United States Patent 10,407,724 (METHODS AND COMPOSITIONS FOR SCREENING AND TREATING DEVELOPMENTAL DISORDERS) - sequence listing, part 71

SEQ ID NO: 1864 - DNA, 2009202 bp, Homo sapiens
tgtaacataactgcgtgctttattgagatacacagtaaagcagtactataatacaatagtaaggcatatatttggtgaagtctgatatgttgtgaaaatgcagtaaaactgaagtttaaaaaaataattcgtaaatgttacagtgttggtgttaaaacacaatatattatgatactcaagtaagaactcagtacctgaaaacaatgacaaaacatgccatgtgatgtttatgcttcagttacattatgatttacagtttaatacttggtggttataaagaacacaacacgaaataatgtccaaattaattatgcttaaaatgcagcaataaagctctcaatttttgttcaaatattatgacagactcactccagagctaatgtgtctaaaagaaaaacaaaaagattaaaacaaaattatttatgcactctatttacctctgattttagaatgaaacttacttacttaaacttcttagtaggatgtaaagtaaccccttgttttaaatctgagttttaaaaatccttgggtaaagaaaaggtccagcgtcacataaaggaaaaaaatgcaagacaaaaaccaaatcttcatgtaatttggtaatttgttaccttagagctttgggttttcttttgaaaattatgaaggaaaaagaaagaattataaaggaaaaagaaaataacgcaatggacaagtggtgaagctgtgaactcaggtgtgcacaattatcaggaacaccccaaaaccaaagtgaggtagaaatagcatgagaagccgtgtttgatgttaattaattaattattaataatggacaaaacccactctccaaaagctaattacacttgatgtcagcccactctccaaaagctaattacacttgatgtcagaggtaacagatttgcaaaattataggtcacacggtggtatctattgaatgaatgatttaaaaatcaaaaagaaataaaatggcatgaaagagtaaagctttttcctaccagtccttagcttttcctcttgagcttttctcctcttttttgagcaatttttgtttgtttgtttatatatttaacctgtctaatccaccaagaagggtttttttgtaacatttgaatcaatttgccttctttcttacttacttacaaacctgtgtggaactactcgcagagaaatgcaaaggatggaaacacagttcatgggcttctgggttgatacctgtcagtatcacaaatgtgatggggctactgttttacaccttttcccaaagtttatttattttaaattatgtcttgtggcatttaaaaactcatcccacatgggacaataaatctaaaaaagcaacaaaaaccaaaccacccagttccttttgactgtgagaagagggcataataatttagttgtaattacagagaactttatgtattatgaacaatcatccaatccttcacttaaagagtggcctactccttcacagggatgggctgggaatccatagccctccagccctatcatcgtcctgctactgcttgggagttaaaaaataccttctgatgttcacaaggtcagaataccttctgattgatttccactgaagcatcattaaatctaaatcgtggcattgctagcagcaggaagctgaatgtatcaatcaatcaatcaatcaaccaaccaaccgattactcactctgatataataagtcctgtgtattcattcacatgttccctttaaaaaaatccaatactttactttactttcgttgtcagtggaaagttgtttaaaatgagaaacatctggagctgtagacaatgttttagtgtggtgtagtttcctcctggcttccggctccgggaaaaatccattctagaccaagcaggtaagcctggatgactgactagaagtaatttctttctattaggatgtgacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaatatagatttatttcttgtaaactcttactgtctaatcctctttgttgtatgaatattataaaaaccatgcgggaatcaggagttgtaaaacatttattctgctccttcttcatctgtcatgactgatactaaggactccatcgctctgcccaaatcatctgccatgtggaaaagacttcctacattgtgtcctggaaaacaaagagaaagaaagacagactttacaaaaggtgcagatagatagcatcactctgtttctttgccatttgggaaatcattccccatttctgggtgaagacaacacagaagctgcatcgagggtgtacacaacaaggtttgatttttcaccagtttccaggaagaagcaaagccttattaatgaagccattacacgttgtttgttagtatcagcttaatgttggatcaggctactggtgtttacatggaaaaatgtcaagctacattcaggttcccaatgtaaatatatatcaaaagaattccatagataagcacaagatttctatcagaacaggaatattccatgatgggatacatcttttccaccttggctatgagtgattgattgattacttactctctacttgtattaacgaacattttttttactatcaatcaaaccaccatcaccaccttcacaactaccactaccatcaccagcacccaaccatcgtcaccattatcactgccaccatcaccgccacaccaacttttcatttcaaagctgtttcaggctgttggcttgcttctgaggctatggtggaggtggctattttctctctgcttttacttgggttgaaaaataataataataaactcttgaattgaccttttggtgcactattaacatttgaattaggaaacctcagaataaaaattgctttacattccaaattactctagaccctaattataaggtgacccacatgtattgtatgcatttgggtattttgtgaatccatcttagagctcctcctaaatgagggttaactatcacaatagccttttactaataatgcagcacgacctagcacgaatctcccagcacggagaaaaagaacagcacaatgtccctgggtacttcgtagcaaaattcagatttagagtaagataatctgagacttactttatggcttgccttttcgtctatgtcccatagttttacatggctaattttaattattgcacattggtaaatccttccactattcaagtattgtctttggaactgaaatgctttactaggctattactaccttgccatgtatcaactttacagattcccataataattgttaaaaataccaataaaaattaaagatatcccaataaaaattaaagctatagactagggagagtattttgttttaatatttatttcaagagatatagcttctctacaaaatgaagcggattcacgggcaggcacttaaacagtgatggcaccagatcaactgaagacttacttattaaaagtttaatgtcattcaggcatttctattaaggtgaccaagtttgtatatctatctttttgtgctttattagtgcaaagaatttcatggagtattaattatattttagaaaatcactttggattttggctgagactgcaagtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattactagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaagtggtgcttctcttccttgaaatggtgttcagttactaactggaaggaaaattcttgagtctctcaagaagcataagttctaggggtatctgctatttaaagatttgccagggaaaacaggttcattattcttaatgtgccatgcacactccgacaaaaagttgggtggcctttaaccggtttacactgctgcattttcacaaatgaccttgtggccatctttgtgctataaaaataaagaacttttagagtcacctcatcatctatattatgcctttggttacttcactaaatacctgctttaccagaataaataattctaatttctttccatggagtttttcattagatccagaaaaaagaagtcaatctctttttacaaactactgccctaaagaatcatactttaatccgttggaggggtaagactgcactgtgacatgactatagaaagtagatttgtatcctagttctattatccatgtgtgtaaggcagagcattcgggaggtcattaatgttacctgacagatttttctaaagtcaaaattacaatctcatactatgaagtatgagaggtactgaaaagcagccaggattcaggcatttgcaatcaccttcaggcacaaggtgacagaaaactatgtctatagaaagtattgatttaatccattcttaaggattattgaacacaaaggcactatgccttgaacattagggcagttgtatgtttttcaagttggcgctaactgcaacacatttagtctcacacgtcaccactgcctgagggaattgttttccacagcgattggaattgagactttctggcaaagatccaagacctcaatagcaatctggtgctctattttttaaaaatacaattcccaaataaattgttagcattcagttgtccaaaggaaagccggaatactacagggaaatttgcttatcttttcttctctataatttaatctctgaaaaaaatctgctttacgtacatttgggatattttcatagcattaaaaaaggtcattattgttttgattctttggcttctggaaacttgtctgaacaccatacacctcaggtagtcaagtctgcaaatgcctatataacttcaattacatgtgctagccttttctgaaattcatttgtgagtgaaacatgtttaaggtggtcaaaattatggtgcatttttctacaaaaagttaaaatgaataaattttaaggggcacttaccataagaatgaacccaagaagtctcacatacgaagtacatgaaccaggcaaaccgtcaggggcattcaatgcttcaccaagtcaggtttcctcaatttctcctcccagcctaccattccctccctggccccactgcccaaagccttggaaggaggcactggcacagacacactgaagaatcattaaattgattagacttgtatggcatgatgttggcagagttttcattacgactcctgtgtttaaatgaatcagtggtctctccagtccatcctgttgctaaggaatccagaatcttctcatttaagaaggactctccacccatccagcctgtctcccagaacactgtcatcccatgggagagctttccttctctcctccttcagattaaattcttggtaaagacaaccttgattttacttgggctgtcagttaacactttgtcatccaacagtcacttaattaggtaattcgatattcagacaatattcctggtggaataggagtaagaagcatctttcaccgtaaaacctgaaaccacattcagtgataagactgcaccctatccctttcaacccataaataggcattttaaaaacctctcaaaactccaatatttaattttttaatcgaattggttattgttctgtgtggcttcaaataccaaataaaaaagatcatcttctgaagggtacgttgagatgatgtaagcctttcaaatgagagttaagagtgtgggtctggagccagactgcctggatccaaatccttggctctgtcacctgggacacactgcttactctctcattgactcagtctccttatctgtaaaacggggttaataagagtacctacctcacaggtttgtcatgaagatgacatgatgaaaaagatggcaagtgctgagaacaatgcttggcacacagtaagtgctcaaaaaatgttcgctaaaatgggagagaaagagcgtaggaaccaagaaaaaaggaaacaaaagcaaaatgaagtcatcccagaagaataaaaactaagggcgctggcagaaaatgctaaggtcctggaagtggaagaaagctttatgactcatcagttatgttcaaggctaaatttattttgaagattttgttagtgttgcaaatggcaacagatgatgaacggcaggattccaacctagggactacaaaggattgccattttaaagagattcttgctcccaaccccagtcttgtcgtcatggtgatgacaacggcaatgaacatttgaggaatgttcctcatgagctgcaagtggagaggtgactaccatccttacatgatgacacaatgtgtaatacacacatgcgcgtgcacacacacaattcttacacaaacgccaaacataaaaagcaggatgagacagacagaagccatggccgtgagcctgaatctcactaacctctctcattggctttccaggggtatttcttcctttaataatagagagaggaagaggcagagatatcagaaagggaaaaaaaacatgcataaatatacaatttcataccaatttgcttcttttaccaaacaaatgttgagatgaccatttattctctgctggaaaaaaaaaaaaaaaaaaaaacagaaacaaaaaacccaaaagacacatctagtcaaataacctttacatacacttaagatcagtgtaaacagataacatgatccagaagacgtcatttgtaaaatccatagagttcacgcattaaactggatgaaaactggcacagaatagaaatctgacaaattgggcattgttttcaaggacaactcaaacttaatgttaaaaaaagtctcagaatctcttcactcttgacaatcagcacattgaaacataaacagtagttgactctgtgtgcccaaagtctgcacatcaaatgcaaggtagaacccgacatagaggctggactccatcctcttgggagaatttgttctatctgatagaagctgagcatttccatgatgaaattggaggcatttgagaaaacagaaagaacagatgaggggaagaggtaagtcccagtaatgggcaagccacagagccagatccaggaatgagctttccacttcctccccaattcagcaaatatcaggagccttacgaggcaatggctaaagacccactggccttgattcatagattcctacatctgtatgcatttatttgtatttcaaaagtagactctgatgagaaagtgttctatgataagtcataattggacagaaaagtagggacttctgtccatacatgtcaatagcctgtcttgggcatgcaatttcctttaaaatcttggttttcaaactgttttaactatagcaatgggacatctcctaaaacaatcttatatggaattccaatattttgagcagttcaaagcagagctgtgagagatcctgtacagcatctccctttcccctccacccatcattctcagtggctccaagaagactaaaaactccctgaaacaatttgagaactactagtctggaatgaagaggtatggagctacgacaccaatagaaacctttcaaaactcactcaaggttagggttcaaaacttctagtatacatttaaggatagtttctaagtttttcttccctctctccttctctttcttccctccctttctccttctctcccttcctctcttccttctgaatttcctacatgactcagcgatttcttaggagtatcagattttcagcttgaccacgtaagggccaggtatttaagatgctcctcaagccagggaaaagagggagaaaaatgggtactagctcctcagctgtgggtgtcactagtgggagatccataccaaatgatgttcccatcatttggggaggagaacatcattctttccttgatggctgaaatcccagtatgaatcactcaccccttctttttgattcctttagcaaggtttttttaaaaaagtatctttatgtttcataatactgtctggtggcagaattaattcccttcccctgtaagactataagcctcttgaggacggggtccacatgttgctcatccacctctctatgcccaatgccctgtaccgtatatacacacttttggtatttgataaatactggctgaagtgaattggtaaagtagtagttgggtcatgaccaagaggagtccttctgtgttataagtaacttgcccttcactggcacactttagtttggatgccaaaggtgggtaacttgtttcggcatgtaactttggtctagttttgaaaacttgagatctttaggaaggacagtgttgttagaaagccatgtgatttagaatgtaattatggttatgtacttcagaatgtaacgatgattctttgaatgcttaatgatacatatctttagtaattctacactaagccatattcagaactcagttatcaattgattatttcttaatatgtagcagcaaatgacttgtgttatgttccagatccttcttcagaaaccatattttatgaaaatggacctcccagagccaagctaactctaatctcttctaaaatcctccctcatcacttgggtccccacgtactcattaacacattacaaaaggaaggtcctttttttcactttagaaaaagttaaaaacaaatgatattttctactgtaaaaggactagttctacgctgacaaaacagaggctacttgattacaacatttttaaaagttcttgaccgataaataaagtttcagatatgtttcattttctaaacatttatttttttttggaaatgagtttctgtagaccttcagttacagtgtccatctggcaatgtgatgtgttgtcaggaaatgaatcaagacaaaagggaagtgtgctggggcagtcctgagtctaaataaagggcttggtcaggtcccgagaagtctaatttcctcgggcactataaaattgacattattgattgtaattcattattttagagttggaattgcaggacagtactgtttctgggtgcttttagcctcttttatattaattcactgactatttaaaatacttaaggaagaataagtccctttttaggatttctgttattttataagtcaaaaaaattcaaatggccacacttgcaggctctttggtgaatatgaatataaatctataaatcaattcaatttcagctcaataatcttgttcagctgaaagttgatcagcacagaagcctgtgactctatacatgtaatgagtcagaatggacaacgaaataatagcgtaaagcagggattggcaaattttccccataaagggccagatagtaaatatttcaggctttgcaagcccacggtctctggaccagctattcagcactgctgcaactactctgccctggtaatgagaaagcaactataggcaacatgtaaatgaatgggtatggctgtgttccaataaagctttataaaaacaggtattgggccagatttggcatttgggctgtatgtagtttgctagtcctggattaaagggataaccgctcaaatcctttgtgggagcatacaggaaacagaatggtgcctgaaaaagggcacaccatatttctatctgcctttgttctttatgttgctcttccataaaagaaccacagaataagattttaattttaaaagacggtaggttttacaaagctgttgggttggtaatttaggggtatttgatagaatgtacgcgggcttatttgagaggggatggtatgaaaaaaagaggatggcatgggctggtggagataatgtggcacaggtcagtaggcaagagattgtacaggtagcagaaatagtagcactgctaactgctttctggattgttttactgcattaagagcttatcttggctcctattattcattcatctatataaagtggtaccacattttagagagcctaataccatactactgactaggagagcgtttctttcatcaatgcacatacatataaaaatatctttgttagtctgctaaatgatcagagacttatggacaaatcacttaatggggttattttttaaattacgtttgtttattgtacccatgtagttttcctatagaatggcagagctttagagagtaccttatagtaaagtagataatgacttattacactataattcaatttctacacatatacttacaaaggaagagattagagatagacagattagatagaaattggctaatattcagtgttcaaatatacactgagccactcaaatctcccaagtgtttgtgaacaactaagtatatctagagaccaaccagaaagatataatcacaaagctgaatgtttacacattcatatcttgaatatgctcctgcttatattgcctattatgcaggatagtgttggccatcggtttatcactaaatggagaagcatgccactcatttattaattttgataacagtttagcaaagccattaagataagattagaagcctaacttaacctgctgaatggccataaataaggcacttgacttttcttggcttccaggtactctttgtgaaaataaaagataaagaaaggttagctgacaccttcaggaccaactctgtggcaaggggcaacagaaaagttgtaaatttgaggtacataatagcttacctatctatatactttatgtttatgaagagcataagttttttaaaaacggcttttcctctgtgggcaattatctagcagggttaagtaaaccacgcggtggtatttaatagcacatttccactaaatgtcagacctctggctctcacatctgttttgagttactcaaacagctgtccaaaacagctgtagcaatcatgaactttgttttttgtaacacaacaatgagaacatggatggtagtgttagaataaaactataaaggtctctgagacattagcaacgtcttggcagaaacttccacggcaaaaatctcaaaatttaaatttttttgaaagataattcaaccaggcaagaaaaactgagatcacatagattagtatttttaaaccactggttcagaaaatccatttagtgggttgcaaccagcattttgtttttaaataaataaaatagaaaaacagcatgcactgtatgtagtatggaaggcatcacttgatgaaacttttgtttctgatctttgtatgcatatgacactgtaaatgtgtgtgtgtacatatggtgggtgtatatatacatgtgtgtacataaacacatgtacaatttattttatatctttaccccagtttgtgatgtaaaatgttcctctgatatggataaccatcaaaacagagtcagaaatcactgtcctggatgtcaaaagtgttaaaatgacctttcaaggctcttccatttgaaagactttgtaatcccaagatgttaagattctcaagaatttctgcttaatatcagctgaacacatctaccaactggtaagatgttcccgccaaacttgacggtatatgtgtgtgtacacacacatatgccatttttcaaaattaaaaaacaaaagtgcttttagttggaaagaaagcatccaaaaaccacttttttgagtgcatcaataattagcctaatttttacaataatgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcccttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggctgcctatgaagaagcagagtcatgagccttgctgtagcttcttctctactaacctcttgtttagatgtggaagaaatgcccagggtgccaacagggcagccagcaactttccagagcaggtaagcaagctgccagttcaaggggccaggatcatacagtaatcaatgattgtactgtgatttgaatttctttggagttctgtatctgcaattgaccataagtaccttgaaggcaaggaatttgtcatttcttctttccatccctactacctccactggtacgtagtaggtgctagtaaaagcaagcaggacaaagtaatgaggagacacgtgaaagcacctgattctgtcaagcctgtgtatgatcttctcattatgaattatgacatctagaagaaggagatacctaagatagtcagaatggggatgcgggtggcggtgggggatgtggaggtgggtggaagacagataagatttttatctgttaaaatcatcacttcagtggcgctcagcagtgaaaagatggctggtgcagacatttaaaattagcttcccctgacggttccttagcaacgctctaccagaacattattgcttttaatgtgcactgcacaacgtttacttgcacatcaaatagctaggaaatggccattgttaactgacactgaacaaaaagataggaaaaacacactactcaatacaccctcctcattgcccttatggagaggaacaaacagcccagatttcctgctgcccgtccctcccaggctacccattagaggtgccaatcactggccacaaagccttgtgttttctcccttttgtttctctaggcttttcttctatttgatcacaggtgactgccaccatcctttttattcgttgaaggaaggcgagagagtgactttgttttatgtgagggcaataaaccaaataaatgcccccagaaacgaacagtagcagcaaaacatcatcttggatgaagcaagacatctgaagctcatgcaagccagtgggaaaattctgcagggtaaaatgctgtttttgtatgggggtaaaatacgcaaggccaaagtgatgaagaaaaagaaaaatattaatgtctttctttgctaagcctgtatttcctctatcgaagtaaaaaataaccaactactctatgaagatttaattgtccctatatttaaatgatggagtaagatacaatttttaaatataaagggcatcagatggcaagtcagaatctctaccactaccaatcagtaggcattgttctaggccttgctgtagcacgtagtagccatatgtccctggcaaaggcactatcagggcattaatttcctcatctgtaaaagtcacataataattgctcttcagtaaagggcacctcataattaactcttcagactaatgtgtgaagcaagtaaaatacttgacaaatagagggtggtattcttatttttggaaacatgttgccctcacgggtatttgaattcagagtactctaaaccacaaattcacacttaaaaatcaaatcttttcaccatggacccaaattgccattctgatactgcgtgttggcttccatatggaaaatacacacaccagttgggtagggaagcgagtggcctgatcccagcaaatctgagtcccttctaggtattggagcttacctcttgaactagggaaggagttgttgagttgctccatcacctcctctaaccctgtgcttgtgtcctggggaggactgagaagatcttcctcaccttaataaaagcaaaaacaaataatggaaaattacatttatagaaaacagatattaaagggccatgattacatttttaacaccattataaattcatttcacttgctcataaataacaaagaaaaccctcaagcttaataatgaggaagtaattctttaaagggaagaagaaatccatacagtagtttatctatatcattacccttggagaaaaaaaaactgtatatctttttttttttttttttttgagatggagtcttgctctgtcacccaggctggagtgcagtggcacgatcttggctcactgcaacctccgcctcccaggttcaaacgattcttctgcctcagcctcccgagtagctgggactacaggcatgcgccaacacgtccagctaatttttgtatttttagtagagacagggtttcaccatattggccaggctggtctcgaactcctgacctcatgatctgcccacctcagcctcccaaagtgctgggattacaggcgtgagccaacacgcccagcctactgcgtatctttttaaaagttgactagttacttgaaatgtgccccgcacatagaaatgataaatacatgagataatgaatactctaaataccctgacttgatcattaacacattctgtgtatgcaacaaaatatcaaatgcactccataaatatgtacaaatattatactacagtaaaaaacaggctgggtgcggtcgctcatgcctgtaatcccagccctttgggaagccgaggtgggaggattgtttgctgccaggaatttgagagcagcttgggcaacatagtgagaccctgtctctatttaaaaacaaaaaaacaaaaaaacaaaaaataaatttaaaagttaaaaagaataaaagaaaaagtcaattgaaaaaggtaaaactgacaagctctcttttgtgccccattcacaaatgtgaaactttgttctatgtaataaaataagtattactgcacacttgcagtgctgtctcctcaacacaaaagagtaagaattgaacactttgcagtcacttcatgaaggtaagaagggagttgagacactgaggtctttttttcactctttgttttgacatttaaccaaaaatacaaacgaaactcaagtacctttaaactccaatgtaatagaaataaaaatagtatatatcctatataggtaatgaaatatgaatattctaaaaactgtagatatggcatatattggagagttatggtcctttcctctgttacttgggactactttatcataattatgttttgggttttataaagaagacattacaaacattttgactgtttatgtgaggagagaatgatgatctggaagcaaagaaacctatggatggatgatattcactgggaatggaaatctccttgtagattttgtgaatctgtgtctgtattgtttgttcatgtgttaaagaaatacacttcaaacagcatttgcaagttaaagggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattagaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttcctcccccctcacacacatgcactatttgcttaagtttatgcctttagaaaaagaagtgaaattcactatttttagtttcatttttcttgcggttttaaactaccattatctggtgaagatgaaatgaatgaaatactaccaagaggatcaagatcctgacaactgcagggctgattacatctctctgtttcattactgatgcaaatttttgcggaactgggaaacatgaggcatttttaatggcagtaagtccacttcagtgacagtatgcctcactgaataaatcagaaccaagagaacatcatgaacgacgctcatgaacatcgatgttaatatttctgacagtttaattacatcatattggagctctaggaactcaattgtactgtgttaaaattcaggtacagttcaatgaagtgactggcattcctgttcctgaattatttcaaagatcaaattataaagtataaacctaatgatgtcagccaagtttatttttccagataaactctctgtgagtctttaatatgagtgtccaagtataatacaaatgtaaaattggcttctttgctttaatggaaaacttttaaggcagtgataattgtatccattcagacatttttttgagtgcctattacattctaggtagtataaaaacaagtagagtataatcttgttttcttcttttctccatattttcatgatttctcaagatggttttaatgcattgctttttttctctttttctttttttttgagatggagtcttgctctgtcacccaggctggagtgcagtggtggaatctcggctagctgcaacctctgccttccgggttcaagtgattctcctgcctcagcctcctgagtagctgggactacaggcgcgtgccaccacgcctggctaattttttatattttttagtagagacagggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcactgttcaaatggttgaacagtgcctggcatattgttcactgaagatatagcaataagcaaacaaaccccacccacacactctctctgtgaaactcgcattcataaggaggcacacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatagagatactacctgagactgggtaatttataaaggaaagaggtttaattgactcacagttccagatgcgtgaggaggcctcaggaggcctcatgattataagtttagaatcatggtggaaggcaaaggggaagcaaggcacctcttacatggcagcaggagagagagagagagagagagagagagagagagagagagagagagagagagagagagagagagaagggggaagtgccacacactttaaaaaccatcagctctcctgagaactcactcactatcacgagaacagcatgggggaaaacttcttcatgatccagtcacctcccatcaggtccctcccctgacacgtggggattacaatttgagatgagatttaggtgggaacacagagccaaaccatattaataggcaacctcaaaatatttctgactctaacaataatacctgtcatcacaagcccctcatcaccaaaaacaaaaacaccttttcacttttttcacttattcaacaagaaaatactgagttccagttgcacactagagacctgcacagcccttatccctacttcacagattcattgcctgctcaaatagcatattgctagtctttgggggattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatggatgcacccaaatgtcagaaatcaccaccgaagaacttattcatgtaaccaaacaccacctgggttccctgaaaactactgaaataataaaaagagaaaaataatgttttttggattattagctatttggtcttcctggcttgtctgattgtggtccaaataaatcactgaaacattttttaaaataaggaaagacatagtcaaagttaaatagtaccgtgatatagcaaaatatgatagtctcctttaatcactgctgaagtgaagaaaaaagaagtgggatgactcaatttaatccgagaaaaaagaaaaggaatgctttgccatggcaagatattcttcagtcttctgaaatataacgatggtttcagatccctttcttgaagggaagatatcccatctgactcacttccctttgattcaaacgctgataatggttctatctgcttaaaaagtgattttagccagaacctacgcagcctatgcagaatagacacaagaattactcctgtgtttttgtctgaatctaaacaaattattttctcttttttttaaaaaggagctgtgtacaagaaattattttttctcataaagggggctgtgtatgaacaaatacgcccaccaacatttttctttggattttaaccagtttccgacttgatgtgttattatcttagtacttgtgtatttcctgcctttctccagtattttttagaagaaaaagcacactgatgtatccaatacccaacatttggctacaattaatttttttccatatgatataggaccgatgctttcaatttcacacataaattctgtgtgtaacacctttaacatattatggtgtacaatgttgttgctgattattagctgatcagttgtgaatggtggtgaaagatactgaaactagtagctaaatttcctaaacgtgtgggctgttccatgtgtacacaagaatgtattatgcttgatttctaaaatattaactcaacaagcactttactgattgtttgttgcacagagtatcctcatacagtaacgacaatgagcaagacttacatcctgtccttaaggagcttaagttctagggagttgtaggcagaagaaagaagtactagtaactggctgaaaacatggctgggtgtggtggctcatgcctttaatcccagcactttgggaggctgaggcgggtggattgcttgaggttgggagttcaagaacagcctggccaacatggtgaaaccctgtctctactaaaaatacaagaaaaagtagccaggcatggtggcgagcctgtaatcccagctactcaggagggtgaggcaggagaatcgcttgaacccaggaggtggaggttgcaatgagctgagatcgcaccactgcactccagcctgggcaataaagcgagactccgtctcacacaaaagaaacaacaacaacaacaacaacaacaacaacaacaaaaccagaatgatataatgcatgattaagttccaaaagaaaactcactgagtgaaaagaaaggatgctatatttcaggttaagaacataatgtactcaaggccaaagagcacatttattctgttgtcaaacagaaggcataaaatgcttaaagaggggaataatatgatataatttgaatggtagaagaggaactgaagtttctggaagatagcttagaaagggagagagaccaaaggcagaggaaccaattaggaaagtattcatattgtctgttcaggtaacacatgatgagggctaaatttgggcagaagtagctgaattgaagaattttgctctttttcataagtagcaaaacacactgaccttggtgactggattgatggtggtggaacatagctaaggaaggcaggtaaaggaagaaggggtagaaaatgactttgtatagattgggaaattggaagagatgctccaaaggttgatcatgatttcagattaggctatatttttatttataattttatccagaagatgctcaggtgggaggtctgggctggaaatcttgacttaagagttgtcagcatagcagaagccaaagtatggaaggagcgcccagggagagtgaagaacggtgaaggggatggagaatcttgaggaaaaccttgatgtgatgtactgaggataccttacctatatggtaatctggcataaaacatttaacccgaacccaatcacttggatacaagcagacaaattcaaattgggggacattctacaaaacatctagcccgacctcttctaatatatcaatgtcatgaaagatttaaagaggctgggaaagtgcttcagattaaaggagactacagggacatcactgatcctgaatgtaaaatatcgctatgaagaatattaattggcagaattggaggtatttgaatttaaattctacattatataacagtattgttctttttgagcatgataattgtgcttatgcaagaatatctttcattttagaaggcacgtgttcaagtgtttaggggtgaagtgttatgtatgaaacctaaccattgagtggatcagtgaaaaaaaaatccacaaactatatacacgcatgaatatgattaaatatgcacataaaatataaacatatacagtatataaaaatatgttaacatacagatatacatgttaatctaaatatatgcaatccatttaacaacacatgaatgtaaaagtacataaataaatagctataaagcaaatgtggcaaactgttgaattaattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacgtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaaggcttttttcctttttaaatgaagttagcttatgcagttcgatatggtttggttctgtgtccccatccaaatctcatgttgaattgtaatccccatgtgctgcgggaggggtccggtgggaggtgactggatcatggcggcggtttcccccatgctgttctcatgatagtgagttcgcataagatctgatggtttaaaagtgtggcagttctcccctcgctttctctctcctgccgctatgtagcacatgccttgcttccccttcaccttcccccatgattgtaagtttcctgaggcctccccagccttgtggaactgagtcaataaacctctttcttcataaattacccagtctcaggtagttctttatagcagtgtgaaaacagattaatacacagttcaagaaaaagtacccttgaattcagtcttttctttcagaggacaaatttaacacagcttatccattttatgccagcaagttatctcttagcttagccattggaatatagcacttttgtcctggtattcagttctaccatgatctttttagctccacagatcatcaggaccacatcctaatgtgcactttaatttgagtgctttaacgagtatgctgcctattcgccattgtcaacgacctaaataattattaatgcttctaagcacccagggctctgaatctgaccactaaaatatgtaacttagtttcatatgctttacttacttaaaaaagggggaaaatcctgaagtagaaaaaaataagaggtactaaagctcagttgttttcagaatttacagactttgcaaatgcatacagttgtttttcatgtagtgtgttgtcatttacaatcccaacagtttattagctatattcagatctcaggtggagggagataatctgacacagagattgccttaaatcatggaggtgtagtaaattcaggaaaataacctcaaacatatccttttccttctcaaaaaaatcaaaacctggctttcctacaagatttggcttctccagaggaggatgtgcctcttcccactgctccaggttcttgaacttcatcacatttatttcaactaccctgtctctttcctcagaaatgttcatctcctcagagccctcgtccatcttcttcaacatcttttccatcctgatctaccactgtcgtcaggatctggacctcacccctctgctgataagctcagcaacgttggtctcatcaactccatgaactgtactccctacccctcagtgatctccaagtaaaatcttcagcagctcgctgggaggcaccatgttagatgtagaaattgcttgaaagtattttacttccatgatatccaacttttgaattttcccgactgtgatctccaaatttttcgccataaaactcacccacacccctgacttttcctttctgtcctatccattttggttaaggcactttgcctccctttattctaccctcatggaagagctcaagtatgaaatgaattcctgaacacatcatcatatcaggcaatagagctgtaagtgtatggaatcaaggagtcacaggtcttttctattctgtgaggtaagatttgagaggaccaagtatataaccagtttaggtcccagggaaaagtaaggagagaggatggagctgactcctactgggcctttacagagaaagagaaatgaggaagggggaccaagtatttgtggccttcataaaaccctctattgtctagccagacacagcaggaaaaaccaatgagcagctggctaggaacccctgtcctagccattcattaccactgtaaaatgccctactcttgttttgacctttgatcatttatgcctcatcagctccacctttcttagaacctagtcctaggcagagaacattgctaagaatgagaacagaacatgtggaccatttcctcaacaaattcatccaacttttgcctaaggcttccttcttacttggtaatgtttcaaaattgtcttcactttccttaatcctcattcattttaagattacctagtctttcatttcattgaaacagaagttttccaccttcccttctcttggcctaaaatggtttctcaaaattacccaatgcatttatagtgacccaatggactgtgatttattttaatttccattgagctctctttagcatttcacctttttgtcacatcttccttgaacctccctacttatccatcctttactatcccattacccaaatggaggtcttttccaaggcactggatcgaagcacctgtgttatagattttatagatttctcatctcacacccttcagcaatcaattctatgaaactcattctcaaatctctccagtttgcccacttacttcaagtatagatctgtatcttaatttcttttgggacatgacttagaagacctgtcaatttctcaaacacattatgtccacaatcagaagtttcactatcttcttccaaccaaatcctctcccttcattcctcttcttacaatttgcactcagtccccagaccctgggaactctattttttttttttttttttgagacacagtcttgctctgtcgcccaggctggagtgcaatggtgccatcttggctcactgcaacctccgcctcctgggctcaagcgattctcctgcctcatcctcccgagtagctgggactataggcgcccaccaccatgcctggctaatttttctatttttagtagagacagggtttcaccatattggccgggctggtcttcaactcctaaccttgtgatccgcccacctcaccctcccaaagtgctgggattacaggcgtgagcctccacgcccagccccctggcaagtctatttttatagaatagtctcacagtcctctcctcccacatctctcaagtgcaggccctcagaactcaccaatcttggccttggcaattgcctcctaactggtcttctcacctatacaagttttctgtgggccagatagagctgccagaatacacctttttagaattttctttttagacttttttcgcctggtatatgattttcagtggctccctgataccaagatgagtcaaacacttacggccaaatattcatgtccctgtaatacgactctacctttcttcagacaacaaaatctgagagtagctaggacacttacccatggagtccgaagtttgactgccaaccactcggagcagcataggctgactgctgtcggacctctgtagagaggtagaaggagaggacaccgttgtgccattcactttggcctctgcctggggctaagtcatccaaaagaaaacagaattacttttcataataaacatacaaatgtataaatttcaaaatatgatacacactcaggactcataaattttgacccttcctactttagaagccctcccaaagattgtttaatttgggatatttcactgttgatataatccatagaaactgtctttgtatctgaattgtgctcccttataaatttgagaaaaaaatcagagctacactggaatgagactatacatcattacattaaataactggaagatttagaaggtcatgtgtgaatgatgagactatgtgagatctcaaaactgtaatggaagattcatatctttgtgaagtattaagtaacaagatagagagaacataattgaaaaatttaaaattcccagaaagccagaactatgtccaggtaggtcctcttacaatgcagtatcttgctaggttttcgatggaggcttaaagaactatgtgttagggattaggagaaaaaaaacacaaaggtataccagaaaatataactaattgtaaatgaaatagttccatttcaagaagtgaaatattcacttttagagaactagtggaaacctttaggcgtttttttccccaagatgtatttcaaattggtcaagaaaaaaccattttggtaggaaacaatattggacaaatacaaaaaagacacactagtttttctatctcctctacttctatcctttgatactatcactttgcaggcacataccaagcacttaagaattgatgcttgttgcacctataaaaagtgctctctgaggtttagttttgtttaagagggaaaaatgaatgtttgtaaaaatcccatctctctcctcacttgctccagcagctgccttagcctgtgtaactgtgactccagctgtttattgtggtcttccaggatttgcatcctggcttccaggcggcctttgtgttgacgcagtagcttggcctcagcaatgagctcagcatcccggggactctggggagaggtgggcatcatttcaggaggggacggcagtggggacaggcctttatgttcgtgctgctgctttagacggtcatattctgcttgcagattcctattggcatcaaaaaagtaaaaaagaaaaaaaaagaaagaaaaagaaaaagaagaaaaaaagtaatttgaatatcatcaccaaattttatataccatggtagatagatgcatctgactgccaccgaagaacagcaagcaaaagaggcactaatgaatggttttaatgatgacaatcttaccagtgctaaaagaacaaaacaaaatttgaagcttttgcctggtgtgtgaagggagccatgcttttcaattttttatgttacactaaaagcctcgcgactggtatgttcagataagtaagcagcaaaggatttaatcactttgtaaatatttctttataatgtcatgagattaaaaattttatacctctatcaacactttggtttgctctaaacattagcaaatattttcaacagaaatgtataagaatggagtaagtatacccatgttcctatcacctccccttgataagtttatcatttgccatattttcttcaaaagttttttgaagaaagaaaagttaacagccaaagcagaagctccctcacatgcccgcctcaacaccataccattctctcctccccgctgccctcaaggagataatgccacactgaatttcatgcccagtgttaccatgaatgtatcaacaaatactaggttgagcttaaaaaagatgctgatgtttgcctgtatttttctttcacctacaaaaacacccattttatgtgattcaatctaataacattattttgcatgtttttaaactttaaatttaagaacttcacatttaagaatatacataccattctaagagttgctttttgccttcaacaccattttggagatttctccaggtcgatacataatagtttgctattttaactgccataaggtattattattctgttgcttgaatatgccaacattttcctgtccatggacatttaggttgtttccaacttttcactattataaacaatgatacaatgaaattcttttttatacctatctccttggatacctgttgaagagattctttacagaatatagtttgatgtggaattgttggatcttagcaacatcttcaacattgctacatgtcaccgaatcgctctgggtgacaaatcggtgcttttaccaatttactctcgcttcagtagtgaatgaggttttccatttggcccacctcctcaccaaatacttggtgttatcagacattcaagttttagttaacctgatgggtgcattttaatttgcacatacatcccggattactggcaaggttagacttcttccatgttaactggcttttcatgcttcctttacccattttcctgctggattgtctttttctttttaaacctttggatatgttctagatgctaatccattgttagttatgtgcatggcaaatatgatcttctacccttatcttagtgtagcttatctttaactttgcttatggcatcctatggtataaaagatgtaaattttaacatatccctgtatgttctctgctttttatgttttgttcacgaaaatcttttcttacacctacattttaaagtttaaaatttggtttttcacatttaggacttgaatttacccagaatctatttttgtgcttgccgtgaacatgcgatctaattttacttttcccccatggataaactatgaagccagcctcattcattgtatggtccatctatttcccactgatctctaacgatgcttccgcaaaacatcaagtgtccataaatatacaggtgtgcttctgagctctgtattctagtctgtggttctatctgcatatccctggtagatcccacactccagctttaaatcaattgatgtctgataggccttctcagcccactttgtttttcctcaaaattgtcttgactattctgacccctttgatcttctccatgattttagtgtttggttttctgattttatgaaaatgcttgttgaaattttgagtttgaattacattgaattcataggttaaactgggaagaactaagttcataataattgagtcttcacatccaagaatgcagtgaagctccttacttactatggtctcattttatgtccattaataatgttttacttgttactcttttttttcctcttgctttacaggttgaataagtcattgattttttatttttaatgaacacatttagggttatacatttcctccttggtaccactttaattatataccaaaagtttttatatacatcacctgattcaattcagtgccttatgttttgtaattcttactgtgatttcttttaacttaacccatagtcatttaggagcacagtggttatatttccattttcacttcttagtgcatttctaatttaattgcgtttcaatcagagaacccctgtatgatactgatcctttgaaatttagcaatacttctttttgtgacctagttcacagtcactttctaaaaatgttcattgagtacttgaaataatgtgtatttttccattggaaagatggagtctctaaatacatagtgtgctgattttgttgttaaaattgtccatatctttattaatttttgattatttgtagctatcaatttttgttagatgagtgttgagatataattatggatttgttagtttctccttttaattctatcataattcactttatatatttctagacctatatagttagatgcacagaagatcctcgttgttcttgcactgtttctaggtagtatactttttcttcctaataatgttgattgccataaattttattccatttaaaggtttctatggttattccactgtcttttggttatatttggttaatttccaaataaatataaacagtattagcacatgtgaaggtcccaaatgctttaggatttactgagaatacaattccaattgaggacatttctgatatttgatatccagtgactgattagaactcttgacatctttcttctacttgtgataaataccaaaataagatgacagatttctgttgttcacagatgatatttcatcaggtgagagaaattcctatccacaaatgtgggagatctatatcaatgagaaaagagatgaaatgtaagtagtgagtagccaagaagagttttcccattgtccagtttgagaaagcaagatcatctcatcaccaggtctgctaaatattttctgttgtcccatactcggaatgaacattccacaggggacggcatgtcttccaaaatgctcagtttcaaaaggctagatctccacatggaagcagaaagaaaacccaatctactctggtttttttctttgttttgttttgcttcatttttttcattctacctagtacctaacattacaaggtttccaggaatttatttaaagtcacacagaaaatcaatgtatgatctttttcatctacagaaatagaatctcctatctgtactgattgaaatcctattgctatcagccttcaagggtagttgtttgtatagtttatttcatagcaatctgctttgacaaagcagtgatgagaagagattcatcgaagtaagtacaccttcagtcagattctgcacacgggtcttctgggtgtgcaccgatgtatgtaactgtccacattaattaaatctaatttctgagaacttaactggcaatcagttcaatgtttctgtgaacttgaagcagtatccaatgttcacaaggtctcattccataggaattactttctatttttccctcttcattaaaagaaaacttcaacaaaatgttctaactggcaacactttttatgtagaatcctattcaaatttttctttctaccagattggggcagccatggtgttccttttgaaaacagtttttagacatggacctcaagatggtacaacaagccattactgtcttcccacctatttttcacaaaggtgctgacaggagactgccttttctagagagatcttccttggtatcttgatcctgtgggtttagttgtccacagggctcttcttttatgatttatttataaggacccttgttcaagaggcatggtttggtatatacaacacattacatttctgttttggtggtttccagtgaaaacagaaaaggctcattttaatcagccaaagctgagctgtaaagaatatcaattgctcaatgcaggcctttctttccttcccagatgtttgaaatttctcttgggagcacatttccttcaagactcacatccttcttcaattctggaagattctcagctatgacagcttcaaatattacttctctaccatttcctccattttcttctgaaacctctcaaatacactcctaaacaaacctctaaattctagtaaggtatattgtagagcctgtggtcaattctccatttctcctaattgctcatttatatttcttatctttttctgtgagtgttgtacacagtaacattctcagcatcatcttctaattcccttgccttctctgacaggacaaagtctagaatttatcctgtatattgagtttagtaacttcaatgactagtttttttggcaaagatatctttgttttcagacctagttacatttcatccatctctgtttcttagtttcttgttattttagcgagtggtaccccttatttatgcctttaagcatctttttttttttttttgagatggaggctggggtgcagtggcacgatctccgctcactgcaaccaccacctcctgggttcaagcgactctcctgcctcagcctcctgagtagctgggattacaggtgcctgccaccatgcccagctaatttttgtatttttagtagaggcagggtttcaccatgttgggcaggctgttcttgaactcctgacctcaggtgatccacccatctcagcctcccagagtgctgggattacaggcgtgagccactgcacctggtctgagcatcttaaatgtaagtaaaaatctttgttgtactagtgtattattttgctttcttctagaattaattcatctttttttttttttgagatagggtctcactctgttgcccaggatggagtgcagtggcacaattatggctcaatgcagcctcatcctcctgggctcaagcgatcctcctatctcagcctcctgagtagttgggactacaggcatgtaccaccactcctggctaatatattttaaattattttttgtaaagatggcacctcactacattgccctggctagtctcaaacacctgggcacaagcagtcctcccaccttggcctcccaaagtgataggattacaggtgtgagccactgttcccagcctaattcactttttgatgtttaacttgggtggggggtgctatcccatttcttcatgtattttggatcgtgatttggagacaaattttgcaagggatgttttgcatgtgcatacatatgcatgtgtatgttttctattattctcatgtgtgtgtactttaatattttcctctctttttaaactcattatctctctctcaggtggttttatggcttctcccagccatacccaggggcttagagtttagagccacatctgttggtagtttgcagctcctacactgagtgatacagagatatcactcatttcattgccaggcagtaggtagattggttcaggtcctggtttcaaggctgtgatgctctctttcccaactgcgaatctttgcctcttccctcggctctatgcattagggccatagctgcatataagctgtagacccttgcagcaaactgtttcttttcatgttgcttttaagtgtaagtgtgtatgtgtctctctctaggtgtgtttttgtggggctctgatttcaaatagtaatcctggctttgggccactaccttgtaaggagaattttaatccctgttactacagcacgagctgaaagcccactaatttagccccacttacttttttttttttctttcacatttctggttcacagagatgttcatcttgctttaaagcccagctatgtctttttcatttttcactccatatattatctaccactggataaatggtaggagcagagaaagatgccttcaagcaagagctaatgttatcttaatcagaagcctaccaggacacattgattttgtagatgtatagtcaaggttccctcagtattaattcaagccttaattcatcaggccaggattaaatgagtcgaacaagtgcttttcttctaaacaaacatatgacatacagaaacctcttattaagctcaatagcaaacttgattttgagggactagtttttcctcctgaagctctgagataggacaagctgtcatgataaggattctaaaagccagaaatggttaaaagaggtatcttggcctgcaaccaaatgaaataaggttttttgatttgagtctgaattctcttttaaggtatttctaaatgttcatgagaattatcaagaagaactgatgctggagggtttgaactagagatgatttttactaaatgttttctaataaatgcagtcatagtcacagagctgtgttagggcatatttttgttaggggttgggaaattgagccatttagcccttatcaattacgcatttgaattttcttatatttaaaaacatctatgccaatactttttgaggtataccataatgttagttttgatgcagtattaacgtaggggagatcattctcataaatgatcaaggttccctcagagttactgttccaaggtaagttattctaatgttttttttttatttttttattttttattttttgagacggaatctcgctctgtcgcccatgctggagtgcagtggtgcgatctcagctcactgcaagctctgcctcctgggttcacattctcctgcctcagcctccagagtcactgggactacaggtgcccgccaccacgcccggctttttttttttgtatttttagtagagacagggtttcaccgtgttagccaggatggtctccatctcctgacctcgtgatccgcctgcctcggcctcccaaagtgctgggattacaggtgtgagccaacatgcccagcctctaatgtttaacaagtacacaatgcactcgttttaacagctgtcaattattaccaatacatattttgcttttcttgaaggtatacacgtacatctcacccctaatgattctctaattgttagaatgtagtcatgaagtcatttcaatacagatgaatatatgtcagtgatcagacaacgactccacagagaatctatttacgttcttgattatcttgtaaattatatttctctggtagctccctaaggaacattaattcaaattcaatacacatggcttctgtcactacaatttcttcctgtagccagtcatcctaaaaaaagtcttccatccagtatttcttattctctatagagctaagaatccccccattctacaaatatgtagatatatctgattaattttatgtcataaagaatataaactctgttgtctacatacaaatttacactcaaaaaaacttcccaaccaactaatggacataagagattaatcaaattggcaaggcttgttcccttaactcaacctgctgaaaacatgaaagcagctggcccttttagcaatgatttatgagtgcctctctagcaatcgtaactattatgtatgataaagaacattacaacaatctctgtgtaatttaaactaatttacaaaggtcaaatgatttcagtgtaagtcatctactctttaaatggagcttccctactacgtgtagttatatagttgtataatgatatttatgaaataaagaaatgaaggtcactttccagtgatcaatgttttcttaacagtatcatacatttaactgtataccaaagcatgagcacacacagggattattttgtaaagtagaacaactacaaagattgccatctaaaaggaatagatccaaagaaatctggctttaccctcatataatattaaaagcagctaaatcatatccaccaatctaaattcaggcaaatgtagtaaatcatacagaactattacagcagctataaatgtagccaatcagcagtttttttttaaatgaaagacaaattctgcaagcaagatgaactttaaaaactggaaattgcattgagcccttgaaattacaataaagctcagtgcaatggctcacacctgtaatcccagcactttgggaggttgaggtgggaggatcacttgagctcaggagttcaagaccagcctgggcaacatagggagacacccccaccatctttacaaaaaaattgaaaaaaattagccatatgtcgtgacacatgcctgtagtctcagctactcaggaggaggaggctggggtgggaggaccgcttgagtctgggaggttgaggctgcagtgagccatgatcatgccactgcactccaagctgggtaacagagggagactccatttaaaaaaaaaagtgacaataaaattttacagtacagctttagacatctttatcaaacacaaattcaaaaatacccctaaactaggtggaaaaagacattaataaggataagctcacagggtgagaagtaagactatgcatattttaggtcagccttaagcaaaacagtaaaaatggcaggacccctccaggctcttgtttctaatcatttcttagcactgtccccctttaaaacattcagagccttacttccaagccctttcctactgaaatttgctcagtataaaggttttatataagacatttacattttactgggattttataataaagttgtcatttcttctagtgatatctgcattttaaaacagatgtcaaagaacgtaaaggaaaaaaataaaagctttgccccatcaggggaaaggttgaacaatgccactttttgacacgctgcctttgtggtgcctttcaccatccatggctgaggagagaattagaacaaggcttgagagatggtcttggattcagaagatcttgatttatgacttacttgcctctgctgcttgctgaggctgggcaactgacttaagcactaattcagttatgaggattattaagccagtatggtcgacattctatatgtcaaactttctttgaaccatgcccagcccatactgtgttcaataaatgttggttactattattattgttattacttctttctctatatattatttactttttggatttagaacctcagatgtgctaaaaacttcctataaaaagaaagcacttaattatctgaaatggaagcaatctacttagacctactgagcttggcagaacatatgcatatctagcgcttagaaagtgactaatcactcagtatttgtcctgtagatacctgagttctagcccctagccacattgtagccacccccaaattttggaattattgtgtatcatccatcatctgtgccttagtaaagtttatcacagctgaacatctgggcaaaatgaaatcactgagttaagatcactaggatgagatttccttgatttgacccaatacgctaggtatgtgatgaaactgtcaaattataatatgtccatggatcattgctgaaataaaatatgtggaccaagggtacagggttaatgtatctaggtggagtctattttctggatatgtcattgacacgtagatctgtatcttgctcaagttccaagagacagaacatgacaatattaattggcttcagtttcttaatctttaatgactgagatgtttttcacaaattcctgatcagatgctaattcattactgtctatagactaaatgtattaatcaaaagttcaacacaagaagaattcataagaaattttaaccacttataactggaaataagacagactaacaaaacctaagacaaaaatggcagtggctggtcatcatcagccaaaaggaaaaactaggattggagaggttttagaggtgaagaactctagtcctcaggaatactgccattgggaaaagtgtgtttccattttcagacaaatacagcaaaatatcaaactttcattgtctgtggtcagcaaaaagccgtaacagtctctagaagaatcataattttaagctttgtgtgtcccggcttcaatccctcatgcgtagttagacttagtcttaagttctcccagtaacttcaatttgatggcctatttttcactccctggcatgcactgctatatactcttgccatatatgatcctatggcctcctctattacaatgacagaaactatagaatcttttttttttttttctttttttgagacagggccttgctctgtcacccaggctggagtgcagtggtgtaatcatagctcactgtaaccttgaattcctgggctcaagtgatcctccagccccagcctcttgagtagttgggactacaggcatgagccaccatgcctggctaattaaaaaaaaaaattgtagagacggtatctccccatgttgcccaggctggtctcaaattcttggtctcaagtgatcctcccacctcagcctgccaaagtgttgggtttacaggtgtgagccaccatgcccagcccagaataacttctttaaaataattaccggtacttgtacatgaatgttcatagctgcattatccataacagacaataagtagaaatagcccaaatgtccatcaagtaatgaatagattaaaaaatgtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaaaattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtcttcagaattatccgtgtggacattaaatattttcagatgatgagttttaaaaagagtccaaaaataagcccagaaaatgcttaagtctgggttagcctaaacaacttggatggtttcagtctaatggaaaatgacatcacaaactaaacaggtatattaagggattttgggaaagaaaataatgtaagaaatgagaaaaacaagggagatacctgaaaatcaaccccaaaaacccatcaagtaacagaaaaactccaaaggatatttacccattcatttttatgacacatttatgtacccagtgctgtggagataaagatatatgtaggacactgtcccttacccttgaagagctcacattctagagtgtgggatattgtttacttccaccatggaaacaaaccttactcgaaggcaaaaagactgggaatcatgctcactgctaaagctaaaaatacagatttttatctttgaaattatcgccttgatttaccaggaaattacaggaaaagaatcatatggatttacttatgacttgtagttacaacagacagactagcaccataaggtaactcagaatttggagacacaagaaaaggtcatattttaactattaagatagtaaaaaaataaaatgggtgagtttagccatctgcagaagccatccatgtacatatgtaataccaacaggaaaccatttctaactgggctgctcatgcccaattacaatcaagtacatcaggaggtccttggtcttcttcttacacaaactctcttcctaggaggtctctgtcctctccccaggcttccatctccgccacaaccatgaccccttcccgcaactcattactccttaatcaagacttctcttctaaggcttcagacctatctctccaacattctcctggatggctccattagccatgggctctagaagctgaaacttgctaagcaccaagccacacgaggttgatatactgattatgcaagctctaaaatttcagtgccaggaaaggaacagccttcctcaagtagcattacacaggaccatatagtagctacacatctttgtaacttataccttaatcttactttgagatgaaagctatacctgcatttctgtcataagataaagagggagaaatatcttcccatgtgttgatgatacactttaaaatcacaatccaggagaggcctcaagcaacaactggcctttgcatctaactacttacaaagaaagattccacagtaattgtgatgaagctaaaggtgctgtctttggtaaacatctttcaaagttcaatcatttcacaagaaagaactcccgatagcaagttaattgcatcaagtcactggtggcaatttttcttggtggtttgggtgaaaagccaagttattcggtgggatattctacaaaaatggtgcaaagaattttctatgatcatgagagttaatttaatacctatctttagatttttcagactaaatcattctggcttctgggtctacagggtaactgcttcaccactagagcatatgaaaagttacttttgtgcgaaaaatccaggcttcctacgtgggcacctgttatagctttatcttctgatgttcccagagacacaacggataggcttctcaacaactacagtagagagtcaactatgctatctcctagactggttttcaaagtttacttcagacttgaatttctttaccaaagtgtgttccatataacattgcagttgggctcgaggtcaagtaagtgggagcaacatgaggttagacaaagctaatcaggtttcttcacttccaaactcctcagtgcaaatgctaacgtaatgatgactttccagtatgagtgctttcaaagttttactgtccttggaatcctttttttctcagagtatctcagtggtattctgcagaatacattttaggcaacagtgacctttatccttggagaactgtcaccctatctttggtgttttaatgttaagctttccacaattatcaaaggccatgagaaacagccacatataatttcccttgggatttgttataaaaatgttgataaggacactagccaataatcacttcaagtgtaacgctgcttaagagttcaggaccaccacccaagtttgaatacaggtcctattacttgctggccatatgaagtgtccttaatactctgtgccacgtaatcctctggaaacagcctctctttcatagggttgttttaaggattaaataggagttcatatgtactcagaacagttcctgtccatagcaatcactcaaaggacagctatttttgttattattattattacgtagagccaggaaaacaatgatgtttctttaggatgctgcgtgcttctttaattcaatattaagagacagacaaatctttgtttcctattatctccctggctacagggaagctcaaactgaatctgaagcttagtcaaatcaactatgctaatccctatgatgttcattgatctattatttatattgcaggaattgtattgctatgactttttaaagaatcctttctgaaaactgaatacgtaaaatcaacataggaaatttccacttgaaatgtccttgggcaaatagaattcagtatgtctgatacgtagctctttctctccatgcactaaccctttgcaaatcaggagtttttcctgggtgcactaggttgcttttgtttgtttttcaatgatcatttcccagttcccaaattaaaactttccgtaacaccagatgcctccccctctccattttcccttggtctcattcattcagtgaccttctaatttctccatccccttcttcacttgcctaagacatccttagttaagaacctggcatcttttaatggactattccactgtgcttctaccaatcttcatggctttagctttctgccaggtcagttatttttctcaatcctcccccccgtcaaaaagccatcactgttcacctgcttataggataaaacccaaactccttagtatgatgcacaaagtcctttaaacagtagtccccacctaccatcccactgccctcttattctcctcattccaagccacacattactcactggtccaccagtctggaaaactcatccttcccccatctctcagactggaaaactcccattcagtcttcaactcttaaactctctttgtaaaggcctctctactccctctgatagaataaatcattcacctctgtgcccccagagcacttgtaacagtaggatataagtagttgtttctattttaacttttttaaaataaattttgagctccatgagggtaagaaccaaggcttattcatctttgtagtctcataattttaaaattacattaagcactcagtaactatctgcagaattgaacagaattacatcctcaggcctggaaagtagctaaagaaactcatgaccataatcaattctactgtagagggacaattggcaaatgaaggccaacaggaggatgagggtcttcatgaaaaatctaaaaaaaaaaaaaaaaaaaaaagggaaattggattgtaagaacataaactcttatccagcatgttctagggagatggcagctgtacttgtaagatgtgaatattctaatcgccagaggggtgcttcaatttttttgtagtatgaagcagtcctcacaaacatccaattttagatgccaagattctaggctcaccagaacacaatttgatttttattgtgattcctaagacactggattctaagacacaggatgctgtgtgccgaaaaaatgaatatattcctcattttaatagatctagtatttgcacttaaaccagatgctgtctcctcctaaaaaagctttaaggcaaccttgataacattttaatacaaggcagttaaaaagagagataattaggataaagggagaaataaactttcattctgggttatccattcactgccatgaactgcatactatgaatcagtcccctcagacttcaattaactttggataaactgaaggaaatttagttacactggccctgctagttagaaactgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttctatcaccttacttaaggctctaatcatctctttcctgggctcccatgtgactccccccagcttgatttcctcgttccagcatcgctcttttcaaagttaccctccgcacagctgcctgtgtggcgtatattcatgtcaatatcatggcctgactcctggatcacacccttgagttgctccctagactaggcacggaggcagcaactctgcagtgggtaccacacccttcccgacctgcccttgctgacctggtcagcctcatctcctctcattctttgccttcttaaaaaaggtaatacaactgcagtttccctcaaacaaactctgccattcctcaccctgacacctttgtttatattccataggaatgcccattcctaacctcttcagattcccttcattttggccatcttttcaccatcattggagacttgcacaaagacctaatgaaagaacattgaataaagatttcccgtagctatgaagattgatagctactagactaggtccaaagtcatcaagtcaattacaaagtaaagcaacgggatcatgatttccagctactttaattcagtggtatcagtaactgatctagaacttctttgactgtaacaataataatcttgcacaatcactggaggaatttaaaggaaaaagagaaaactcaaattttggcttcataaggtcttactgcccaacaagacatatgaaaggtcctgagtaggtattaagaatctacagagttccctcgtgttatataacatctactaacaactttaactttagactttatggtgaattaggttaatatttagccaccttgttgacttgagaacaatctaatcaatttgctctgcaggtagtagaacgacaatgtctttgtctctcagaaaggctaccttttcattgctaggatcataccttgaatttcagagcaagtcttggtttatttagacagtgcagagacaaatacatctctgtatttgaacactacaggcttaagtcaggagactgaaggctttaatcaacgcaagaaaaaaaagtaaaccttgagtctgcaatgctaaggacacacaatggggcaaaaacccaagatccagtggctctttgccaaataaagatgtatctgaattatatgtggtaatgagggagaaatatgatgcagaagcgaaatattaaagattagatatctcactaacaccattagtcatccaaacttatgggaggcactatgggaaaaactcagtcagatttagcttttactcagagctttagccttatctctgtggcatcaaccaagaatcagagaacaccaatgtgggatacatacagtgcctgtgatttggaaaacgggttcttaacattctaaatttatgacaaagccatgcctggtgctaatcaaggcagtttgaaaaaggggagaattttgaaaagcaagcagaaaacaaagtctttgaaaggcttttctctacgaaattaggtttgtaaaagaactttagtcaaaagtgcatgcatgtatgctacaattaaaataaattcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataagtacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggctgttttcaggaagggaactctgtggagacatttctttggaatttggtagaaggtcaaataggacaaaatgaagggacaatgaaggaagctcatcctgatcatttcgtgaaggtcaaggtaacttacacaaagatttgcatcaaccccagagtcctcattttggagctctaagtaggcctggtgttatgttttttgttcttttagagaacaaaccatcccattcttggagaatggtcttggatatcttccagggtaaagcggttatcgctgtgccacaagtagatgaacaggtttattccgggacactcagtcctcatagatagtccctcaagttaaggcacattctggggaatatgccgcaattctatgtaaatgacattcacagagacttactcttctttattatctggttgaaggcagagttgcctatttagagtcagaaaaatctggatttcaattcagttctaccactggctgactgggaaatctggggcaagctgtgtgaacctctaagaacctgtgtctcattcacagaaaggcgacagtctcttctccatagcgtttgtaagaagattaaatgatctaaaatatgtaaaagtgcactcaaaatgataaaatgataaataaatgatagttatcagtactctttacaaacattctttgacccgggtgcaatggtacggagaaagactatgctaaccacaaacgaggcagggctcttgaccaatgagctcaaaagatatattacacgatcatatacttcaaaaatatatttactccttggtaacatcaaattctatttacagtgtcagttccaactttttattccgatttgactttgacccctacaataattacagatttaacataaatggatattactgattattctcaataaagtagaaatgttttctctaccatggtcttcactgacaaatgatctcaaaagtacggccaaaaataaagctatcattaaaacaacaaaaaaagttcaatattatctcgtggatggtactcatgtgatgttcttgctgtattttcaggtttttagcaaacatttcctgagtagccattaaatattcaaaccatgctaagtactctggaggatatgaagatgattaagatacagtccatgccccaaagacacacactagctcattaaagagaggcactggtaataactgataaaaaggaaaactgtcaaggaattttctgagaaaggtccaaagtgctctgggaatagaggcaaaagacagatttcttccaactgcagggatctagcagggctccatggggaaagttattttgagcagtgtgatggaggataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtgggaaagagactaaagggaagccaaccagataaggagctatggccataggtaaaaggtgttaagagctagaaggctcgcagtggcagcaggaagcaatggaagagtggcagtttgttttttcatcctgaagtggcatactcccgagggcactgatctcagacacactgcgttgcctacgttaagagcttttggtgccttgggctcaaccaaagagatgaaagtacttaagacccacaaatctgagcaacatctactttaaatccttgcttggtggcatctgtctgaagaaggcacattgtgagttagaagtgatcatgtgagaagactttttaaaccaagggacctgtgacataataaatgtaatacagaactgaaagtccaatgatttgcattatcctgacacaatacagtaccccagatgtttacatctttgtcctccctgcagtcattatgagagttctttagcctttttctcttctacaatttctgctatttttacatgactgtcttttacaggtgatggctgacaattggaattgtctcactaacctgctatgatggtgagcataaataataatttctgcatttgatgatgaaaaataagatgaaacaattggtttcccaatatgaccaagccaataaccctactttcttaaatgtttgaggtagataatatggccaaacacatgtaaaaaaaatcatataatcataaaattaaataacctacttttttcttaaattctattctgaaatataaaatcaaagccttggagacacatgcaacaagtcaaataccaccatcagcattaactccttcacacctaaaatatgagttcttcatcatactattgcatccattgtcttctttcagataacaaaaaaaaaaaagagagagagaatctgcaaatggagctaaacagattattttagaaaacaattagacataaaatgactctaagtgaagattcctggcacttttctatgtgtgcaagtgtatgcactctgcataccaatgacaaagctagaaagaaaactcacctgttttcttcctcaagatctgctaggattctctctagctcccctctttcctcactctctaaggaaatcaagatctgggcaggactacgaggctggctcaggggggagtcctggttcaaactttggcagtaatgctggattaacaaatgttcatcatctctggaaaataaaatcaaaggttttggttttttcccccccttattttgctttgggggttagggactcaggagtgtatttgaaaatagaaacatttatttgctcttaacaattaattagaccttttttcctgcttctaaagaccttttgatactgctgaggttgtgatctaccattctactggtaccaattcaaagtgttttcttgctcagattttcaaatgaaattgattggcctatttacacggataaatgaaaggcagaattacagaaatactgggactctacgttgatgttagtcaatagctaaaaaatattaaaagatataataatggctgtataatgctttggccaccaagcctgtcaagataatctgttcactaacccacgctattgttgtactgagtaggaaaaaataccttgcagctctaaaagtaacagaggaaatattttattaagtggaaggcaatgtaaccaaaaagtattgcttcagtaagtcagttttaacttatataagtcattgaggcagaatgacaacaacaattaaactggagatacatgattgtttcattcagttattgtttagacagaagaacgaaaattaaggggaaaaaagacattaaggtgactgattaaaagaagactgaacatctcattcctcggggcagagtttttttaaatacaagttttatttatttttaaatttatacataatggttttaaggactaatcttgcgggaaaaggaggcaaaaaggcttctatttggggaggcagctacaatctttcctggaaactaggaactctctaatacacaggacaaacttttttctgaatgcattgctccaagctccggaaaggcctgtttacctccaagttataagaattttcttctgtccgtaatgacaggctaaagctcattgtttctggttagatatcattaagatgatacgctaatattctcctctccatacccacttaagttgaaaaatatcagaaatttaggaaaaagtccttctcatttgaattatttttgtttatcaagccagttacctggtttagatgtgaaaagctgactaaaaataattattgggtattaaaaacacacatttaagtgaagtcaaccaatccaccaaaccacttccccaaacctgcccctaaaatgccatgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaatagccatgctataccaagatcacgtttccactccccatgagtggagaaaatagtacttagccatgactttaaaattaatatcctatccctttaaatatctggcaggtttggtcaaagattaagcattactataaatacttgggactctgcaatttgtaatcatatggtatgaaataagttcaaataagagtaaggcaaactatttttgctactctgaatactaataatgccagaatttggatgagctcattccatgccagggcattaagaattaaaggaaaaaagtaaatgaatggctccttaaaagatcaaatgaatatgatgctaattcctatatcctgtgctatcctacctctaaatccctcaaagcaatttcattgtcaggaacattttgtaaaaagagatgggatacttacatgctctcattaggagagatgctatcatttagataagatccattgctgttttccatttctgctagcctgataaaaaacgtaaaagctcattaaaacttatgtgacgtcttagaatctattcaagacctaatcgaacattcctgaaaactaaaggataaatcatggcaagaagagaaaggaatccttcaaattaaaggatgtgtgtgttggcttaaccatttgaggcagtgtgtggtagaccacagctagttagtagcactacatttatgatagaaattctaaggaaagttatatttcactgttttccccctacagatcagtcttgctttcactgagaacaggtctttgttttcagaagaaaagcttccctaacaataagtgcactccctaccttacactaccccttgtcttttaggacaattactactttccactgatgacagacttacacagctagctaatgcttttcacgattggtaaacatgtccagcagttagaatattgacaaaggatggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacggaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagatttgtttaaaatatcataggttagctttccttggttagttatttcaatcaatatttgcctggcatacaactagtctcatacctgctagcataatgttcaatgcgtgaatgagtatcatcgtgtgaaagctgaggggacgaggcaggcctataaggcagaaaatgtgattagtcacagataccatccattaatggagaaaaaacccaccacacagttatgttatacacatggcctagaatgcttttattctaattctatggataatgtatacatttagttgctcctatatcttaaatattatcaagtattttaaaatccaggattgagagatgatttctcatacttctgcttttattaaaagccatgaagagaggccaaaatcttctctggaaaattcccatcgtagaaaaggttgggggagacagtttctaggaagcattttgtcctcctactttgtaatttctcacatcctataattccgaaattgtgttagccctatgtggtttaaaattttaaatagtttacacctgcgccatttataggctatcttcttattggatcaaagctgtatatctgcctagatacttacaattattttagcttcaaagaggctactctagtacaagacttcttaaaactccatgtatcaagatgtcttgatctatgcaattttgtaaagaagaaatgtatcttccaattcagcagcaagactataccactaatttctagcacaaaatagaatgaccctggattatattgtgaggttttaaaaaagaatgactaaatttcatagaacgtcatgatatctgaaatatttcttagagatactgtgtgctaaaacataggtgagaaaataagaggagatcattagcaggaatagtctatatgctttttgtatataaacacctatcttttcttatctccataggctagaattctggtagggttaacattttttcatcctttcatatctgatctattaattatccttgaagtttttatagtatcttttggattaaccttaggaaaaaaaaccatctgttctgaaaaccagtttaggcttggactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaaacttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcagggaaaatacattagtagtgttttcccttgtaatagttgctatcctggaagtgtgtacaagaatgaaagcctaagaccttggagcataagtacaccaagaaaagtaggcatataaatccaaaatactttaataccattttatacagaaaatcttatacagagctttaattctttgcctcaaggataattccatgttatttttcttattaatatcagtggcgcctatcacagcatgcataagcacaagaacttacaataaccagaaatcttaaaaaatatacactaaaagagacatttattaaaccagaaaatgagccaaaagggagtactggtcagagatgaatcatttaaaaaccaagaattagtgaaaatacaaagccacttagtccacaaacaaaactaagtgcaaagccttctaaaacacttccaaaagaaggtaataatactgttccccgcttcccacttcctaaacacaaaaccatatacccagaaggattacttactataagagttaatgacctacttggtcaattccatcccacccaccaccaccttctcttttatgaaaactctattaattaaaagctgacattcatttaggtttcaatgcagaatcgctcaaagaatatcgtttgactggctcacttatggacagacaacgtaaaggcctatgttagctttagttttaaagtaatatgacaaacacaagcaaataagagtttagtctaaggaaaaccaaacggtctgtatctctggaaactttcaaattctgtgatccatatcaaatggatcaaatattgtaatcatcataggatttgttaacattagatacaagtcttgcaaaatgaaacacgttaggacctggctcttatgcctgaataggatggctttgtaatatattttatacagtatttataatcctatgaataaatactttaaatacaattactgctattaaagaaaacacagacttcagtctgctagatttgttttcttcctcaaaattaaaacttcccactatttctgaataatctaaccaactcttcataaaaaggcaaattgggaggtgtgttttagttgttagaaaatatttttaaataaaagatgttattaattttaaagtctttcaacgtttaagacagacaaaatcttctacttaaaataagttaatctgattgtcataatgtttttctcattagcttacgtgtagctcctttttgcctttcaaggactattaattactctttgtttattatttggtgctacttttatctatgtatttgtaacaactgttctttagcatatttgtcgtttggatttcttactcggttaaacttatttccacatagagtaaatccattcccttatcaggatccaatcaagctgaaactgtagtgtatcaactctttaaaagtttcttatttatgaacggttgtaacttctataacagactacctgggttaggaaacacaatttccaagaggcagaggacataactgaacctaaataactccctaagttctttaagcatgatgattaaataaatcagataatatactacttatagctaccatatctcaaaattaaggggcgcaataacgaagttttaaaaaggaaagcatagccttccacttcctttaggcctattaaagactgaaaataaacctcaattaataatatgcatttatcacgacagggtttttaaaaaaggatctagtttagattaaattatatggtggaacaataaaaaagatttaataaaaagaaattgaattcttacacaagcttatcttccgaattggtcatttcccctttatccataacagagctgtctgattttcaataaatattttaataaagcatactttgaaataccaaaagtttgttataacaaccctacataatgtagttttaaaataggcactttgtttgctaatatagaaatcacaggccccaaaaaagagttttctagcattataaactctgagataaatcatctgctggtatctaagctcagtattattaatacacaccaatagtaataacaaagaaatactttcctcctagagcaaatgtataattgtttatgagctgaatatttagcttggagaggagagcaaagtgagtttagttcaaaatttagaaacccttgtatataatgattagtcaaatagcatggcataacctgataaacagtccgcacacctcattaaaattattcaaccaaactcagcatcatactttaaaacgaattctgctgatttttaatagtccacttataacagaccctaaagattctaaaaagcatcgaatctcaagaaatatggctaaagaatgttattatgtaatcagaagcttcttccttgcttttatatgaagaaatatataaacatgtctcccaggaatacagctaaaactccaataacttctttgattataatttgaattcaagccaggatttctgctggtttgaatttcacctggtggaggaaccaaaaaacccactctgattctcctgatctgtgtagatggtactttcaaagtctcatcaagaaaagaaaaaaaaaaactgaaatgaaggaaggggaattaatatgtccataaaacaaaacaaaacaaaagaaaacaaacaaataaacagaacaaaagagaaccaagcgagcgaatgtgttggtggtagcagcacccttcagcaaaaaaagtactcacgcagaatctactggccagaagttgatcagagtaacgggactgcaaaacaaaaaatgaggtggtgaaggagacacacgcaaactcagccgcaaaaaaatttactgaaaggtcaaaataaataaaatccagccaattaagtatgaaccatggaaagcaatagccaaaccaaggtgtaaagtgaattaaaagaaaaacacacagttgtgtgactgccatcagagttaaggcaaaaaagaggagcaggttgaaaagaggtgaagacgtcccctttgatcttgagaatcattactacttactgtgaagtagtttcctgtgactatattttcttttgagtagaaacaagtgactagatatgaccacacaatgagatacaaaaagacacacatttactgatttgtgagagaggaaaatcaaaatgaaatactggaatcactcatttgtaaacagtcccatatttcttataaggcttgtaaggcaattagtggctgtattgtgttgtggtttttttttttttttccccctgtgagataaagtttaacttttggaaaaagaaattgtcaagtgacgtgggaaagtggcaactggacatcagcttatttttctcttttcagctaatgtaaataaaaagaaagaaatagaagagactgtttgcatttgggagtgaaggagggtgttcagctgagaggagttcaaatatacatcaaacaagagtgtgttctgcttttgctactactcacgtttccatgttgtccccctctaagacagtctgcactggcaggtagcccattcggggatgcttcgcaaaataccttttggttcgaaatttgttttttagtaccttggcaaagtctcgaacatcttctcctgatgtagtctaaaagggagatcatggtgagatcagatttaggacaggatgatttcaaaactaatgaccactccagtcttctgccccatgacacttgttttgtaattaaggagagtgttgtggttgtgagcaaaggctttggaatcagacaaatggggctctgaaaccaggcctggcatgtactaatttggctgagttatttacttctcagaggctctgatcatcagtaaaatgggagcaacaacacctcaacacgttgttatgataaataaaagaaacatacaagcttactaggctactcaataaatggtagtttataggtcttaaggtcaaaaaggtgacattaaattttaccacactttatggtattttaaaaactacttagtacaaaatgatagcatgcttcacccactaaatttcggtctattcatagcatggtacattctcaatcactgaccatctctataagaggaataaaagtgagacaggcaaatatctgggaggatcactctgatgatggaagagagagatgctctaaagcagagcttctcatactttgttgtgtatgggaaccagctgcagatctcgctaaaatgtgggttttgatttagagcatcaggagttggggcctgtggtttcacatttctaataaagaccaaggtaatgccaatagacatatgatgattagtcaacagaccgtatcttgaatagcaagcatgcaaagtttagagaagaggagactgtaagaattaaagaaagagaagagaaacacgaagggtggctctacagtcaacagggacaggtttattttagaaaaaacaaacctgagaggagcctgtctttaattcttaggcagatttgtactcaggtctgtctggccaccaagtctacatccttgccatttccctagtgatttttcacagttctattggccacttaacattttcctaaaataacatcttaggagatggcttcaactcttacttatagaaccttgagtaaattatttaacctcaggacctcagggtcctcatctgtatagaggggataaaaatcatagtacttattttacacagggtagtttaaaaggtaaatgcctagcatttagtaagtgttagcatataaaatggatttttaaaatgtcactagtatacaggacagataataggtgagcaacattgattaaaagtggtagtttatgaatttgggggaacctagaaccatcccccatactcaacatgcctcatggccataagatcgccccacacaacctctaaggctgtgcaaaataaacgtgaaaacgtcttcaatacaaccatgcacacagaatgaaaaccctatttattcatccaacaatatttattgagggtctatcatgttccatatgtgccaggcactcccctaggcaccagggatagggtaaatcctgaagcctacagttgagagccactttagctggggaacatctggggaagtgacaaatcacagcattatacatgatctgcagtattgtacaaaactgaaatttatcccaggtgaactaactctcacgtcaggctggcgtcaaacttaccggagtgcaatattccaccatgggatagtgcattttatggccttttgcaactcgaccagaaaaaaagcagctttggcagatgtcataattaaagtgctttagactcctgtacctgataaagagcaaaaacaaacacgtatgtatttcttcgaatcaaattcccaaagaacactctttaataaaccttctaccacgttctaatttgagaaacagaaagcaatgttcattagtcccacaaggtaagtgattaactttctgcctccagatttttccggtgcctctcctacagtaccaaaacattttggcagaaagattatcctataaacatatggaaggagggaagaaaaactcagcttttatttaaactccactaggaactctttgagattaagtaggaaggtactggaaaatttccagtcttttgaaaaccaaatactcaaatttaaaagaacttccaggagcgacagacttacgctgtgcatgccccttacccatcatgggacaaaagttttctgaagcaattattttcaaaacattgtcaagataaagcaatttcacaagacaaaagaaatgtgaacaagaactttcaattaaaacaagtctcgctttaataatgttttctaattgactgatacgattcatcttcaaacagttactcgaatgaactcttttatctctatctcttcagaaatctctcaccccattacctacaaatgataactgaagccccaagagaacatgaaatttggattagatggaagaatttataatctgtaaatactagttggtacatttcctccattatcagaatgcgatattctttgtttcatactctcctgccttttgctttctcagataagaaccttagccaattcaaataaacatatttcttatgtcacatatggggaagtgggaaggaaagctatcttttttagattccagccatctttcaagagggggacaggaggaatgagaagtgctgggtcctaaaataatataatatgataagggcaaaagaattgaaggtgaaagtgctctttcagatcctccaaggcattcttcttctttattttataaaaatttcccttgtatacaaagcccactagctaaggaagcagagaaaaggtagcttagaaatctaatgcagtcactgtggcttcccttccccactccccacccccatggtatcatttttacctgccaagaaaccgggaaggaaagaaggtgacctttgcaagcagtacctactcactgttgtctatctaggcttcagaaacctctaaaagtttttgtaaaacctctttgtaaacagcatgactatggaacaataaacaccaaaagtaaaaaagcactatgaataaaaagcacgcaacagtacaaggtagttattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactatcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattcttgggaagtttctataaacaggaaagaccgtgaaaaaggaaagatggtaaaaatgttttggttccaggaaggaggaggtacagttcatctgtaatacctccgtgaagacacgcactttggcctgctcaaccaaaaatgtggctccgaagagctgaagagtgaaggtggtaagggacaccagcctaataagtgagatccaccaaaataacctagcgatcaggagggtgacaggaatgatcgatgttccagcccaatcaccttctctcccactttggagacggtacgaactaacagcaactggcacaggagataaaagatcaagtcataaaaaggtgaaaaatgatgagaaaaaaatgacattttttttttggttcctaatacctgaatccaatgattggacactctttgcagatgttacatttggcctgatgcttggcagtttctgcagcagccactctgtgcaggacgggcagccacaccatggactggggttccagtctcatccagtctaggaagagggccgcttcgatctctggcttattattagcctgcaaagacaggagggagagagaaggagggcaaaaggatgaaaggaaagaaggcaagatggcaaaggaggtgtatatcagttcgattaataagttaaacagaaaagatagaaagaacaatggttgcaaagctaggctggcttttcacagcttgtttctgcaaatgctccctgatatccaaagagctacccactcctaaggctttggtaaactgccattactctttttggctactagatgacaagaaaagaaaacaaaaccaacaaacgagaaaggtaagcaaactacacacctgagcgagactttatttagctttaatttttgaactgatacataaaagttagccagaagtgaaatgcaggtgtttactgataaaatttcaaaggagggggacaactgatttttttttctagagaatctgtttctcatagaatcataatgaggggctttaaaattcatctggttccaaagcctcatctaacagacaagcaaactgattttgtagaccagaaaaggagcttttcaaaggccatacagctagcagcagagctgataatagaatccaaacctcctggcttagcgctgttttcatgatgccctgttgattctgtctgcctctctatttctctctctttcaaagtctaaatgtaagaaatacaattcatcccagacaggacaatgatctcaacaatctcaaaataccaccatttgatttatatgttactatattcatgaattttaattataccttgtttttttcaaccctataggattgttttaattttttatattattagatagattgacctatatattgactacttttttgctcttcattgctttctttcatctcaaatcttccatctgggattagttctgcctgaaatatgtcccttagaatttcctttagctgttggtggtgcatttctcaagctctgtttgtctgaaaatacctcctttttttaaaaaaaaaatccatattcctgatagttatcttcattaaatacaattttttttttttttgagactgactctatctctattgcccaggctggagtgcagtggcgtgatctcggctcctgcaatctccgcctcctgggttcaagtgattctcatgcctcagcctcccaagtagctgggaccatgggcacacgccaccccacccggctactttttgtatttttagtagagatggggtttcaccatgttgactaggcaggtctcgaactcctgacttaaaatgatccacccgcctcggcctcccaaagtgctgggataacaggcgtgagccactgcgcctggcccaagtataaaatttttgattgaaaggttttggggtcttgtttttattttgtttttgaatactgaaatattactccactttcgtctatctctgttgctgctgagaagtcaatagtaaagatgactgttgctcctttgcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcactcataggtgggaatggaacaatgagaacacatggacataggaaggggaacatcacactctggggactgttgtggggtggggggaggggggagggatagcattaggagatatacctaatgctagatgacgagttagtgggtgcagcacaccagcatggcacatgtatacatatgtaactaacctgcacattgtgcacatgtaccctaaaacttaaagtataataaaaataaaataaaaaaaataaagataatctatctgttttctatcttgtgctgtttctaggatttgatttagactgcttaggattcactggacttcttaaacctgtgatttagagtctttaatcagctgtggaatcttctccgtcattctctcaacaaatagtgcctcttctccattccctctccattctactttcagaactctgttacataaatgttactcttcttcaatctatatttctctgaacaggacttccctagttcccccctctctgccccacatctttttaaaacatccttctgtgcttcattcttattaattccttctgccttactgtctgggtatccatttctcttgccggtctgctgtaaacccatacagttttaaattttgattattgtacttttgacatctagaaatactacttggtcatttttaaggtaacttctcaggtttgtggttccctgtagatatttttcaatgttgttttttatttttctaactgcataaacacaattaagaaaataatctgtctaataattctggaatatgatgttatcgtaggtctgcttctatggtttgctatttcttctggttctcattcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagcacagcatatagaagttccagagttaaaccactggagttcaccactcactggctgtgtgaccttaggaaaataactttatctctctgtgtcttactttttctctgctacaaactggaaatattaatagtgcctacctcatagagttattttatgattacgtgagtcagcaaatgaaaggcaattggaaccgtgtctgacacatagcaagaatcatgtttgctattgttattgtcattattattatccatctgaccagcaacccagaagttcttggtctttgaacagccctttaaatattttaccagagctgtcttatctgtccatgcctcttcattcctattctttttacttcttcttcatatgacacggcttagtttgccattgtcatttagaaaactattcttcaaatatgattgcggagaatgtacctctatttctccagacagtgtaactggattactttcttttgttctgtaccgtaggctcacacacggttcctactcaactaaaatctctgagtcagtgtttcccagtatgtccagcagatcaatcgtccagcaaaatgcttcacgagaaggtcaaattaatgaaagaaacagtgcacattatatctgcctcttaaaattcttagagcacgttaacatattaaaagctgagaaggtcatcagtaaagcaacatgttaatcagctctggaatcttcccagattctcagagagagagagagagagagagagagagagagagagagagagagagagagagagagagagagagagagagaacaagcaagagtgacttctgaaggggcgatttaataacagttttcaattatgtgaatggctctcgcataggggcctgtgaccagctgttcgatctctccactgaggacagaacaagaagaaacagacttaagcagcatgaagaatttaggctgtagctcatatggaagaatttcctgatgctgaaagttgttaaagcattagtgtgaattaccaagggaggctgtagaatgttctactctttcaaaaaactatagattcttctatgcttaaaggttgaacattctcaaatttctagcccctaagatgcaagatccatcatgttggctcttttaaaactgctcacctacgccaactgacagactgaagacaaggtacggggattcacgttctcattctgtttcaatctttcatttttatgacaaactactctgtatcctagtggtatattccctctccttttgtctggcaatgaagaaggaaagaattaaaagccaggcaagcttctgtaaagacctaacagaactagaattaaacccagctaaaattacatttcgatcattccagaaaaaaatatatagggatagattggaatagcaggaagttattaaggtcaaaagataagtatgatggcattcactggactgagataatctttgtaagtaccattatttgttgagatacatataagtctcagatataatcccctctcagtatcaagggtgaccttgtcctcatctctaaacaccagtttcaagccatgcaagcaaaatctcttggaaaggtcatttagccctgggttttgttttgtttgttggctttgttttgcttttgctgttgttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaaccgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcatttcaattgtgaggtttgtgaaaaccatgtgaacacttaataaactacaataattagtacagtcatccctcagtatatgctaggggttgcttcctggcccgccgcagccccactcccacggggattttgctgttgagatacagcaaaatccacgcatacgcaagtcccacagtaggcccagctgaacgcatatccgcaggtttcacatctcttgagtactgcattttcgatacgcatttggttgaaaacgatccacttataagtggacccacacagttcaaatctatgtttttcaagggtcaactctatatagagaagtaaacattgggcaagagactgtgcccagtaattctcagataacaagaaaccaccatcctggaaacaatacagaacgatacctccttaatttctttcctaaattgcagattaattaaagacaggaactatacttctggagtctctgttaaaatctgctgaattgaacagtgggtgggaattcaactgcaatatgatcgcaagaaataaaaggaagattataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggaggaacaagaacaagctgtaaagaatattaatgactcttcttccaaacaatcccaatttttatgaaaatcaaatgagtgataaaaagactctataaaactatacaaaacctgcatgtaacaaataaaacagaaggaaggtgacattttgatcctcttagacacaagatacttgggttttacctttgagttactgaggaaactatagtgtacggacgcaagggatcatttacatgaggttgtacacaatggtttttcacatcttgctcttagtgtgtgtttccattcagagaacacttggtctcatgtgaaatgccacactctatgtacaagactgttttctatatcttatagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttatgttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaataccccacaacactgataaatgcatacttatatctcatctgatcaactcctttcccccttcttttcagcattacatgtccctcgtaccattagatgctacggcatgtatgagctacctggactgacaggtgcgggtccatatatattgaagtggcaaaaaggaaaaaaaagaaacaaaactctatgagcttctcaattcagcacagttttcatgttacgtgttttaattatgtcaatgtgttgttcccataaaaggattggttaatatggaaatgtatttattagacatctgtttatgtggctctctggagaaaggactttcaattccatacactgccattttaaacaattccaagacaaaaatagtatccaatggcagttcagtaaagagagatatcattctttgtacactcagaaccaccttggatgtccacagtgatattcatgaatagacgggggagaggtagaagctcttctttacataagaaaatggtctaatacatgcagaaagtatggtagaattagaaagccaccattatgcaaccaccaatattataactgaattagacaaggatcatccataaatgctaaaaccatagggtaaaaggttaaggaatggatattataatatgtcaaaatatcaaaaaattactttctcattacaaagggaaaaggatattttacaaggaaagtatcttgtagacaccaccttaacattcttagtgataccaataggaacaaaatgttattttgttcctccagattgtgatacagtggtaggtacagagcatcatcttatcgtcttttggccaaaaaatgttaacattaatctaatcacaaggaaaccatcagaaaagcccagagtatgggacattcttcaagagaactggtctgaactcttcaaaaatgtcaacgtcagcccggcgtggtggctgatacctgtaattccagtactttgggaggccgaggcaggtggatcacctgaggtcaggagttcaagaccagcctggccaacgtggtgaaaccctgtctctactaaaaatacaaaaatcagccgggtgtggtggtgcatgcctgtaatcccagctactcctgaggctgaggtggagagtcacatgaactcgggaagcagaggttgcagtgagccgagattgcgccactgcactccagcctgggtgacagagcgagactctgtccccctaccaaaaaagtcaatgtcatgaaaggaaaacaaaatgctgggagactgttcaaaactaaatgaaggtacagagacatgacagacaaaaaccttgactagatgctggaagaaaacagtggctataaggaacaattctggggcactggggaaagttcagtgtggactgcatatcagagggtattgctggattgctgttaaatttgtgtgtaacgatagcattgcagttatgttagagaatgtcatcctttaagaaaatggtgtatggtgaagtgtttaggggtttatgttgtgatgctcctttacttttaaatggcataggggaaaatgtgtttgtgtgtgtatgtacacagacagacacatacataaacagagctgagagggtggaggaggtaagtagagcgaaaagcaaccatggattgaacagatgtatgacacagatgagtgttctttagactatcctttcaactactctttgtgcttgaaatgtttccaaaataaaacgttggttggaaaccgttatttctcccaagtcaccccttcatgggaataggttgtgggcaaggcaggagggtgggcaagagtgattttagtaactgtgaaagggacaggacaatggtattaatgtcaatagtaatgagtgtgaaaagttccccaggattcgttttctctaaaaatacaaacctaacgcaaaattgatttccttcctgtccttgtcacggttcttaaagcatctcctcatcgactctgcctagatgtgcttttcctagatccctaaatgtgaatctccaggcatgaaaatgagtttaagagtccccacatgcgcagaagcagaactttttgtttaaggattgagaggtcaagagttgtctttgtgagacaagaagaagtaaaaggcttcccataactaccatcttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatcagggcgcattatgtaaaagaacaagatataaagttagctcttccactactgcctcctacaatcctttaaaatccagttcaggaaaaggcaaaattacaggaacagaaaacagagctgtggtttccagagattgggacttagtgagatgatacagcatgatggaattttaggggtgatagaaatggaaggaagaaaggaaggaaggagggaaggagaaggggacagagagagggagggagggagagagagagaacgaaagaaaagagaaaagaaagaaagaaaggaaaggagaggagaggaaaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttaaaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaaggggtgtaaaaggaatgtctatggaaccaaagggcccacagtctgattaatacacaaaaagccaaaggaaacctaagtgaaggagggtttttaggagttactttcaggatggaaaatctattaataaaatggaatcggccaggtgtgatggctcatgcctgtaatcccagcactttgggaggctgaggtgggcggatcacaaggtcaagagattgagaccatcctggccaacatggtgaaaccttctctattaaaaatacaaaaattagctgggcgtggtggcacgtgcctgtagtcccagctacttgggaggctgaggcaggagaatcacttgaacctgggaggtggaggttgcagtgtgccgagatggcaccactggactccagcctggcaacagagcgagactctgtctcaaaaaaaaaaaaaaaaaaaaaaaaaaaaaaaaaaaaaaaaaaaaaaaagtaatcagttgacccggggaatgctgtctaaccagccaaaagtctcctgatatggcattttaacatttgcagagaaacagaatctccagaatctctaaaatgcaatccacagatgatgttttgttatagataaaagcaactgttaacattggcaggatattttcatgccacaacacactttagataatcatagctaacattcactgggcaccttctatgtatccactacagctcttaagtgctttgcttctattggttcatttaatcctcacaatcacctccaggagttcaggggccaggaaggttaagaaatgtgtccacagtcacacagccagcaaatagcagagctcagatttggactcaggcacagttcggtttcaaagcctatgcacttaaccactctgccagtcacttctccagatattctggaatgctttctcatttatgtgttactgatcctcccacctcagtctcctgagtagctgggactacaggggcatgccaccatgcatggcaacaataatacattgtatatttcaaaataactaaaagagtagaattgggaatgtttctaacacagagaaatacttgttctcaacagttgagactgtaatttattctcattttcatatcattctacattattacaacaactgtgcatagatggtattcatttttgtcatacaaatagagaaattcagaagatagatggaaaagcaacttactcatttggaatactaagtacaacaggaggcagaaaacagatgtaaaataaacagattttgacactccagctctcataggtgaagcatattgaatataaagttggtatacttgacgttatctaaacaataaagtccttaaaatgtttactgaagaagatactacaaaatcgaaaccacaaaaagatatctgcactcccatgttgactgcagcattgttcacaatagccaagatatagaatcaacctaagcgcccatcagtggatgaatgcataaagaaaatgtactataaacacataatggaatattattcagccataaaaaatgaaatcccattatttgcagcaacatgtacggaaccggaagacgttatgttgagatcagccacacacagaaagacaagtatcccatgttctcactcatgtgtgggagctaaaaaaaaaaaaaaaaaaaaaaattgaactcatggagatagagtaaaatcatgactaccagagtctgggaaatgtagtgaagatcgggggataaaaaagggatggttaatgggtacaaaaatacagtaagaagaaatatgatctagtgtttggtagcacaataaggccactatagtaatcaatatatttttaaatctttttacagatagggtctcactatgctgtccatgttggagtgtagtgactattcacaggtgcaattgttgtgcattacagccttgaattcctgggcgcaagtgatcctcccacctcagcctcctgaaacgctggtcctacaggtgcgtgctaccatgcatggcaacaataatttattgtatatttcaaaataactaaaagagtgaaatgggaatgttcctaccagagaaatgatgaatgtttgagatgatggacaccccaattactctgattgtgttaccctacacattgtatgcttgtatcaaaatatcacatgtaacccataaatgagtactattatgtgtccataataattaaaaatattttaaaacatacttttttacctgttaaatgactggcagtgcaggtttgtgaaataattcttcgtgctatgatgttacaatggctacagtgtcacaaagtaatgcgaatttttcagttccattataatctcttcttacgttgatcttatgggaccaccatagtatatatggcctgtcattgaccaaaacgtcattcttcagcacatgactgtatagttttcccacctaaaagtgatacttggttttatctgaagatagactaaacagctatgttgggattagagtattttcaataaagatgggtgtgtgtgcatgtatgtgttttgggggaggggtgtttatttatctatctcattctattacaatctaaaattcatataggggatcacattgacacattaacactctgtcatttcaatctagtctccgaactggttgaagccataacatgatgtaaattgcacgatgtagactagattcattgtgccactgtgggcctgttttctcatctgaaaaaggagaggtgcagaaaatcctcaaggttccttcaggcagtctatgtgactcactgccagggcaggcttggccttactaaggtcgtaaaaatcaatctaatctctcaacagggctgtttccatggaatatgagaaaggaacaagctggcaatatattaattacagctgtatctcttaaactcgttgcaaaactttacttctatcactaccaaaatgagtcaatttcccagtaaatgtgttgactgcaatatgctattaatgtggaaacatatcctgttgcctcatttagtatctacgaagataccactgtcaaagccataaatttacagtgactattcctttttcatatccatggatgtgacttcatttcctggcttaatggataattccttggaagacctatagtgatttttaaataagcaaaattttacatttagacctgataggtgatttccttttctaagtggttagtggggagggatatgagaaaacctttaatagataatccagagagtgtggcacacaaacacgtacctctcttcttgccactactgggcccttgtctgaatcagaagattcagtacctttctaactgtaccaacctgaaacaaagtaaggtttccaggtggtgacaagaaatcaaaggaaatcaaatctgcaatgcaaggaatgcacttgtaggataaacaagtactttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaacgctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagggcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgacattttcaaggacggcatcatatgggaaatgcttttctctaaaactagtatgagggcaataagaccaatgaaaaggactggagtgtgaagtggaggcttgctaggaagccagtgcaatgatgagaaggcctggaaacaatgtaagaatggcaatggaaagcaatcaaacaaaacatgtttctttccctaaaaaaagaggcagcactttactaattttttttctaattataaatgttcaaagaagaaaactcagaaaataaaaatagtacagagaaaatcaaaagccacctgttaccaccattcatatcttgactgatttccccccagtctcatagaaaacatttcaaggctggatgccgtggctcacgcctgtactcccaacattttgggaggctgaggtgggtggacagcttgagcccaagagctcgagaccagcctaggcaacatggcgagagaccctgtacacacacacacacacacacacacacacacacacacacacgcacacacacacacatacaccaaaaaaatgccaggcgtggcggtccatgcctgtagtcccagctactcaggaggctgaggtgggaggatcacttgagcccagaggtcgaggctgcaatgagctgtgatcgtgccactgcactccagcctgggtgacgaagttagaccccttctgaaaacaaaacaaaacacatttcacatttcaaagagcttggagactggctggccaaccaggaggcattcaacaaatatgcaaggatggactgaattcaaagctttgagactgagaatacagagttgttattacagagacagaaatgtaaccaaaccagagacatgggcttaggggagtaggaggttatccagcaaaaggatgtagcaggcagaaatggaataggttggtctcctgataaggggggcagcccagggaaagcagagcttctgtatggccaccgcttatcctgacaaccaaatccaagagggccagaggctgcagtgaggatggtggtggcttcctgatgagtcagtactcgggcgagaaaacaaagaatccagctggccctgaatacagcctagtttactttgcagcagggaccatcactgagccttacctttaacccaagtcacaatgcacacacatatgtttatatatccctatatatgaacacgtgtgtgtgtttcactagaactcaaagagtaactgagacttgactaaaggggaaaaatgattaggacctgtaatcccagcactttgggaggccgaggcaggtggattgcttgagatcaggagtttgagctcagcctggccaacatggtgaaaccctgtctccacaaaaaattagccaggcatggtggcaggcaccctgtaatcccagctactcgggaggctgaggcatgacaattgcttgaaccagggaggcggaggttgcagtgagccgagatcgcgccattgcactccagcctgggcgacagagggagactccatctcaaaacaaaacaaaacaaaaaaaacacacaaccaaaagattaggaaataactcgcgtttatggcaagttgttttataattggattttaaaaaatcaaaatgaacctagattgcctgtggccattaatattcattgtatggaagttacttgtgtctacattttgatgattgattggattgatcatctatctgcattttggaaggtttgggtatgaggaggaaaagatatttatttctccacatgcattttacatttacaactaatttgccataattttggcaaaataattcaaacagtatatcccactttacataaatgaacttattatgtgtgcatccggtaaatctatccaactaactattaaataaatactcaaactgctttaaacacctaaatattcacagtgatctgcccaggaaaccttctatagtttcatcctagtctgtggtcaaagacttcagatataacccagttagttctacagctagttccattttgtaaatctcagccattgttaatagaattagaatggattgagaaaccctacataagaaaaacagctcttagcacttgaaaaaaccaaaaacaaaaacataagaacactgtgaataatgtgataccgaaagcatcttactccttcaatactgatagcgttacaattagaacaacttttgaagaaaggccacaaaaaatgtttatattattttgtctggcaatcacacgcctgagaattgatcctataaagaaagcttcaaagacaaaagctaaacgataaggatgttcattgtagcactatctacctaataaaaattagaggccaggcacggtggcttacgcctgtaatccgagcactttgggagttcgaggcaggtggatcacctgaggtcaggagtttgagaccagcctggccaacctggtgaaaccctgtctctactaaaaatacaaaaattagcttggggtggcggtgggcgcctgtaatcccagctactcgggaggctgaggtagcagaatcacttgaacccgggaggtggaggttgcagtgagcagagatctcaccactgcactccagcctgggtgacagagcgagactgcaactcaaaaaagaaaaaaaaaaaaaaaaggaaagagaaaaaaaaattagaacaagatgaatgtctaccagtggagtgctcaggcatttgggaagaagagggtgtttctggggcactgactacgacagagaaaaagcaatgggacaggataggaaagagaacggacaagagtgtgttcagtcagtgatggacattagcagagagtatacacctctagactttggaataataggggaatgtcaaagctacaaaggacagttttaaaaaaaaggacagctgtgctaacaatttaccaacagccattgaaaggaggctataatgatagaattagagaaaggactcagagactaagagactcgcctacaaaggccattttcttatatacataggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaattggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatctggatatttattatttttatgaatcaagttaatgatcactgtatatatatgaagtgtgataacttttacataaactgtgtcactgcaagaagcgcaagcttacacgtaccctcgacacttaaatttcttctaagccagaacataatccttgggaattattgtatataggatgtaactacatcaaaaaataagtgttttagcattaagagacatataactggcccaaagcaccaccctccttggacaccagagattcaaaaatgtaccacagttgggacttctttatggagtcataagatcactgagcttctagtccatcatgtatgtgttcccacaggatactgtgcatagtttgttgttgttgttgttgttttttgagacggagtcttgctctgtcgcccaggctgcagtgcagtggtgcgatctctgctcaccgcaacctctgcctcccgggttcaagccattctcctgcctcagccgcctgagtagctgcgattacaggcacatgccatcacacccagctaatttttgtatttttactggagacgtgtttcaccatgatggccaggctggtcttgaactcctgacctcaagtgatcctcctacctcggcctccctaagtgctgggattacaggtgtgagctactgcgcctggctgcgtatttctaattaatagctcacatcatgttatgctggcattgattcaatatgtgtctatcgtttttggcaggagacttatatccccttgagggaaggaaccatatcttggtcagttgtgtgccagaagtatctacagtagaatggcagtacccggtggatagtaggtgcccaatatatgtaacagaatgaatgaacatactgaatgcttgcaatgttatgttttgttctcagatataaaattttaatcataccttatattcacctagaagttgcccctcaaaaaaagtaaatccaagaaagctttctgtacccataagcacactttaaactctaggaaattaaatgttttaacaggatacctaagatggcactaaaaattgagattgtacgcacagctttttatctgctctccgatatacatacctaggtgtttattttcaaagttatgagttactttcaaacatctcattttgcatttaatatttttgtttcaccaacctaaaaacatgttccctcttagtagttattcgaaacaccaactcaaagcttcctcaattattcaatttaatattatatttacaatgtgctgtcactataccatatatacggtagattagaacctaacctatactaagtaactacaatatttaaaggagaaaagcacacaggtatcccatctcatccgaaatacattttaaaatggttaacaaaagctgttcagttatttttctctcgttctgaggatgagaaaactcaagtggaaactacataaaagtgagggccaaaatggtttgtgtattttgtggcttactcctgaaggagaaatgatcagtaggagacagagtggcttttatctcctgcctgtcctgaagcttagcacatctcctcacatgtgtggctaggcctcaggggaagagagaaaagacaagctaggctgaatttgtttaatattcctactgaaaagattgcttataagcatttcaaggggaaaaccaactgcagcctttcacaatatgaatggatggtcacttggtcatctgaaccatcactcctctagcattggcttttaatttggttttacagtttttaagcagaagaacccaatgcgtaatcaaaaggaaattctgtagggtggtacgtatctatcctttaagaaacagcaagctatctgtctctcaaataataaaatgttagtcacgtcacggaattggatgtgtcagtacaacttgcagtaagatgattataaaataaacaatgtttcttgaacatgaatgtcacatggtattctttaaataagaacccaaagactagacaagtgcagagattaaatcttcacacttatttttccgacttacagaaagaggttagaaaatcagactttatcccctaggaacatgtgttttattcagacacagtcaatgtaatgtaaaataatacctggactggaaaagctaatcctcattctctacttaaatgcctgcaatttaatgtttgacaaggaatggcacaaaccaaattttatgacactctaaaagcagttctacatcttacatgaggaatctgctgtcaaataagaacagtctgtcatttcccatctagaactagggtaattagccaacattaataaaagaatacagcattaatatacacgacttacatctgtacttgtcttccaaatgtgctttacacagggaaatgatgccagttttaaaagacaggacacggatcctccctgttcgtcccctattatgaagaatcaaagcagaaaacaattactgaccctttcctagagggtaaacacttctagttaagaataaagccttgaaaaggaaaaataaaggagtaaagtgctcaatgatgtgtgaactctattgaccactgttttattaagattgttttgaacttttccaaattcattatctctttgactgatgacctacaatgcaatggaaattcaaccaacttgaccactgaatgtttaccaagtttcaattcctaaaaacccttatttgaactgcaaaagttctacataaattaagaaaaaaaaattctattcacctatggaaagccaccttggtttaagttggtaagcagaagaattactaatcttcaccaatctactttggttactaaagcaaattacctactttggtcatggaagccaaaaaaattaccagcaactaactgctcagccctcttaaatgctcagatcttcatcagattgccccttattgaaagaaaattaattacttcaggccacataacacataatatagaatataaatgtttatctccgtaagaaaaatatcatactctattaaacaacattcaaatatatgatctaaaaaataaatttataaataacctgttgctatatcagtgttttaatatagattgcttttatttgcatagcattttctatatttgcatatagaaaactgaaataaagcatttcacataacaaatttattaataagctaattttatccatgggggaaaaaaaggaaaaataagaatgaaaagttttccattttgtagaaaatgtctttcaagacatggaatcaatatgaatgcccatcaatgagaaatatggtacatatacactatggaataccatgcagctataaaaaagaatgagatcatgtcttttgaacacggattagctggagactattatccttagcaaactaatgcagaaacagaaaagtaaatactgcatgttctcacttctaagtggaagctaaatgatgagagctcacgaacacaagggaacaacagatactggggtcttgagggtggagggtggaaggagggagaggagcagaaaagacaactgttgggtactgcgcttaacccatttatgctggaggctgcatattactttttgtgaaaatcagaccttggcgatgaccttgagcagtaggataggaataattcccacaagcttagtgttccaataatggaacactaggcataaatgggttaatacctgagtgatgaaataatctgtacaacaaacccccgtgacgtgagtttacctatgtaacagaccttcacataataccccgaaacctaaaattaaagttaaaaagtgtctttcaatagttttttggcttcttattttattacggaaagctactggcccttagatattggtaaaaagaaaaaggagaaaatatttcagaataattcgcctattagcacttcaaaatcacaaaggataggtcccaatggcggttattttcggtgaacaatatgctcaacttccagctactaaaatttattaaatccctcagtcaaaaagaaatcctgggcactaatggactaaacaaattcctatcactggaaaattttcttatctttctccctcttaagaaaaggtagatcaaaatttaacaaatccactttatacagcaactcaggtcttcaaggagttaaaattgtcaccaaatacttttcagtcaggtagaaggaagttatacattcagaatgcattcacatgtcatctgcaaagaaaacagtgccaaaatatatttgaggggaaacctgaatacaaactcttatcaaaactaatgtgaacgtagttcacaattgaaatccgacatgttcaaggacttggtagatgactatgatgaatgtaatagtcaggtggtcctgaaattttaaaaagcaataccttatcaaaataagaaagaaaaaaaggtataaattttagttcaaaaggtagtagaagtctacaacaaaggtaaaaggcaaaacagttgttttgcaactcttttcagaaaaccttcccagatttccaaatgggagtatgttcttgattggtgaaatgaggcatgtaataattttgagatctaagaagaatttaggcaaaattaagaccaattccttctgctcccttcttcaattgtcttcattaagctcaagaaaaaaaaaaatcagaactggggatatctcccttgtgtgcaatccaaaacaaacaattgttctctaagagagagtgatgaatggaggcgccaaactgaaacttcataaaatcttattaaaaaacaaaagaaaacgaaaaatgttctcagtttgagaagctaagtttgctgtattaagggcttgttttcattttgtttggcctatcaattcataatcttctgcaaaagtgtcctaagtatcagctaagaccattctgatctggagacaggtgtgccagtatctccaggagcacagccatggccgccagtgagaggaagccacccctgaagtgcatggaagaattccaaaatccatgggcgagaaagggaaagaaccaaaggctatatgtcgactcattccactatttgcaaaatgagtgtctcagggttttgtttgttttctaatctgagagcaatctacattctggctcttaactcctagcttatcaaaatatttttcaagtcataaatgcaaaaatgatttatcacaggaagagcattaggtccacagcttccagggccctgttgtaatgctaattacacttcaccattctgtacgctaagcctcctgtgacagagcccgggaaataaaaacatgccatacgtacgtatcataaacattcagcagccagttcagacacatatccacgcagagagggacgttgaccaaattgttgtgctcttgctccaggcggtcataaatagtggtcaaacaattaataatctgcaggatatccatgggctggtcattttgcttgaggttgtgctggtccaaggcatcacatgcagctgacaggctcaagagatccactgcaaaaaacaaataaaatcacaaatgactcaaagagtaaaaccttcctttcagtgtcctttttcctctgagaatcctagctaggactctctcataccctttaataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcattagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagggaggaaaattcccttgatctgaggaggtgtttaatcttatgctggggacaaaaatttaacaaaagtgaaacttcaaccttgtccaacatcagcaaatcacaagctttattcccaagtgtcatgaaaagatgcatttctctaaagccaatttattagccaaactagaaacacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccattaaatatattatatatatatatatatatatgtgtgtgtgtatgtgtgtgtgtgtgtgtgtgtgtttgtgtgtattcactagtagatatatctttaaagctacataaaaacccaagtattctaatacatcttcactttctaaattatgtttacagtagaggatgctataggctttgaagccattgaagaacagggaccatgtggtggtaccctatgcatgagggctgtgggggtgagagagggtggggacaggataaaagaaatggctgactctccaggatcctctttgctgtgcaggaaaagcagacagtggcggttggggggcggcgagcaggcaggacttcaacacagggatcccactaatggttcctgaggctctggttgtgcctaatcatcttctcaaccttctagcttcaaaagctcattcttttcctttctatgtatgccacagtagctaactcttgctattccttcctatgtaagacagattttttttgtcttttacagagtgatagactcttagagccagaaggttgctttaaaatcattttgcagttgagacaactgagaccagagatatggagactcactctgggtgttatggcaggatatctaggttttctgatttctcatggaggtacatattgtaagggggaaaagtgggtggcagaaggtgtccttactgactttacagaacaggaaaaccattctgcattccatgctaatgacaacagtaggataaaacagaagcaccaaaaagttggttagtggagaaaaaaaaagtctcatggtgcccatataaccccaagttcatcctataggtcaatctgtatattctatgttgatgtataaataattctgtgatctaattagcacagaaacagaaagaggtgagtaatggtggaagaactgctgtatgtttgctgatttttcttgcccaggcatgccactctacaggcaacttacacttatggctgagggacctcccaagcaaatctttgcacttcaagaaagtcaatgcactttgatgtagttgtctgtgcagtaagggttaattccagagaggctggagttggcacgagatgacttgctaaaatatctacacagtgcagagccctggtcaaagcacttgcttttcaaagtgacttactgtgttgaagtgtagccatgggttgcaggttatcaccattgtttattgctaacagtaacattgaccatttttacccgggcacagtcagaccaacggaagccactgagtttgaggctggttacataggaacagtatgcctaggttacccacgggatataagaaaccctggctgaaactccaatttgtgctccctggtttccaaggtgttctgtgctcacatcagtagctcttgttccaagagagaaaatgcatcgtggtgtggctcttgcagacagagggcaattatagcttgcacctgtcctctctggaccctatgctgtgaggcaggctgtggctgtgacacttattcttgttttaatgttgtgggtatattgcatcctttttctgcaaggaactctagattcgtaagcactgtcatttggttcctgtgagtcctctttagcaattgaaccctgtttaacttccactgtcagggcagtgagtgtcagaagcaagattgtttagaacacctccaactcattcttagctaaaagtatgactgaggcattatttagaaagaaaaaaagaagattctgataaaagggatgaaaaagaacctttgaagttgctcaacaagctacgcttggttgaaaagtaacacaggctttgaaattggttactgatggtgtaactttctagtggaatctggaagtgagagaacttgaacctaaggagctaacaaaatggattaggaggcaattgcaaactgatggcaaggctgctaaaaaaaaatccaaaagctaatgttaagttcagaatttctttccactgggcttcaccctctctggcctgcaggtggagtcccaaccaaaaagctgaagcaactatcatttttgagaaatgggctacacctgtgagaccagttacaattaaaaagataattcaagtggggcacttacaggtattccctatgtcactacaggtttcttttttgatgccagacctagtagtccctgaactggggctacaattaagagtttcaaaggctggtaatattccaaaataagatactatggctattagttggtacttaagcacaagcattccacaaggatcaatggaatggattactccttccttgtgccttgcctaattgaagctatcacacaaccccatcataggttgaaaatatcttaagtcacaaatgcatttaatacacctaactaactgaaactcacagcttagcctagcctaccttcaatgtgctcccaacacttacatcggcctacagttgggcaaaactgtctagcaacaccttacacagtaaagtgtcagttgtttagcctcatgatcttgtggctgactgggagctgaggttcagtgctgctgcccagcaaggggagagagtatcataccgcatattactagccttggaaaagatcaaaattcaaatctagaagtagagtttctattgaatgcatatcactttgcatcactgtgaaatcaaaaaattgttaagttgaaacttcacaagttggggactgtctgcattgtgtggtgtgtgtgtgtagctggggaagaggtttggcttaaaattaatgataaaaggaaaaaggtgagattgttgcaaggggaaggaaaccaccaaagatacttttttatttcttttttcttttttttttttttttttttttgagaccgagtcttgctctgtcacccaggctggaggacagtggcgcgatctcggctcgctgcaagctccgcctcccaggttcacgccattctcctgcctcagactcccgagtagctgggactacagtcgctcgccatcacgcctggctaattttttgtatttttagtagagatggggtttcaccgtgttagccaggatggcctcgaactcctgacctcgtgatctgcctgcctcggcctcccgaagtgctgggattacaggcgtgagccaccgagcccagccgatacttttttttttttttaaagggaaaacctaatataatgttgctgcctacggagaggtttaaaataagagaataatatgctcccttggcttagactcagatgcctcttggggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatcaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtgtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgagaaagacttcctagtgcaagaagcgcacttcaagggcatccaattccaggaggaaggatagggatggcaagctgccaaggttgatagctggagaatggaaccaataattactagaaaacggaacctacgaggtgttctttaatctctttagcatctgactgagagaaaaccattctttccctagtgggtaacagctaaacaagattacagtatttcccctgggagatagatgggtcatgttatgagacctctcttgggcactaatatctgtcaaaccatataaactgagaaaattagtttggccatgtcctcaagacgtcttaaactcagaactaacagagacatggcctctaacctatgtgaaaaataatacatggtatatagaaaaagtagatttttgtaggacagtggcaaaataattacactggcctctcgagacccccttgctgtggaggcagcctgtggctgtggatccatatcctgacagtaatgctcttgtaatgtagccttttctggcaatagagcgcggatttgtaagccatgttattgtgggtcctgagagtcttctttagcaactgaagcctatctaatgtcacccttagcgcaccatcaaaaggtgaggtgcatttacagagaaggcggtgcatttttcacctggtttgtcatggtgagggcgagtccagaaactgtgactattcacacaactccagcctgtaccaaatctctataatgtgtgctttagttgctgaatagaggcaaaatgttctctatttcttactgtttgcagaatatttgtcacacttatcaactgcagtatatttagccctatggtttgggctctctccaacccaccacacattattaataaactaaatacacttgctttgttaagtgcgtttttatttctgctcttacaagttggctttttaattttagaagcctcacacctgtagaatgtcatcagaactacaaagggagaaagaaaatgcttaaattaccttcttcataactttcaatggagtatcagctatatgaaacagtttataaatccttcttaccaagattttatctttgttcctgcttttctaccaagtttcattttcatttccaatgtgttgagaggcagtaaggagtcatgcaacacttaactgattacaaactggggacattataggccaacggtgatgctctccacttaaatagtgaattctctatagtggatacaattgggttatttggctttctgcaatacggaaacattgatagggaagtgaaaaaaaaataagatcaagtgcttaatagaggtggaagtgcatatttccaaggcatctgtaattcaaactcttcactggcaccaggaaatcactgagataacatcattaattttccttaaagttagagttggtagaagtggcctttggtagggaaagctagccagggcaagttttatttgcctgtaccgcagacaatagctctttatcatggctttgcaggcttagaaatgacaaaagcctggaagctaaatctaagcaaatataaaattaggagaaaattcttaaatcatatattgaaagtaagtaatgtgaccacacatatgttcaataaaaggatggggtgaactcttcattctatagttttactatatatggcaccctcctagcattaatgagaattcaatacttaatttagatacatacaccttaattttggcatacttgaatctttttcacatattagaaaagccatgctcagaaaggaaatgcagagaatttcaaattgatttaaaagtgaaaatttaaagaaattattctacattcggagcttacctttattacaaggttatcacctcaaatggacaaaattttgtatattatgaaattcccccattttcccaaagtttattggaaattataagttgaaatgacagacaataaaacacatatgtgaatggaattttttttgagcaggaaaatcgaataatgcctaaatccagggtgaaaatggacattatagaaaggaacagtcattataaggtttttccatctggtctatttctgggtttcttttttttttttttccatagtataaactggaacaaatggttagcttctgaacttttaggatctcacaggaatattctctagcacttcatgataaccagtgcctaattactcctttattaaaggaaagcagtagctctgggatggggcaggggcaggggcaggggcaggtgaagaaaaagaggcaagaaaactttctctattcagccccctgactcgatcccatcccaaactactttttcccagctatgacgtattaacaggtcctaaggaaaccctcgacctggaaagccctttaaacaccagttaaacttggcaactatatagctgaaaaatgataacttcgggctataaggaaatggaagccttggtttactttcattcatgcattcatctcatgaaaacatattgaaccatgctgtgtgccaggttttgtactaagcattggggataccaagatgaagggaaaaggcctagtctctctttccaaataattccacttctaaggcatttcttctctatctctgtgtaagaaccatatgccaagtgactccttgactatcttattgctagcctctgcagatcctctggttgaacccctttatttctgaagacctggcagccagggttcacggtccttctcttttgcccagttctcgctccaattctgcatgatttcaacattggcatgggggactcatgcatcattctagcctctcagttccttaacttgctatttcacctccatggaaattcacatccactctacctctgccacctactcaaatggctatatcctagatctaatcacctgaaactgttccaccttcaaaataatgttcatctatgattctctctgaccacaacttcttgaccttcagttcctttactacttcttcccctacctccctgaagagttagcattttcatccctctacctcctaattaccagtttccatatgcgttcacagcttctcctacccaacagggacttgtcagtatcattttaatcaatcttttgcccaaatcctcacttctcttgcccagctgttccctccctaccccaggacagaagcatctggctcccaagtgctaagcgtgcctggggaaataccacacccctgcagattggagctaccgtgaaacactcagccgcctctgggttcacacagctggttttcaactccgccctctctcttattctccacaaagataagcccaacttcatcatctcctgctgttaactgcgttgcagggactctccactccatacaaaaaatggaagcctttatagtaagacatccttcaccttgctgctacctggtttcttagttacctggacctgcccagatccttccctctaccccacccattacagtggaagagaggtatctcttccctcccttgggctctggattacctgcccgtattctctgagaacacccattatttatcatctcctcttgggccaataattgtaatctcaccctgtcttctcatactcatataaatacattcccacgaatactatatgtttggcctgcatttgattgaaaaaaatccacgtaagttgacccaagcagttcaaacccatgttgttcaaggatcaatgtatacacacacacacacacacacacacttatatacacatattgtgccacataatgacatttcagtcaacaatggactgcctatatgacagcgagcccatgagattacactattatatatttttactgtatctttctatgtttaaatacgtttcgatacacaatacttactattgtgttccaactgcctacagtattcagaacagtcacgtgctgtacaggtgtatagcctaggagcaataggctatcccatacagcctaggtgtgtactaggctataccatctaagtttgtgtagtactctcctatattgacataacaacaaagttgcctaacaacacatttcttagaacatatccccattgttaagcaacacgtgactgtacatacatttccattaactcctcagccccctccaactagctaccaccccactcttctccccttcataagtaaatttctccaagaatcattcataccttctctaattctccacttttggttcacttttgaactcaccacaccacttccactgtgcctctaaaatctcaccaaagttactagggaccttcctgttgctaagtccaatgggcattttccgcaactttatgctgacatcccagcaacatctgaccctggtaacgggttctttctttcttcccatggagcatgtggcatcataacctcttggaattttccttctttcctcctggccattcctttgcagtcccttctgtaggttgcttatcctgtgtcctaaataacttcccttctcacgctacactttcctggagctatccaatcctctcccccgttacaagcagcacctacaggctcatgatccctaaacgttgtttgtatatttctcctgagcaccacagctccgtgtctaaccttaccagacaagtcccacattcacctgatattccaagccaagcacctaagtgtcttccttgactccctttcacccaccacatcaagcttgtccaacctgtggcccaggatggctttgaatgaggcccaaatgaattcgtaaactttcctaaaacatttttttttttttttgcgatttttttttttttttttttttttttagctcatcagctaccgttagcgttagtgtattttatgtggggtccaagacaattcttcttccactgtggcccggagaagccaaaagattggacatccctgcaccacatcaaatgaatcactgaggcctgtcaaatccacttcctaaatatttctaaattctctccacttatctcccttactactctgctaattcaagccaccacattgctggtttagattactgcaacaggtttttctcctgtcactcccacatcgcaccaatccatactctgttccacagcaagaatcatctttctaagcgacaatctgattatgtcacccccaggccaaatcccctgacctctaaattccttaacttgggttttaaaaaccttgcacaatctgcttcctgcttctctctccagcctattatttcacaatagatctttcccctggaattctgtgctttagccatactgacatattttcagttcctgaatgtgtcatgctttctctgggcccttcagcacatgctcttctttctgactagaacgctcttcctagagagagagctgcttactcttctagagttacctagcttagacatcacctcttcaaacaaacattctttgaatctcattccacacagttagctgttcacatagtaccccattgtcccactgttgcacaactaaatatatgacattgaaatggtcttggaaatagagacaagatcactttatttttttaaccaactgtagacattcttaatacattatacatatatttgcttatgtctacaaatttcatgaacatcctggttatcccttgttagactgtaagttccatcagagcagaaactgtgcctgttgggccgggcgcattggctcacgcctgtaatcccagcactttgggaggctgaggcgggtgaatcacctgaggtcaggagttcgagaccagcctgaccaacatggtgaaaccccgtctctattaaaaaatacaaaaattaggccgggcgtggtggctcatgcctgtaatcccagcactttgggaggccgaggagggcggatcacaaggtcaggagatcgagaccatcctggctaacacggtgaaaccccgcctctactaaaattacaaaaacaaaattagccaggcgtggtggtgggtgcctgtagtcccagctactccggaggctgagccaggagaatggcgtgaacccgggaggtggagtctgcagtgagcctagaacgcgccactgcactccagccagggtgacagagcgagactctgtctcaaaaaaaaacaaaacaaacaaacaaacaaacaaaaaacaaaaattagccgggcatggtggggcatgcctgtaatcccagctacctgggaggctgacgcaggagaatcacttgaacctgggaggtggaggttgcagtgagcccatattgcgccactccactgcactccagcctgggcaacagagcaagactccatctcaaaaaaaaaaaaaaaaaaaaaaaaacagaaaaaaagaaaaagaaactgtgcctgtttcatgggcatatcatcaatgcacacagaccctcagacaatagtagagttatacataaactatttgatgacatgatagagctgtgtaacacttcaggatttttccacagatgtatgataaaaaaggaggaaagcaattctgtcatttttcctctaccacttcattcatctgcacgttagcattcaagctaataaaccacacatgtctatgaagtttggtttagatcagatagtcatagtcttctaatactaagtacattttgtaaaaagaaaaaaaaacaaaggtagaacaaggattgtgcaagtttcacaaaggtaattatggatgccgatgccaatgccagtagttggaaaataaaaattctcaatatcttaattcaacatcagtagctgaggaatggtgacaggaatgattctaaaaataaaacaaaacattctaggcaaactctaggccaaggatacattaaagaatgaattatacattgcaacaggaattgtgacagctgtttctcccctctctaagtaaaaatgtacccaacctactttttattctaagcaaagacatagtatcaagatcttcaaatactggccaatacttacagcaaagggccttctgcagtcttcggagtttcatggcagtcctataagctgagaatctgacattattcaggtcagctgaaaagagggaaaacaaagagcatttgttattccatcagaaataacagacaacccacccccgacgcccagtgatttgccaataactacaaccaccacaaaaatagcctagaaaacatatagtgtgtatacgccaagctttcggaggtgaaaattctgttaacgtggggaaaagaaaaaataattccttttgccctttgacaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataaatcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgtatttaaaaatataattaggaataaaataaacatttggctctatattctaaggtacaatcattctaatgttcagcacagaataacaacaatatatgttactgtggtttctgcagtcaccggtctatcaagccctgactcacgccacctagcaggaagctatatttagatgatgttcttactcaagtctgcacaagccttgatagatactgggctacatttatttcaggaactcagctccaaaaagctccttgaagacaagaactctgtcacctacttctgtcatttttcctagcaacttaatatgcaactgccctctgaaaaagctgttttaatacagatcatggaccgactgaccaactgaatcaataaacaaaagaatgaaagaaagaaaaagtacactgacatacatgactgccataatcaaatgacacctacgaaaccaattctgatgaggtgttaggaaagggcaataattcaatccatatccaagtcacttgggtcaacattttcagctttatggccatcgcagagaccaaacataaaagcctgaatttcaactaggggaaagaaaacaatgtctgtaatttaaactattcagcatacaattttgtttaaaagaccggaataccaaatgttggtgaggatatggagcgactggaattctcagacactgcttgttgggaatgtacgacaactttgggaaaccagttaggcagtttcttatgaaattaaacacacatgtatattatgactcaaatattcttttcctggatatttgcacagaataaaaaaaaatgtatgtccacaaaaagatgtgtacatgaatatccatagcagctttattcataatagtcaaaaaccggaaaccaaccagtaaggtaatggataaacaagttgtggtaaagtcattcagtgggatactactgtgcaaagtgcaataaaaaggaactaactactgataatgcaacaatgtgaactgatctgaaaaacactaagctgggtaaaagaagccaggcacaaaacagtacatactgtttgatttcacttatatcaacttctagaacaggcaaaacttagctactatgccagatggtagcctggggtgtggtgggagtaggtaactgacctcaaaggaacacaagggtgttttctaggtgatcgaaatgttatatcttgattggcatggtggttacacgagtgtatacatttgccaaaatctaacctgaacacttaaaatggaaacatgttatagtgtttaaattatgccctgataaggtaaattttaagagtctttaaaaaccctcacatgaacagtacactctgatgtatgtgtgtgttagcttaagctacactgtagaggtggtcagttgtcttaatcaggagtgaactccaagggtggttggctagcaattaatcaaaaagcctcatgccacaggcggccactgtaagtgattcagttatatttagctcttattacaccaggggtttcattaattttcctaattaatagttagacgggcctgtgtagtgatattagtggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggtatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaactacatctaaccatgaatgactaccaacaccaattacagagaacctgtgtgagtccttgttagtcaaagtgtgatttgaggaagaatagcatcagtatctgcttggagcttatgagaaatgcagaatctcaggccccacccagatctgtgaatccgaatcaatattttactaagagcctctggtgattcatatggaagttctttaaatgaatattttaataaagtttcttgttccgtgttgttaaacttcaagtataaattctgtataccaacaccatcctgtgttgtcttttgtttttctatctttctatcttccattttgtgggcttttattaatagattatttaataactactatagtcaactacaccaaaacctcccctctgggatatatttgtgagtctcttgtttatgataaataccaataaaaagtattcaataaattaaaagcatctcggagtatcttgaaatgctatatatacagattgcttcttgaagataattaacatttgcctggacgctgtcctttagtgagcagaacttgatctagttgagtccctttaattgtccttctctctctctcccctaaaagatgtggttcttcctttgtctcttttgcccagtcatcactgcttacttttttaagtggtctcagccaactcatggtatgaattgtcttgcggcatcaatccatgagaaaccaattcctgtcctcccctccagattggtgcaacatccttcaccagtaccatcaaatttttcctgtacttgctagtgtggagttcccttacacacacactcatcattgagtccctttgactctttataaaaagaaatgtagagacgtggaaatgcacttttggtcaaatacagatccctttcccattaacaccagcctgtagcagtttccaggggataagcatccaatcccaaattttctctcattcctttacttatgcaaaagtattgagtgttagttttgtgccagccaaacatcttgtagaagatattggcataaagtttctcttctttttttccctttctaatcctccttctccactgcctcgtaactcatgtgcctagtttcctatcatctttcttctttcaaagaacgacgattcctctcttatgaccccaattctaccctcttttcctattttcctggttctattcagcatttagaacaaatggtctaaatgaggtcacaagctccatccaaatcttagcgttcatatcaagaattggcaaattccagtagctagagatccaagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcaatgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagtgggggggatagcactgggtgatatacctaatgctagatgacgagttagtgggtgcagcgcaccagcatggcacatgtatacatatgtaactaacctgcacaatgtgcacatgtaccctaaaacttaaagtataataaaaaaaaaataaaaaaataaaaaaaaaaaaaaaagaaagtagcagggcaaacgtttagcttccatcacaatgctacggaagccatacaaatgtatatctggtaactgtcagtgaactgcaacggagttctggtgccctacaagtctactactcaagagagttaactgcctgtgttgtttgagtccgcatgtgttgctaggagtctgcagcaccactccctccggcttacagctggaagagataagtctctgccttaggaaagtgtgtaggatgcacacagaaacctcaagatgcaatacagctgtgaacaatgtgacactgtcctgggctaaagcttgggatgactgtgtagtgaaagtatgtatgcagtttaataaagctaaagccccccattcccgtgccccatgagagactgtcctccactttccctgggagctgactttccaggactctgatccaagttgtaatgagctcactagctctcacagccggaactcaagaggagtgagactatccaagaaaccagttacgccatgtttccatggcagctgggagaaagcgcacttcagaagggtaaaaatgctgaactgcacatttctcttcataacttgtattattttatccagggctggttctagcctataaatagagaaatctagaaacgtaaggaacaagggcaaacatcaaaccacctaccttctcaagttgaatttccaactactgaagtgataggccattcatcttttattttgaaacatgaaacaagtaataggcttctcttgcccctttgtttagtctatgcatttttcttgactttggtaagtatttctgttttatgactttcacttttactctgtgtaatagtagcaggtgtcaaaattcaccagaaaagaggaacaactggtcaagtttgcgtcacatatctacatgttacatgcttttgaaaaatagtgagaaacacctcagcattttaaagccatggaagcattccaaagatattacagaaaaaaaacattaagtcccttcatttcaattttatagctggtttctgtctttttaataatactgcaaaaatcctactatctctgactgaactgaggtctagaatttaaaacaaggagtgttttagtctatctttccaatggcttatggagactttttggaaaggcctaaggtttcaatatgcctatctattagctagaaagaacaataatgacctcattaactttatgagtggaaagagctgtacggctaaatgattattccaacagataaattggtatagtggtctttgtttcttcataccaactctatttcccagaagaaatttaatccaaatctcccaggtggtaagtgaaaaataaaatttagagcacatatgcttttgggggagtattgttctaaattcagtgtttggcatacaatacgcattgaactactactgcctgcctattttactaattttccaaattttcccaagaagccaaaacaaggcagtctccccacatactcctattatagaaaggtggcatattttaaaatataataatatgtctccaattttccagtctcactcctccaaaggattctaatggacttttcagatgacaagtattattcttgccagctcaaactcactagaacagacaagaaccttggatcttaatgagacttcagacaaattgagtaatttaaatccagtctgtcttgaaagcaaattaagccaaaatatccaggcttcagaagtctagaattattgggagatcttcaagaacagaccaggaattctggaacatatctttaaagaattagctgagagaagaggaacactaacacatcatacttggtctataattttttagatatatttgaggcctcttaaaatctcaactcgtaaaaacctcatcatcaacatagagctttacttaaatgggggaaaaataaacctacacacagataaacaggaattatgcattcatacttagataagtacagaaagtacagtctgtgaatttataattactatcaagttatgtttccagatgtgaaatggtattacttatttatcaccaatgactttgtaaaactcttctaagaaatgaaggagagggccaggtgtggtggctcacacctgtaatcccagcacttatggaggtcgaggcgggcggatcacgaggtcaggagttcgagagcagcctggccaacatggtgaaaccccgtctctattaaaaacacaaaaaaattagccaggcatggtggtgcacacctgtaatcctagctactcaggaggctgaagcaggataattgcttgaacccaggaggtggaggttgtagtgagctgagatcgcaccactgcacttcagcctgggcgacagaatgagactccatctcaagaaaaaaaaaaaagggagagaagcaataaagtacctagtatggcacaaatgtggaagactcagaattgaggaaaagagaaaaaggttatgaaccaaaaaatactgagaagttcaactgtgaaataaaagatagcacaaaatcctggctgtggattgtttaaggcatttctggctccctcctcttgcttggccttcctcagcagaatctcactacttcttagcaacactgtaataatggcagagttgaaattcaaattagttttgctcattgttagctgccctggtaaaaggtttgttgagaaagcagtttctgtaacaaatggccgatataaagttttctgggggagaactgtgtatcttaagtaccatttctggggcctgaattctgccccagataatggagggctgactcatataggcaccactgtgccatgctcctttaaatcaagcttcaagagcggaaggatcagggctctaactcccaaaaccttcattatatataaaacatacaatccataataattatggatccataaggataaatgtcttctaaaaagctacaaagcagtgttgcctgatcttttaaaaatcattagtattattttaatatataacatatattattttaaatacatttaaaatagtacaaatgacatatttaaatacatattttatatatttataacatatgtgtatttaaatatgtatttgaagtaatactactgattaaaaaagactctttaggcagaactgttttataactgcttaaaagacattcatctatccataatcctttcatctatcctttcaatatttattgtgcatgtactataagccaagaaccatgccaagtacatggaatacactggtaaccaaaataaatctctgcctttattgactttgcagtgtagcgaaggagatggataataatcaaatattcatatgtaggccaggtgcggtggctcgcgcctgtaatcccagcctttgggaggccaaggcaggcagatcacctgaggtcagaagttcgagaccacctgggccaacatggcgaaaccccgtctctactaaaaatacaaaaaattagctggatgcggcggcaggcacctgtaatcccagctactacctgggaggctgaggcaggagaatcgcttgaacctgggaggtggaggctgcagtgagccgagattgtgccgttgcactccagcctgggcaacaagagcaaaactccgtctcaaacaaactaacaaacaaatattcatatgtactgtggtaaaatggtgaaggaaacacacaggaagtgatgagactgtatacatagggaaacataggtccgagaggcttcttggagaaggtgacattgaagcaaagacttgaaggatgatgggagcgtgccaggtaagaacacagcagcgtaataggtcagcacatgttaaaaaaaaaaaaaaaaaaaaaaaaaagctctgaagcagagaagaaggtggggctttaagaatccttagaaggccaatattgctgaaatctcagagaggaaggaggaagagtgggcacagataaggcctgacaggtaggcagggggaggcccactgcagagccctgcacatcgtgtgaaggattttgggtgttgggacttctagttaaacacagcagatggagcagactcatttgtctctctttatccctgaaactctaccaggttgatagaagaggaataaaaaatggcatttacccaaaagaaaattaacaaaacaggagaggagatgagaacagatcagagctccagtattttggtggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggcttaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccacctttatctccagaaggaacttcaacttcagcaaggtatgcagccattaaattgttcctcaattatcatccctatatatcatattcttcatgctgcagttacaactactccaaatcaaatcaatgcactttccttgcagtctccctcttgacaggcgacttacagtcacacaggccactctggctgctggaataaacaatactattctcctcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagccaaattcacagatttttttttttaatgttgtgccttagcttttttggattgcaaaaacatactcttcataatatggttgacattacctattttgaatttatcactctctcttacagttgaaaaatttgtggaaagcgtattttaatgatgaaaataaataacagtaaatttcctcatctgctttaacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctgaggctgaacgtcctttctctttcttcctgcctgagaagcagcagtcgtcttggaaccatcaggaccaaagtcactcgttaaaaatggtacagcagaataaaccatggcccaggtctctgatgacatcacggaactcttccatagctctcaactacctgcctccagacttcttgttctacaaaaaatatcaactcctctgtgtttaagatacaattggtcagatattttattaactgcaaccaaaagtcatctctaactgacatgttaattgaactgtaagcaacaaaatgcagaagactaaatagggagcatcgtccacccccgcaatcctccttgcggtggagaaatgacgtgagcactaaagagatcttgggtggcagagatctccatccttgctaccaggtggtgccactgatgcagaacagcttgacagctaatttaacgtttaaaacaattttataacagagggcttatatgggtaaggcactcttctagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgacagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatgaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagaggggaacaggtggtatgactcaaattgcccatgcatgcagaagcatgtgatagagaatgttttcttttcactgttatgtgttaacttttctggagactagatgctaatgatgagatcctgctgaagacactaatatgtaaatcattccttaaacaaaattacttagcagctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatgcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctgagttcctctgcccacctcatggatggccctgaagtcacaggagtgagtttgccttctttctcctctcagtggcaatgaccacggattccttgtcttttggattgcctcctacttcatagcagacagggctcattccccctttctctgcctctctgtttctctcacttctcacctcagctttcttttcaacacactggatctgacccagcttttattctcctcagaatcctggacaaaactacttgaggataaacctaaagcagcccttttttcctaagatgtaggtgactcttacttcagctctttttgtatgcaagtattccctgtagagccaaagagaaaaacggaagtgacaggccgatggcagaaggaatactaacattcgctgagcactcaagggcaaatgtcgtgtgtacctgataccatcgagtccttacaaggccctgagttctgtattatcagctttgttaaagataaaatgaggctcacaaatgtttggtaacttccctacggttgcatcccagagcctgcattcaagaccaaatctttctgacactcaaagcctctgatggccttccccgcttctccgctacagaacaaatgtctttccttacccagtgtaatcctaattagcacaagggtgaatgggcagtagtaccctcagaagaaccatgataccgggcaaggagcagagggtatggggtgaggcagaaacccttgcacaaggaccacagggagggaaactgaccagtcaatgggatgagggagtgaccaggaatgtaactagaccaataatgatgaagttcccagtcctccttatctagagaagtttgctgaataatcaacacctgcagtacgagtttctaccatttttcctacaaaagttttttgctcccatagaaacatacagctgctttctatttacatggtgcagtatatcaggcactctgagggttaactaagattctgtgacttagggacctaaccaccatttataacacatttcattccaaattgtatgcaactgacttacaaataaacttggaacagagcccgagggtaagtttggaaaggcctaaatcttgtctcaaggtgggaatgtggttcttgcctgactgctgagaaatttaatggttactgggcaaccaggaattaaataatttgggaaattttaactctacctttttcttatgagtattctttaggggaatatatatactttttattaagaaaatgaaatacatggtgccttagaaatagaatctctaatttaaaattttcattttccaaatgagagaactaaggactagaaagctcttagtaacttgttctgaattccctagtcagctaggagaaaaacatcaactagaatccaagtctttttctccccaagtgtgtatcccttccctgagcaagccacagaacaaaaatataaaggctcattctaagtgggacttcaagtctactcattcagcttaagggctcccaattgctcccaattcgaacagagggcccgtgaatttctttaaccttgacaaacatctgactggaaaacaaattttcccaaaagcaagcagggtctaattttcccctgttaagagtggtttctagaccttggcatcttcttaaatttttaagattcagctcctcctaacccgctctgacatataaagtcatagtgttgtgaagcagactgtgttatagaaggaagtcaggaagtaaggatgtgaacatttcttttaaagagtagcagcagcctccatcctgaatgaagaagccaggtctcagacactcccttagacgtgccgcctttaagaaaggacatcctctctgtacttctgatgatcagcttaatttcccatttgaataatgatttttttgtttgcttctgaagtcatgagaagcagttagcatttatgaagctttgaatggttgtccaatttgacttaaaggccacgagatgctgatgttaaacttcgtacatttatttctgggttcctgtcttattaaaacactgacataactctccatagtgcaagttttcattcaccatctgtcagtctattgcgctacaggaaaaaaaaaactccaggttaattatgtaaaaggtaatagcatcaaagaacagaacattgtgcctattatactctcaatgtgcaaaaatgggcatatttttatgtgtatgtttgtatatgcaaaaatatttacagaagcaaacataaaaactatactgttaattgtctctaggaagtaaaattaggggattgataccaagagtggttggagacttacttttcaatactatcctcttacaatgtttgatttcttaaagtcatgtgcactttttttaatgattgagtattaaatctatctatcttcttttcaagatttctctatctgggatttcttccaaattcttagcttcacccgctgtccttcaggagagtactattgtacaatggaaaaactactgggtagagaagaaaacttaatgggctctatttatgtctttgctgtaaaataatagtaataatggttatcatttattaggtgcttaccctatgtttgcaataaataacataaattctcaggttatcatttattaggtgcttaccctatgtttgcaataaataacataaattctcatataattaccttcaactgtgatatcattatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgcccctgtacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggcagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggctcattcttgtaatcccagcactttaggaagccgagatgggcagatggcttgagctcaagagttgagaacagcctggataacatggcaaaaccctgtctctaccaaaaatacaaaaattagccaggtatggcggtgtgtgcctgtagtcccagctgcctggggggctgaggcaggagaatcacttgagcccaggaggttgtggcaccagtgagccatgttcgcaccactgcaccccagcctgggcgacaaagtgagaccctgtctcaaaaagcaaaaaaaaaaaaaaaaaaaaaaaaaaaaatctggagtagattctcagagaacaatgtcttcactgactcgcaaacaagccagtctttcatacctttgtttatgctgctacactatctggaatatcttggccctacattttactttacctgagtattacaaaatttcttcctagaacaatgtttttttccactctccaaacaactctccctaattattctaattaatactgctcttcctacctatataaggtaccatacgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatgggggaaaaaaatcaatgcctcacagaaaactgtaaatgtaaactgaccatatctatggtatacatgagtcttcctcacccaagaggcaggaagcaatcttccttttctgttaataactgaatagccttttattaggacagccactgtaatttagggctctgcatatatttaaaaaatgtgaagaaacaggagttggtatagagaataaaatttaatttaatgggtagataatagatccactaaggatggataaagggataaggcttatttagctgaaaaaaaattaaactgtacagtatttatgtaaccaggaggctgttaccaactagagcccctcaacataacacacaaaaaagtgtgtattatatcagaaaagtttggaagagttgtgtttggttaacttcgttttgttttcacattactcaaaaaagaagaaaaacacccagcagatatttaaaagaaaacatttgtggtcactagaaataaaaaatacacaaatattaacaatgagatggtttaattttccttgttacaatagcaaaagtaaaaataatactccatgctgggaaggacatggttagattggcactttgaagtattatgagtgtaaatggctacagccttttgagaaagtttcaggcagtgcattccaagaagcttagaaacattaacaccatttgactcagtgattccacttacatgaatcaaatgtagaaaggtgttatgcataaaggtgttcctcaaagtcttacgtggaacagtagaaaaattggaaacgactatggaaataattatcagctctatattctttaattgcgtcttggccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagtaagatcataaaaacttctataccctcagtaaacgtttttctccttgatatttttagcctgttgccctaaagtttgaaaatacatggcacgctcttaaatgtttactgaagcaggaaaccaatgaacgaacgaggccatcagcacatcaaattgtgttcagtgtttcctttctttgtcatataaattctgaatccatagtgacactttttacgggtcttatttctccttatcaattaattattccttttagggcaaaattaattccagaatagcagttcacttggttttgctaagataacaaattgccaataaaatctacaacttaactgatattccctattttaattactttgaggctttatcttctactttctggaaagaactccatctctccagagttccatcttgccagtttaataatccgccttagaaaaccctcatctgtatctttccatcttcttgagtggtatttgttttcctcccgagcaaaatcactctcccttgctctactgtgcttcattcaatgaacaattattttttcagaggctaccatgcaccaggcactggtgacaaagatgaggaagacagttcctgctttaaagaggctcattacaggctcatctcattaaattgcactttgctgtattgcactttgtgaaaattgcattgtttacaaactgaaggtttgtggcaatcctgtgttgagcatgtctatggacatttttccagcagcatgtgctcactttgggtctgtgtctcgttttgaaaattccctcaatatttcaaatttgtcattatttttatatctattatggtgaatcgtgatcagtaatcgttgatgttactactgaaattgttttggggtgcaactaaccacacccacataagatggcaaacttaattgatcaacgtcatacgtgttctgactgctccaccgaccagctgttcccccatctctttccctctcctctggccttcctgttctgagacacaacaatattaaaatcagggtaattaataaccctacaatggcctctaagtgttcaagggaagaaagagccatacctctgtcactttacatcagaagctattaatgattgagcttagtgaggaaagcatgttgaaagatgagacagactgaaagctaggcctctcatgccaaacagtcaagttgtgaatgcaaaggaaaagttaatgaaggaaattaaaagtactaccctgcgagcacacaaatgataagaaagtaaaacagccttattcctgatatggagaaagtttgagtgctctgaatagaagatcaaactagccacaacatttctttaagccaaagcctaatccagagcaaaaccttaactcccttcaattctatgaaggctaaaagagatgaggaagctgcagaagaaaagttggaagctagtagaggttgcttcaagaagcttaaggaaacaagccatatccataacattaaggtgcaagatgaagcagcaagcattgatgcagaagctgcagccaagttttccagatgaagctaaggtcatggatgaaggtggctacaacgaacaacagattttcaacatagatgaaacagccttctatttaaaggtgatactatctaggactttcatagctctagaggagaaatcaatgactgccttcaaagcttcaatggacaggctgtatctcttagtagggcctaatgcagctggtgactaagttgaagccaatgctcatctaccattctgaaatcacagggcccttaagaattatgtgaaatcaggccgggcacagtggctcatgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactttgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttgacatagacagtgattcctctgatggatctgggcaaagtaaatggaaaatctctggaagtcaggtgtggtggctcacggctgtaatcccagcactttgggaggccgaggcaggtggatcatgaggtcaggagtttgagaccagcctggccaaaatggtgaaaccccgtctctactaaaaatacaaaaattagccgggcgtagtggcacacgcctgtagtcccagctactcgggaagctgaggcagaagaatcacttgaacccaggaaggcagaggttgcagtgagcctagatcacgccactgcactccagcctggacaacatagcaagactgtgtctcaaaaaaaaaaaaaaaaaaaatctctggaagtgattcttgatgccattaagaacatttgtgattgataggaggtcgtcaaaatatcaacattaccaggagtttggaagacgttgattccaaccctcatggatgactgtcaggggttcaagacttcagtggaggatgtaactgcagatgtagtggaaacaggaagaaaattgaaatcacaagtggggcgtgaagatatggctgaattgctgcaatttcatgatcaaactttaatggatagggagttgctacttatggatgagcaaagtaagtggtttcatgagatagtatcacattctacagagaaatctttcacaaaaggaagagtcaactgagtggcagtcttcattgttgtcttattttaagaaattgccacagccaccccaaccttcagcaaccaccatgctgtgcagccatcaacatcgaggcaagaccctccaccagcaaaaggatcattactggctgaaggctcaggtgatcgttagcttttttaacaataaagtattttaaattaaggtatgtacattgttttttaagacataatgctgttgcacacttactagactacattatagagtaaacataacttatatgtactagaaaaccaaaacacttgtgtgacttactttattgtgatatttgctttactgaagtgttctggaactgaacctgcaaaatctccaaggtatgtctgtatttagtcttgagagtcatgagcataaacacctgtaaacgtcgcaagtactttcatcaaatgcatggaagcttatccttagtgtttggacttctctgcagataatttgttttaattgctacctcctctcctttaagatcagtttcctttgaacccaggatgtccttctggtatcttatctatgtcacctcaaactcctatgaaagctttttagtttttttatgtttcttgttcccgaaatatctgcatagagggttggttgccttactgtccatgggatctcctgtacttcaatcatttgcttgttggtttttgatactttctctgccttttctctgctctgctgtttattacagtacattttcctgctcccttaccaattggcttccaagtaagtttggccaataggagtcactggcagaagcctagagggcaggcggaaaggagaagccgggcgtacttcctttttcattctacctccggcaataggtctggctaactgtgtctccttcctggctccagctccctcggagcccctccctcattggtcccagctggccaaaggttccaactccgccttgatgcccatgacatctggggctctggtgataccacctcttgtcattgtccctccagccctaggtataacagaaacttcatgctgtgtgtgtggcttctcagcacttccattcttgagtaaccaatttcccgcattaaattccctttgtttgaaataactagagggtttatgttttctgaccaggcagaccctgattgatacatcttccaaatcaaaaaccttagtataaaaaaccttcaacataccatataaggcttttcacagttttagccctcctcatctctacagccattctgtgatacctccactaccacagactagtaccaccatcatttattagatatttatgctcttttttgagacagagtctcactctgttgcccaggctgaagtgcagtggtgcgatcttggctcactgcaacccgtgcctcccaggttcaagcaattctcctgcctcagcttcccgagtatctggtactacaggcagacgccaccacttctggcttttttaaatttttattttagtagagatggggtttcaccgtgttgcccaggctggtctcgaactcctgacctcaggtgatccacctgcctcggcctcccaaagtgtagtcttttttatcctgaatgatatattattttagaattgggggagggcaaacaacacagtacaaaatgtattattttaatttgcatgtcaaattaaagtacgtgtatgctttccaaaagttaggataaattgtgatcaggtgatctttatcaccttggttaagaagtaaaatacttcagaaaaatttagtggctccttgagtgtcaaatgtgaagacctaaacctaggtgtctctcactatctgaattcttggtatctcaattcaggaacccaatagattattaaataaggagagacactggtatatgataataataactaataataataatgcatatcactaatagcaattataattccttgagcagttactacatcagacattctgttaccttacatatgtcattctaatcctcacaacacaagataagtctcatcataactatttaatacatcacataactgaggtttaaaattattagtggcttcctttttgaccacagagaactggtgacagaatcagaatttaaatccagcctcaaagtcaatgaacaattttgttgctgcaaaacattgcctccaaacctaaactcataaagtgacaataggaaagtcacagtataatcaattagttcccccactgaatgcaccccataaagagtgcatatatcacagtttatattctagataaaagcaaacctgtattttaaacttatcacattatatacattatatttaattatagggggtgcgagagacattaaactaggcagcagtggctctgccgcttaatctctggttccttcctgtaacacaatgatttctatgctttgtcttctaaaacaattgctaaggagagctaccaagtgggaaagaaaatagatccctcctctgcctgaacttgactcaactggcaaaacattaaaccgcataaataacattttcaggtgttcctgtttggttaattatcctcccccgacctgagtcacttgatttgagtttacatttatactttcaaaaattaagtgctctagaacagtgctactcaaaatatggtctttcacaagcatagatatggacagtgtgttaagtaacttctatagcaatttgacattgccatgacatccaaattcatgatcaatgaattcatctcatggagcagggtacagacgaggtcaagtgttgttgaacttgactgttgagttacatgtggtgtgaatgcatacttgtcagtttcattagcaccacctaaaaatctgtgatgtgtagtatgttaaaaaccaccaccgcggctgggtgcagtggttcacgcctgtaatcccagcagtttgggaggcggaggctggcagatcatgaggtcaagagatcgagaccatcctagccaacatggtgaaaccccgtctctactaaaaatgcaaaaattagctgggtgtggtggtgcacacctgtaatcccagctactcgggaggctgaggcaggaaaatcgcttgaacccgggaggcagagtttgcagtgagctaaaatcgcaccactgcactccagcctggcaacagagcaagactctgtctcaaaaaaacaaaaaaaaaaacccaccaccaacaaaaacctggcccttcaccagtttgagaagcactgctcttcagtgatagcttctttttttttttttctaagacaacgtcttgctatattgcccaggctggactcaaattcctgggctcaagggatccttctgcctcagcctctggaagcgctgggactacaggtgcgtgccaccatgcctggccttaaagtgatagcctctttacagaccaagaaagtaaaatataaaaacaatcactttcttaccaaaattaatgcttggtaaagaaatctgtatgtaaatatatcaatataagcaacatttgtctccgttatataagcttctatttatgagggggtgtaatgactttcctggagttatgcaagcgatgaacgctttgtggaatagcaaattttgaaacattcccacagaatatcaccaattcataaataagctaatgattcatccactatgtcataagagagactttcagaatatttttaggtcattttattactaccgtagagggtacagactttaaaaactatctattttatgtgagtgctctgactgttctgaatctctttccagcaaaattgcagctcccaagagacatacagaggtaatcagacttgtgggcttaaaaaagaaatattggaaatgtctgaataagagcagacacgtttttagatgcctttactctgtgtgcaaaaatcatcttctgcagatccagctacataaaattgtacatatccagcacttttcttctagctgcaggtgtaaccttaatgttcctcttatttagatcagtaaactacaatttggcagctcttttaaaactgtaaaccagtcaaagtctaaggaacaattctttttgagtttccttctgaaataagcttggagagatgcaattcagaaatatctattatgttcttcaattagaagctttaaatcaagttatttgaacaagaaaaaatattataatatttagaacagtccattaaaatgccataaattttgatttggaagttacatttctattttacaaatggggaaagtcaatggatcctaatcaaagttaaaagagcagattatttttcttttttcttttataagctgaatagtaaaggaagaacatttataacagccttaataacaaatttgagtaaatctcctgtgctaattttgtcagctagggaataaagaatgtcatatggattccagtttaattatgccgataaagcagttttataaatcatgctaagagtaatggatgttcctttgagaacagagaactcggagtttgtaaaatgtgtgttctggacttggttccttatcttctaccatagtgagtataaatcaaatcaagtcttgagtctcagtctgctcaagtccaaatggaaagaagggaaaagttgccccatccaccggtatggtagcattatttcccaaatcaaaaactggaaggacactcaaagggatgacaggacaaaaaatctgaaactgaaattgatagaaaatccaggtcatatgccacctactctatagctgtgtgaggattaaatatggttatttctgaaaactcttcgccattgtaaagtgctacacaaataaagtacaattattacaaatatgattataggctaggagcggtggctcacgcctgtaatctcagcactctgggaggccgaggcgggtggatcatgaggtcaagagatcgagaccatcctggccaacatggtgaaaccccgtctctactaaaaatacaaaaattagctgagcatggtggcgggaggctgctgaggcaggagaatcgcttgaacgcgggcggtggaggttgcagtgagatgagatcgtgcaactgcactccagcctggcgacagagtgagactccgtctcaaaaaaaaaaaattaaattaataaatatgattatcctattattcatatcctttaggttggtggtgacaaagaggaactgggggtttagggctgacaacattcatacaaccaagctttactctagccaggggttaaaacaaaaccagtcatttaatgatgaaagatcactggccaacatgacatataagaaaatgaagaccaatagaaagcaagggacttgcccgaggtcacaccaaagctggcatctgaatctagctatcctttccagttcaaagcgttatggcagtaaaaagtcaaaaggcagaggttttaacactgagcaatatattaaggaactagaagcaagagccaaggaaagctaaatattgagtagcttagtggagaacagtttagttcacaaaatatgctgagaaaagcattaggacaagctcctaatgcaaaaggaaggaattcatagtcattcagaatcctgcagtttctaacccaagagcatcctcaggagggaatacttaatggaatgtagaaagcctatcaaaagaggagagtgaacaaataactacaatatcccttcctcttgggcaagctgaggaaagaggtacaaggattttgatagcagtgtttttaactctcttgcaaattgctgatttataatgatattgatgtatctttaaaaagcttttagccccattgacttaactaggacttaactagttctcctaactagaactgctgaagaatcacacccctaacctcaggcccagcagaccctaaaattaaaccctcattttaacattctgaagctctctgcaaaccatagacatgaagctaagggctacgtgctgatagactgccttcaaatcttatggtttttaaagaccacttttcctaagaattccaaaaacactcagaagtccatttttgaaaattgagagctttcgcatcattcaggtgagcatcatgctggatagtaggatccaaaaattgggcaacagattaaaaagggctagatccttctgaagaacgctataacttaagaaaaggaaaaccagtaccccttgagaaaacacttgtggttaagagggcttcaatgaaggaaaaggaaattggaataagtaacaccagaacatacggtgcatctagattttaataaactgcttgaaataaaatcagctttctgaagtgcagcgattctctcttcacattatcctatttttacctacatgtctccttcataaactggtcttcttgtactatactgacagtatcacaaatgcaaaaaaactcacattgtaatttaaaaaggaaccattggggaaccacatattttattgtatttataattaagagacccccccccaataagacaggctaagaaataatgtttttaaacagggtctcgttctgttgcccaggctggagtgcagtgatgtaacctcggctcactgcagtctcgtcctcccgggctcaagcgaccctcccacctcagcctcctgagtatctgggactacaggcacatgccaccatgctcggctaatttttgtattttttgtagagatggggagacggggtttcaccacgttgcccaggctggtcttgaactcctgagctcaagtgagctgctcgcctcggcctccaaaagtgctaggattacaaatgtgagccactgtgcccagcctaaattctactctgttggtcagtatatctgtccatatgtaaatactcttgattacttaaatttgtagtaagatttgacattggaaattgtgaaggccaggtgcagtggctcacccttgggatctcagagctgtgggaggccaaggtgggaggatcgcttgagcccaagagtttgagaccaggctgggcaacatggtaagacctccatctctacaaaaaatttaaaaaaagattagccagacacggtggcacacggctatagtcccagctacttggaaggctgaggtgggagggtcacttgagcctgggtgttcaaagctgcagtgagccatgatcaggccactgcactccagtctatgtgacagagcaagatgctgtcaaaaaaaaaaaaaaaaaccccaataaaagtatctctaagcagcatatattatgtgtgtgggggcagggtgagctttttaaaaaatattttcttaaaatttcagtaatgaacttagggacctagacataaattgtgagaaaaggacaggcttttaaccacataattgcacttcatgtaaatcaatattatattagtatttcaaaataaattccagagcatattactatctaacatctactgatgttgtaaatgctttctggagccttgaagagctcagagttttaaatcaccaagctaacctattggaacagtctttccattacatttgtaaaaatgctaatagaaatctaaaactcacctcatgaatcaaacatattattacttctagggagtgacgaagaatgtaccctctcaataacaaatgaatgacccagaggagtctaatgggaaatatctcaagagcctctctatttgacaacagcttgcctcactcagcctgtaagacacggatgggtggcataatcttctcctgttgtttgttttctcagaatgtacattttaaaacataggaatgattacatttttagaaatccacttgtctgcagagttagccgaaaggtacctcttgaaaaataatgatcacagcaagtttagaaacagcctgccccaccctcagcccaaagtaaaagaaaaacaaaaatcttagacacttgtccaatatcgttactttttttttttttttttttttttgagatggagtttcactcttgttgcccaggagggagtgctacagcgtgatctcagctcattgcaacctccgactcctgggttcaagtgattcttcagcctcggcctcttgagtagctgggattacaggcatgtgccaccacacctggctaattttttgtttttttagtaaagatggggtttcaccatgttagccaggaaggtcttgatctcctgactcaggtgatccgcccacctcgacctcccaaagtgctgggattacaggcgtgagccaccgtgcccagccccaatatcctcacattttaaagataaagcaccaaggtctacaaaaaatagacatgagacacttggtctcttatatcccacttactccactactattctctactaccattctatgactattgggggtagtcacagacaaatgctgaaagaaaactgatttccagttgcttttagtgatttattccctgtgaaaatccaagacaatgcttttgtcaaaccattaatgtgatgtaaaaaattttctggggactcaaattcctaatgactgttcagtcatcatagtgaacctttaaattatttctttactatgtcttgctttgtttgtgtaggactctggcaatattttctctcaattttttgtgtaggtacacagccgataaatgagggaaacacaatatttctaacacttgatggaaacctcctctgcaaagccattttagatctgttggaaataatctaaaattaattatcttatattgttttttatctattttttaatcaaaaaagttctattttctctaccactaaaatgtctacatctgcatttttcacaactggacatacagactaaaaatacatgagatgatctctttgagtttaaagttacctgacaaagtccatgagaatcagggtccttaagtataaattatctacatatatgtggggcgtgtgtgtgtgtgtgtgtgtgtgtgtgtgtggctactgctgcttttctgtcataagttctcattagttaatgaattgtagctatagagacactaagtaagaaatggaatgggggtatcgacgaagaaacttttttaccaaacatctaactgtaaataatataaattcattgtagaaaatcagtggaaaaggaatgaaaaagaaaaccacccagaatgtattagagagctccaatggtaatatctcaagcaatattatagcttttcatcagtaaatacttgctactttttcagttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctgaaacactgtaattttggagagggggaaaggcagtgctggtagttaatcttatatgggatctcaaggatgtaggcaggctgggcgctgtggcttacgcttgtaatcctaacaatttgggaggccaaggtgggaggatcacctgaggtcaggagttcgagaccagcctagccaacatggcaaaaccccgtccctagtaaaaatacaaaaattagctgggtatggtggcgggtgcctagtaatcccagctactcgggaggctgaagcaggagaatcacttcatcctggggaggcggaggttgccgtgagccaagatcgtgccactgcattccagcctgggtgacagagtgagaatctgtctcaaaaaacaaacaaacaaaaaaggatgtagccatataacaatcattctatatgtgccaggcaacagtgaaaggagtgcccattgtttaggacccaccataccatttccagaaataccactcaagtaacttactattcataggtaaaactatcaattcctatatacgtgtagcaggtatgtagtaaccaacataaatatactttacctagtaaataaaatcaatgagaacagtgaaagtactaacagaaaactgaggacaaatccaggtgtagccccacatagctgtgtagccctgatcaattcctccctgagcctggcttcgctgtcctgtgaaatgtggatgttgataccatccaccatgcaggttggttgctggcacatcccatgtggaaaacatacaataggcccgcaataaatgggagatgttatctgatgaatcaccacttggataaaagcccaacgaatgtttgattgttacaaaactattggaaatattaactctgaaaggtgaaaagcaaacttcaacacttagttcacttgcaagtggtttgttattgggctagcaagaaacagaatttcaaagggggctggaattgatcacacacttacgatgacttccttttattatataaaaattatacctgaaagttgatttcataaaagagaaagtttgcaataaatgagttctaaaatcccctgcaactgtaaaattctgttataattcaaaattgagtgatgtcacaagcccaatgtcacaagtcatgagagattatcagttttgagtttatcaccacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaagcaagttataagacagaatgattcaacttctataaaaatatatgtatagaaagacatttttgaagatcctagactattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggggtcctgggagtactgggatagaaagaccagcttgcccaggacagctgctgcccacttcagatgaagccttttcattctctcatttgccaaaagataagcattcacgttttccacctgtggtataaacagtccacaattataagccaaaaacattctgtaggggctggaaatgtagcacttgaaaattagctgatcccaattttatttaaaattttaaacgtttacacacttataaccagactgaaatgacataatattactcgaaatgtattggatctctctggctagtataagtgactttgtttttcctttttcatgttttttatttacatttttcaggttttctagaagacatttaatcatttataattagaaaaatgtttaataaaaccattttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacagtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataaccgcaccactgcactccagcctgggagacagagcaagaccctgtcccaaaacaaaacccaaaacaagctgcaacttaagataactcatttcagaatattccttgtagatctaaaacgacaaaccagacatctggacatttgtccagtgtaaaaagactggtgttttcaaacccttatttgtatgctctgtacccattcaaaataattcaagttatgaggggaaagaaaacagaactgtcaggctcttacataaacacaaaacaagccatactaaagaaatcatttaaatgttcacattaatgacccgccaggccttaggaattgtgagcaccggaaagacggcagaaaattcctttacacaacatttgtggtttggcaaaagggttgtcttggtttcacacggaagaaatcaacaagcacctgaaacagttttctatcttcgtgggaagaaaaaaaaaaatagccataaattgcaactgtttttccatcattttaggcaccaaagagaactacaaagacctataggccctctcaggtatattgaatttttaggaatcaatcaacttctaaaacttgtttttaaggaacctctgataaaaagaaagctgactgtcaattttggataggaaggtgccactgctttcacccttgaaacaatctagtgatgtatttatatagcaagtaactttcacactgcaaactactttatcctaaaggtcacctgtcatttaacttggaggaaacatggccatgtccttacctaaagactggtagagctctgtcattttgggatggtcccagcaagttgtttgagtctcgtggctaaaacacaaaacataaagaaagactttagcatttacaatgagtagtcaagaaaacaggaaaaaagaaaacaacaataacaacaacatgatttttgcttttgaaccattcggaatctttatttcaaagcgcttccatagtgtattgaagaaatgtttatcttacaagcagaaaggcccctttctgctttgtttccaaagagaaaagcaatataaacattattcggttccagaatttgtttcttctttgcacccacaaatcgatcgcacttcagttatgataaattgaccttgttatgtgatcaataatcgactatcaggacttcttcacccatccaatgtggaacactacagaaaggacaccgacaactgattattattcaactctgtcaaagagataccggacattagttcaataaatataaatcatctcacttctcatttgctttcactgcccctgacatttttccattactctttcctctacatatacagatctcatatccatgatacctgtatttcatttcagcttaaggtatatctactgcctgactaatatatcataacttccttcttcccattatttcagagtgttttttctttaaacgcagtacgctatacaccactacacctcttcctatatttacttgggcctgaatgaagcattcacagctgtcttccatttcttgaagtgtggttgctggctatcagctcctgccacaaaaagaacaaaacacctttgttcctcattcaattacatgaataaaccctggagaaataactacatatacttttccttactttggcccatctacataaatcaccatagcgtcatatttccagttttcagggattgcatgacaggctttgatacagtaaaatgcagttctgaatgatatttgggtactcatatgcagagcctattcataaacttttgaggggaaggggagggaaggaaaaaagagaaatcgcttaaactggggcatttccagaggaccagaaagtacaggggcctcacacagaaagaggagtctggagaggcaacaatgtcgaatggccttagcgtatgttttgaattttagggctctgcgccctactggcggtgaaatttaaagcaagcctgcctaccttggagggttaaaggattagttgaaataggtaagtgaccggcaccatttggtgctcaatatgtggtcgcttttggtatcatgtgcccctcaaattgtcatctattaaaagcaaatctgttattagttgattacaatatagatgtggatccaactgtaattaagtcaatcaaggcgaagaaagacccttcctagagagcaaaaccaacacactacatgttatcacctatgtttaaaaaaaataagttaaaacaaccgtttaagttggtttaagaaatggaacacaatcataaacctcataaagacatatggaaatcatccaaactgtacaacttcaaagaccatccctgtaatatttactagtcagtgattgaacagtgagggctactgaaatcaatttgcaagaaaatgttcacttgtgaagtgctgtttcactgtcttccaaatacgtttatttcagttttacttttccatagagacaactcacatttgaggactataacaagggcttatcagttgagggaatataacagagtgacattcaagtcttaaagagcaagaagagcaggagatatggtctctatgctttaaggggttttaggacaccccatgaccaagccggtttatgatctggagaaggggtaggcaggactggtactttacatgcacagcacaaggaggctgcagcttgcagcttcgtggaaaaagtgttgcttgttctcaggcatttctcagctcggaaagtgagtgtataccaattccatatataagtgcagagcaaggaaaggttaccttctattgagaccaccctgcattcaggcctcctctatttccaaaggtcatccagatgtgatataagcaccagggagaaaggaagagcgaagagaggaagcacacacatgtgtgcccacatgtacaagggctcacacaggcccttactagtcacactgtgtaacaacaatgtcccatctccaggatatttgtaaggaccgtagcatcttctataggtctgcagaaaaacatttagctgagctgataagcctgatcagacagagacagggaaccacggtgaaaagccaccatctggaatggacttcaaattagaggaacataggcaagaaataaacctgtaccaaacacagttctaaaaggaaagggaaacagtgtgtacaatttacaggagaatcccacatagaatgaatgagggcttcatggagctccccatcttctaaagaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttctcaccttcaacacacaaaccttttatttctaagcaatgcaaaagaactagaaaaacagatttagatttcacctttgcagtcttagtttcacttcaattgcaaatcagttctaagcaaaagaagtgagcacaagtggaaagaagaaaagaataaagggtgtgactaattcttaaaacgagaaaaatagtcttttaatcatttaatgctaaaaatgcttggcaacgtagccaaaaaaccttcagattctttggtaactatatgacgaaccaaatattcacttcacggcttgttattttctacctgtgatgaatccagagccccactgggacacatttaaccctccaaaatagataggaactatgaatatggactggatgaaactgtaagcacaaatctgcataactcatatctatcttgtaccttgaaggacaaaccacatttttgtctgtgatcaataccgattttacagcttcgtttcttactctgtgcctgccttctaaaacagtagagaattctcagtaactccatgagaagagcccacatttacctggaatatgcagacgatatagaaaaacacggtgtgctagggaggagggagtggaagggtgggtggcactgttttggtaattgtctcttttctgcatttcactctccacatcggaaatacactccccatataccatgaacaaccaaaagggaaattctgaaacctgttcacatgttaatgggtacatctttgtttggcctttctgagaacaacaatgttcaacatagatcacaagtctgtacgtacattaacacagagatcagcttcataaataatccttaaaacgctctttacatctttaaaaaatgttattgattttggccctgctggttccaaagcctggcatcagatatgcctctctgagcagtatttatacgaagatttcccctctccttcttctttctacaaaccatgataatctttttcccttttatttgaggcggtgataggaccctgatgcaaattaaaatataaagtcatcgactatgacaaaagaccccagcaacacctacttgtcaataataagaaattaaagcattactctactgagcacaaggctgacctaatttcctaccatacaatttaaattttctctcacctgctttagtttcaagtagtgtgcaaggttattataactgcctcagagctgttcctgctgtcagtgctggaataatcagacttattggaattgcttttttagtttcttaaaaacaaacattaaacacttataaaaagtaacaaatatctactgctgtggctgggaaaatggcagttgcctaattaaaataagatttcttctgccaccattgttatttggtactgaaaatattccaaacagttgcctttttaaaaaactatctgtccactacttcccagggagaaaactaatcgctatgcagcaatataaaaagggagcgttctcttgcgatttgcagaggattagagtttggtttcatatataatctggagcccattgatccacacacacaaatgatttccctttaatctgaggatcagactctttttctagaggaaccttggcatttgcgtgctgaattgttgaacttggcttgcattgctggaatactggcagggtgtggatggtaaaatatattttaaagtttctgctaccgtggggcaggggtttggaggggtgggcatcaatataagcatcagaaatccattctagttccccatttcttgttccctgggatatttaccattttattctgtctggctaaagccagggcaaagatgattgcctcggtggctgttccagctgttagttgtcctccgttttatttgcttttcaaggtttaactcctacccaccctcaactttggtcaaagcaatttcttttcagggtcgtgtccaatcggagatcaaacaatgatgactgaaaccaattccacggtgttcaagggtcagagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccccgaaagtggagcgccgccgccgccgccgcccaagctcacagctgaaagcactgcggaggagccggcgcgggcgggccggggagggggcgctgcgggcagacggggcggggccgtgtcgggctccgcccccacctagggacctgggaacccggacacccagagactgggcagttggggctttcaaaacggaaaggaaaaagaaaagagaaagaaagaaagaaagaaagaaagaaagaggatggggatttaaggtagacccaggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatagcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagtttgcagtatgatgatagaagttaactacacacaattatttcaagcttggaaatactcaaaagaagaagaaagccttcattagcacaagaattttctgcaaacttcacataacaccttagattagcatccaaagagcatcttacgataaactgttagtgatattttcactgcccttctttgtccatttattttgttggcttgcttttctttttattttctttcaaacatttgctttccactctcctttccgattgattcattccacttcggtctacagtttaaatgtggtcccctttttaaaatttatttcttaagggatgggggtctcactgtgttgcccaggctggtctcccaactcctgggctcaagcaatcctcccacttcagcctccaagtgcctgcgatgacaggtgcatgccaccatatccggcttcttttgaaataatccttttctgctcaacatttttccccctagaatgttttaggtggaagcacacccgttttgctttatctaatgctatagcatggcaaaagaggcaaaaataaagtatctggacaaaagcaaaagggaatgccaggattctttattacctttaacaaaccaaatataaaggtaaatgttatcactaaagatatgtgcatgtaagtatgatcggtattgctatttttaagcaaatatggcacttcttctggcattctggctcatacactgagattacttagtgttgccctttagcaattttaagctagtgagttgtggaggcagctgctattacggtctgaggggggcacactaagatttgctttggctgaagttgtcccttggtctaatagtatattctaggtctgctccgatccttggggaagagggattagtgtcctgtaatgaggaagtagtgccctttgcagtaaatcagagacaccaatctctgtgtcagtgtggcaaatcacttaactactgtttatgtttatttcaacgaaaagacagaagcctcagagcatggacatttgtaaatattacaaatcgataaactaaggatttgtaacacctggatagtaagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgcttagctattctgctatgctgccatgaagagacatggcttcttttcctgtgagaaaggtctgtgttttttctagtatactcatagacaatctcactgatggctcagagcagagaagagtaaatttgctagaaatagagataaagaagaaatgaaatgggatgaggtcaaagaaggcgacccagtacattttcccgtagccaaaactctggtctttgaaccacttaaactttgagggtatctttagagaataagggcatctctgacctaagggactgtgcaggatgcttccccattctcccatccatctctattctttgtccttctccattctgctctgtggcccaggaggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagctatggatttgcagtgtactgttggaagggtcttgggttcgaatgagcccatctagtggaggctgtgaagggccaacagctgaaactaggctgttcctaccttccacaaacacatctttttcctttctgggttgcatgtggtttcaatgttggcctgatgctagctgtgtaaaaatgcagagtggcataggaaaggacaaagacaaggaatggtttgaactgggtacttgcctggagggatggtcccgagagacttcaccaactcctagggttcagcttctctctatctatagtgcgccctaagttttagtataacctgcatcactttataaaaattcatttagagtataggtatcacttcaattaactcgaatacatattctatagtaaaatgtcagcatttgggtatacaataaagacataagaattccatattcctctttgcatagtacaagtactaaccatgaacagtgactcagacatctaacaaatgggttggtgtatggtgaatcattgctggttagggcaaatattatagcatactaattgaaatatatatataacaatccccctagatcaatctgaaaccaacatcttctggatgtaagaatatccagccaggtcacattaaccagcaaatgaagaggcctctaagttcagacacagagcacttcacacccacacaaaagcctatttttccaggccctgtctctttagggaggcagagtaagccagactcaggaaagttctctgtgagccagctgccatctaaaccagagatttcaccagacaggttccagataaagtcgagctctgcttcactctcacacagttttcttttaataagatttctcaaagcttcacagagccacctatatcaagccgaacatctaaaaagatgtgaattttagcatcttcactaaaataaagccatacttcattaacctcacaggccgacggttgcttcatgggaaagaatttggagtacctattagcctgccagctatagcgataacccatgtatatgacccacaccacctcctgctaaaaatggatcactggttaatgtggttcaagtatatctgactacagcattcctggtctaccttaacagctcaaacttgtaactatttgtctgcctttccccaccgattgtgccaaataagcggaatttcaaaactgggcagaaattcttacactctgcataatctctcttcctcttcagctacaaataaggctttgtattcgattagactcacagcaggtgaaaaccccaattagtgaattcattctgaggcctctaccttcctcccacacaacacatttttgtaaaaaaatcagggaagtctgcgtctcttctcaaatcagaagtaaattaaccctttgatctacccaagcaaactatttactgcatgaagacttttcactgcaaaatgggaggatgttgaaagattcctccttcttgactccataagggaggttacagaaaattctattttatcagactttattgttttcttcaaatccataaatactcacattttctgatcaatctagaaattacagtttttctttctacctgacactcacaatgctaatattatctaacaaaagattaatggacagtctactacaagagagaattaatttttagttatgttcttattttggtgtatttgaggtgagaaaaaaaattaaattttagtttaaacagtatgctttggccttaggaaaggcacagagtctatatttcatactttgtaaatatttatttgtcaaagaaaattcatcattggacaaggatagatgtttggttgaacattaaaaaaaatcaacgcagctttagttcttagagtgatttactcatactttgtcaattgcttctctggaaacaattcacaacctagttttatttatgaacatatgattaaaaaacagcagctttgtcttttttaattgttttagtcctgtcacttttcttgaaacaagtcgtaggacttacccacaagaaaatactgagcatatatcaagtagtaatgcagcttttagaagtagtcatctgttactgtcagaggttcatttcattttgagtctttttaattaaaatgcaaagttctacatacatgcctgcctaaattacccctttctgaaatactcaaatttcaaaaaaaaattttaaatgctaatgtaaccattgttaatactctagacttgcttcttgagatttggaaaaaagtaaacaaaggaattaccagtcaattaagcgaacaaggaagtcatcctaagttgaaacagataaggaaaatgtaataatcaaatgctacagatgaagacaccagcgtttttctttttttttttcctgagatgaatatctacaagaatcacgctttatcaaaagcagcttccttaatcttcagcaagcgtagctgtgtattatagcaaaggcatgaagatagaggggcagagtgtccagaccaattctaccccttagaggtgggtcacttaaccctttacaggcaagtcacttaaccacttggaagcttttgttaactcatctatagaatgtggataatactgccatattgtgggtcaaaatgacacaacggctctgacagcaatttgaaggctggggaatgctgtgttcatgcaaagcagcctgtcaggcaggtatgatttcttaaaagagaactcagtatgttcaggaatagttaggtatacagaaccaaataaattcactttaacattctgttttagattgtcgtgtgagggaaaatgagaggtctgagtttagtaaactgctcttctgtaaactgctctttagcagtttacaaaaggcacctttcctctttttgctttttacacttaagaaggaagcaagtaggaaaagtaagattttttttgtgtgtgtgcaagataaggcactagctgtagcctgagataggcataaaattcacagcgtttgctatcattcagtggggccgagattaaaatatgaatagtattcacgcatgttaaaaggtatatccatgttcatattctcagacagcagaaacctggagtagtcagagagcaagtgaatattgatttggtgggggacagtgagggagaaatatcccctagcttgatggagaaagtctcctggtggcaagccttgaacagccagcaagtggcaggaattccacacaaagacagggatccataaaaggggaaataagataaaatccagtttaaccaattaatgatctaccaatgtctgaatcttgtactccagctctggcttacttttgtcaaggcatgttttcaagatgaaaggaaaatacagatgcaaggaacttttatttatccacaaatttccaagaatgttttttatgtgctctatctagactaagtttctctattaaatattatcctatattaagttctttaaataacttcaaacatagtgtatttatggaacacttacatatgtatttgcttatcatttaaactcttctcattttttctttatggttggtaaaaactggggagtgtttggagaatgacatggaaatatataaaaatttcaacattgtaatccagtttttttttaagtgggatcccaaggaaatatggccttttccttaaggagcttatgatctaatgagagaagatagacccatatatagctaaacacagtatcagacagattataataattacagaaatagagagaaaaaaagcagcaaaaagggaaaggtgattagtttggcctcttgggattagagaatatgcacttcaattaaaaactaagtaggctttaatcacctagttagttcttaaatcaggttttgtgtgtgtgtgtgtgtgtgtgtgtgtgtgtgtgtgtgtgtgttctttttgctagaatatgaagagttgaaacaagtttcttacattgactctgtgagctaatcgctcatattaataatttactaaggtacagagtttttatgttaatatacagctgtgttacgacatcagtttaggctttttaggaattcaaaaatgtatttggccaatattggatttgatatcttgggaaggctaactggcagaaaatactactttccccattaggacatcaaagcacattattgagttaatatgaacaagaccttcacgtgggaattgaagtcctcacagcttgacctactctcatcccttagaaacaggtcgacaaagaattggaagcctctttgcatatgatggatagagaagaaaaaattggcaccacctgtacttttgaatatctttctttttaaaatagaattaaatttgaggtgggaagaaacaagggtggaaaagagggtagggatcagaatggaaatgtatgccaagtagatgatgacaacagcccagttaagagtggatgaaagtctgaactaagaaaggagcactgggaatttgtggagaggctgaattcatgacaggttatagaataaaatcaatgctacttttgagccaattgaatgtgagggctagaggaaaaggaaaagtgtaggatttttgataatggccctattagctgtgcattcatggattcatatttgtgtatatactatgtacatatttatactgtgcattgttctgtaaaggctttagggcaacttataacaatgtataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggccgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagaccctataacccagaaattctaccccttgatatagtcctcaaaggaatgcatacatatattcatcaaatggcatgtcttagaatgtttataacatcatttttttctaccaaatgcccatccacagtagagtatataatatactgcaggatattgacacaatgggatattacatagcaattagaatgaacaatccaccacttcatacaacagcatggatgaatccaggtttaaagaagtcagacacaaaagagtacatgctgtgcaatttcatttatataaaggacaagaacaggccagaatatttaatggtgttcaaaatcaagattgtggttacccttggaggacaggtaactatcagaagggcacacaaagggccttctaaaggttggtaatgttctgtttctttatttggatgctggttaaatgagtgtgttcagattgtgaaaattcactgaactgtataagtttaagccattttttctttttttttaattgacaaataaaaattgtatatctttatcatgtataacatgttttgaaatatgtatacactgtggaatggctaaaccaagctaagtaacatatgcattacctcatatacttatcatttcttatggtgataatacttaaatctactctcttagcaattttcaagactatactagattttcattacctatagtcaccatggtgtacaatagagctcttgaacttattcctcctaaccgaagtttcatatcctttaaccagcatctcccttattttctacatgcctaatatatttcagtaaaaaagtgttttaaaaggtgggtataatttggttgtggcctttgtagatgtcaaagcaaaagaaaaaatataaaaggaaatatgatcgattttattatttggattattgataaggaggaaagagtgtaagtgaaacaaaggaaaatccaagtctggaatgacttagattgaataaacagatctgcatgggatctaaggtgggagacactgcatggtgtcgactttcagaaaaatcccttcagcagttttcagtgcccctcgacataagccaggaacatgatgccgaggtacacctgagttgaggcaatcttatgggggccaaggcaaagtggtctaagaatgcagctttctgatgacctggcctgaggtggagataaaactaactacagtgtttttcaaactgcaggtcatgaacccttagtacgtcatgaaatctatatagtggatcattaccagtattgttcttaatgaaacagaaaagaatagaaaatatgacagtgtagaggttggagtggggaaaatgggttataaaactacctattgggtactatgctcacaatctgggtaacaggtcatgagccccacaccttagcatcatgcaatgttcccatgtaacaaacctgtacatgtacctcctgtatctaaaatagaagttgaaattaaaaaaaaaaaaaaaatatgaaagtgtactatttggtatgggtaagtaatgttttgtgaaacttttctttcaatcatacaagcatgaatagacagaaaaagatttacagatatagatgcgtgtgtgcgtgtgtgtgtgtaccaggatgacatataaaattaatttttatagtggattggcaaaaaagatgaaagctacaggctttactacataaagaaatggacaaactatacatgcccactggacaatcatgcatcattataatttctctagactaggatttggaaagaagttgacggaagacagtttgcagtcttattccctggtaagggctggaacattacaagagactggaggaggattaaaagattcaggagggggagcaagttggggaggcgttcatcaagtctgaagttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatcttgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaaattcctttcaaaagagtgaccagctttgaaagttaccagaaggaaacccacaatctttcttttttcagtatttaatcacagcagctttcattaaattcccagtactaataagtggttaactatgtttgtaatcagtatttcttatatttttaaaagcactagattatggatgctgtatgtctaccattggctgtgaagccacaaacagtttagcctagcaatgattactcacaaagcatgaattttaacagcacactccattttacctacatctaaattcagaagagaatttagtccacagaggaaccttcctgtaacttttcttgaatattttgtgatatcttgcaacatggccaaaagttctagccctctccttggtgtccagctcttgcagtgtgcctttgtatctcttcccaccaacaggtggagtctttccccactccttacatctgggatggccctatgacatgacttgcttcggctaatggacactaccaaacatgacacaagcagaaacctgagaagtttccatgtgaactagcctgaactagcatgttggatgatgagatacacacaaacctagttgcatctgttcctagatgacagcctgtcaaccatcagacatatgagtcaggtcacgatagcttatccagctgccagctgactacagatgcataagcatgcctggcaaacagtagtacaactggtcacaccacataaatggcccaatccacccatcaaatagtgagctaagtaaatggctggccattgtgttatagagtttatgaactattgttcaaatttggtctatggcctgcttctgtacagcctctcagctaagtatgactacatttttagagttgtaaaaagaaaaagaatgtgcaacaaagatgcaaagtgctccacaaagcctatagtgtttactatgttgtcctttacagaaaatgtttgctgacctcagtgttaagccagtaagttttggggttggtctgttatacagcaaaagtagctgttacacatctgctcccaagaaagaacgttagaaactaggcctttctcacaaattcagttagcacctagtcaatttatccttggtgcatgtcctccagttgcttgttaataagataatgctgaaatgaacagaaagaacaaatacacatataacctgggaagttattttagtaatatgcttctcaaaagtaagattttataaggggtatttagaaaaacaagtatacaatttttagcagtcttattcataatatcctcaagctggaaacaaaatcattatgctgaatataagagaccagatacatacaaaaatactgtatgattctatttatagaaaattcttgaaaatgcaaagtaatacacagtgagagaaagacgatcagtggttgcctagaatcaggggtgaaaggaaaaatgacctgcaaaggggcacaaggaggcttttgggggagtaagaacgttctgtcatttgactgcagtggtggtttcacaagtacacatctgccaaaaatcgctgaaccactttaaatggaggcagtttactgtgtgtaaatttttatttaataaagtttattttaaaatttttttaaaaaagcgtttgccctaaaatcaaatttaacattcaaaaatgcatacaactgcacaaagaatgaggtgcatcacacaggatgtttacataaatataggacagattcaggtcatgctgtcagttcccttctgattaattccgaaaatatcaaaacattagattcacaagtgaccttaaaggttaatgaattatatcctctcatccaatacagaaattgcctttaggggtgagacagtcatttcagtcttgaaaatctactgtacagggagtttaatgcttttcaaagtggcggattttattttttggagagctcgattacaaaagtttctttaatatttagttaaaatatgctttcccataacttccacatatctagctcaatccattctcagaataaaacaggaaaaaaataacaaaagagagttcacagtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgttgctcatcaacatcaaacttattggtttgtaaattttaaaattcatctctttactttttaaacgttaaaaaaatgttttctaatctccttatatgacatcaccaatcccttcccatgttttctctgagttttccactggcaactcttttcatgggaggaggagtgacttttagtggatactggataagaagaatgcactcctgttgagtagaatgagatcccatggcagcacttctaacaaattagacctagtctctgaacaaaaacaatatgagttaagatcgtccctaagattatctagaaaagaatcccgttcccataaagctgagtaacattttggtcagatttgtgtcattttaaaagccaaaatatttacctaaaaagcaagtgatttgaatgtctcagactaagttattttttactgatctatggccctcaaatgagttgatgaccttcagtagagaaatggttctttatttctgatttgtgagagtcatgcgacagcagtggatgggttaagaaggttagaggaaatttgttacattgctttttagctgttgttttttagtttggtgaacaaacgagataacatagctagtgccttttagtcataaagcaaaaataaaactacagtgttttctaatattgtaccctaaacctatgcaaatctccaatttacatcacccacaagccttctatatttttgcagattttaactagagctaaataataggcatatatttatacttaattgtaatcaaatgtaatgacgtgtgcaaaacaggctttgctcaaagtgctctttatagatgaaatatgattattgaacttgacagtagatcattcattggagggaaaagtgattaatcacttctctgtgcctctaccttcctaccctttgatgacaccggttatatttcaagattctcaatgctataaatgaacactttactgaagaagcatctttatccaatgcaaaatgaaatgtgttgcctaagactaataaagtcatttacaagtttcaatgaggagcaaatataaatagtaaaaaaaaaaaaatccattatttaacagcagtaaatccagtatgttttggtaaaacagttttcagagaagctctacttacgttagcttttcctaaaccttgctgcaaagtgtcagttctttctaatatacaatcaaaggaattttgtgttgggaagaacatttctcatctttgtaaaggacatttagaggagagatagggaaaaacaaagatcatgcatgaggattatgtgtgagggtatggattgactggatttcaatcattattttaaaaggcttatctaaaataaggtgttctttgaaccaagtggagtctgatttccaattttagaatgtttccacatttaacactgacattcattatcctgaaaatgaaggcagatacacataatatctatatgtattttaaataaaattggttcaataatttttctcaaatttcataactttttctatgaatcaatgtgtcaactcattttttcaacttttcaaactgaaagaaattccattgatctttaataataatgaatttaatcaaatattaggcaaaattctttagtgaaagaactcagagaatttgattaggtgcctaaaatgtcatttttaacataaaaattaacaaaagcacaaaaatatttccattttatcttaaaaattaacatgctatgttataatacaaaaaaagccctcccctaccccagaatcctgcataagaatgtgaatggttatgtttgtttgcgcagatggggtttatatttatgtgtttcttttccatctagcaaatttaaatctaggatacaaatgtagtcattatcgtgtctgaattggtgaagaaagcccaaaatatggccaaatctacttgccccctaccttaaattatgagtttttaaaaatatattttcaggttagaatatttctcttttttctgagtttagctctctgaagcaagtgctatcaattcatgaaaatattaattataaaagttttatactgacgatttggtcctcataactgcccctgcttggtctatatttcaccttcatcatgatttattttctaatatgagattaatgttaaggaccataaacgttatgttgagaatcataaaacatgtgtgctaaattttgggaacagctcacgtatacagagaaagaagaaaataaaaagatctagcagataaagaaaatactgtttttggtcccatttagaaatgttattaacggcaatgctgtaacaccttcctttccaacacaatggcaagccatgggatgaacaagctcaagacatgtgtggtagcataccaattaagcaaacagttgactcatggatgcattactagcaatacttctgctccaacccagatacagatgctcttcaacttacaatgaggttatgtaccaataaactcatcataagttgaaaatattctaagtcaaaaatgcatttaacatacctaatctactcaacatcatagctcagcctagcctaccttaaacttactcagaacacttacgttagcctacagttgggcaaaatcatctaacacaaagcctattttatactaaagcattgaatagctcatgtaatttattgaatactgtactgaaagtgaaaaacagaggggttgtgtggatacctgaagtatggtttctactgaatgtgtatcacttttgcagcattatcaagtaaaaaaatcctaaatccaaccattgtaagtcagggatcatctatgtttgattgacaggccccagcaagcatccgcaaatgaggaaagaatagagagaggagaaagaaagtactagatgaagacaaagaatccttggtgataggatcttcagacagagaggctctagggacttgaaacctggaagttcagcataggcatttagtatatgttgagccttagggaactcatttatcaatttgatatcactcctttgtatcactgccatggtgaatgatcagaaaggaaacacaaactccttctttaagaactgcaataacgaactgtttcttcttcttcttcttcttcttcttcttcttcttcttcttcttcttcttttttttggcagaggtggggtgtctcgctaccttgactaggcaggtcttgaactgctggcctcaagcaatgctcccacctcagcctcccaaagtgttcggataaccggcattagccacctcctctggccaagaactgtttcttttgattaaattttgttcttcctactccaactttccttaaagataatgcttccttaaagataaatctaatggcttaaacacacacacacacacacacacacacacacacacacacccacacccacacacgcaaagtatgtattcttttttatcactctcctcctgtccctcttacaccttgctttggaactgactggtgccttgcatctccagtcatttatcacacatcgtgtagaccgagattttcgatattaaaacattcagtctgccaatgtacgtaggaagcaccctcaatgtctttaaaatgctattctgaaacatttaaagagggccatctgcaataagaatgatcattagatgatgataaacagtactgggtcacagatggagaaagtaatagtatttgagagccattttcatgttaatgttatagattacatattaaagaaatgtgccagtaatgaagcaaacaacaaagagggccattggagaagaacagttatgctattgaaagcaatgatataataagcagaatggccccaagccatctgtttttaaagcttaccatatttaggctgttaggaccattccactgtccatggaggtgccattctgagataacagggaagtgggcaaaactaatacaaattaaaccattgtcagtaatttttatcataaattgatttttccctctacaaacatatctaatgctcccaaatctgactatttaaaaaaatgtttcttagtccttaatgtatgcatatcacaactctgaagacactagaagtatagactatagggttcacagtcttaaaatgaggattttagatattgattttcattaacgctctcctctaaaatagtttcagtcttttgtgcttccaaaattagaactttatccttaggttttgcaatttggatcttgtaaggagataaagagggaagaaaaaaagtttgtgattcaggggtgtaataaactccagctggcatatcatgagcctagttatgtcaaaataaataaatgatcaaaaatcttattaaaaaacaaaaacatactggaactttggaaaataaatttaggtaaaacaagtgaaatgaaaataggaagaatattaatattcagaagctgattgattatgtattagccagatcaaagcctctgggtgataatgagccactgaacagggattaccacctgtcctgttcaactagcagctggacttaccaagaacagctggacaagaacacttatataaaattagcctttagaagcataagctaagttttttcacctgcttctcagatcggcatctttatcactcatgccagaagtaaaaagcttttcatattttgatgctgtttttgccttcaggaaagcacagctttgaacaccaatattcccagccgcttgctaccaagtaatggaggttgtcttctagacctaataagctaagatgtcagatgcacttggtttttcctgtcactggctcatcttgtgctcttatgtttaagccactacaaattctttcaaaagaaagtagaaatataaattataaagaaagattttaatgtcatttattcctatattcttactcacgaatcttcattttattgaaacctatttaaaatgacaatatatatgcacacttgggaagtttatcagataattttgatataagacgataggttaaaaataaggcatatgacaatctttatttggtgctctgaattgtattaaagtcaccagtctgttttaagagttatcatggaacaagtgaatgagtaaatataatagtctacttccttccttctcaaagtgtggttggtccacagattagcagcattagcatcacctgttagaaatgcagaacatcatgtctcattttagacccactggctcataatctggattttaacaagattcccagacaatttgtatgcacattaaaatttgagaagcaatgttcctgtgagcttaatcagatcctctctttctttctacacgttttttctttcttttttttgagacagagtctcactctgttaccgaggcttaccaaagctggagtgcagcggcgtgatctcggctcactgcaacctccgcctcccatgttcaagtgattctcataactcagcctgggattacagctgggattacaggcatgtgccgccatgcccggctaagttttgtatttttagtagagacaggtttcgccatgttggccaggctggtctaaacctcctgggattaagcgatctgccctcctcggcctcccaaagcctgttgggattacaggcttaagccaccatgcctgtccctgtttctccactttgtattggaatgcttttatttgaatatgatgttttagtacaaaccacagcctaggaggcctgggttttaaagtaactaatattgatggctactatgcctgctatgtataagtgtaacgtacacaggttgaacataaagaggaggtttcacataagaatattataggaggtatcgtgaccttagaacatctgtacatctgtataatggaacctatttctttcattagaccccaatctgaaaatttctctgtctgccaaaagaaacagagaatccttctactcccacaacgcaagagaggaaaagaaaaacacattctaagtggcaagtaactggcagcaggcactttgtataaataccaaaagtagcacgcgttagcacattgatgacgactccttatttcaaacctgcacttggaacaactgcagatagagactaataattcttgtcaatgtgtattaaaagctctgacaggagaaaacaacttgtgcagctcaagattgaaagaaagcacaatgaggagattcaattaaaactggatgatgggagaagaaagcataatctataggaggacaggtataaatcctctttttctgatttgtccagtctctactaaaagagattgaaagctgatatcagaatcctttgccatgctagttataggcatttatttatttaggtatttatttacattttttaattatatgcttttatgtataatcatgcttcaattacgtgtacagcaaatggtaaatatttctcatttatataacatgaggtcagtcattcctaatgaatcttttctggtgccttaaaacctcccaattaaagactccttcaaatactccagtcaaagacaccaattaaggattcctcttaatagataaatatccaaaccaggctgtcctcaaaatgataaccagtgtcaagattccagtgttcaaaaaagacagatcagtaagcagtctcccaagccaattgactgtgtgccaattccacccttggttgaagggagagaaaatgattgcttcagagcagaagcaacggtggaagcagaagaaacagacaaaaaaaaagtgggggcgggagaggagagagggttaagatgcaatgggacagtaagatgttgtggagtagtgtgaacccggaaatcaattgggaaatagaacatcaaaagaacacgccagtatttttgggtttttgtttgctcctctctaaagaaaaaattctgtctaccttagacaagcacttcaccagttaagtctgtgggaagcatctacttagggcaggtaggccaattggtatcttcaatctttttcaaaggcttaaatttaggcacatccaggagtaagaaagtccttcccttcactacgtgcaagataaagctggtcaatcgttgagccccagctgactaaattttatgtcaggtaaaggaagcaatgtgggtatgttcccgacaatttatcagataaccaagtacaatcccattaagataacggctatagtccttgaattgaagacttatagggccatgtagaggtggcttttgtctaaaaaggacaaaggaactgaataatgtggtcagttctctgccacagagacatgaagacgaaccaagagattttatgtgtgtttgctcattttgtcagaaacaacaggtgacttaattacatagacttcagttcaaaatgctaagaataactgacaactgacaactttggaggacagattcctaccaaagtaatcacattagtgctgctctcagtcattcaattagtttatgattttcaataaatgaataatcatataatagaataatccaaaatcttatttttaggttttttgtatatataactagtattaaccctctctgtcaacatttttgctttccttaaagaaatataagaacataaaattttagtctaggtgtggcggctcacatctgtaatcctggcacgttgggaggtcgaggcgggtggatcatctaaggccaggagtttgagaccaacctggccaacatggtgaaactctatctctataaaaatacaaaaattagctgggcatgatggcgggtgcctgtaatcccagccactcgagaggctgaggcgggagaatcacttgaacccagcaggtggaggttgcagtccactgcactccagcctgggtgacagagcaaaaaaaaaaaaaataaaaaataaaataaaatccatctcaaaaaaaaaaaaatcaaaatttaacactctgatataccattataattatttattgtaattgacaacgcaaatacaattttgcttatttggttgttctgttcgttgtaaatggagtacaaattctaatttttgttagctctaaatcaaattttaaaagtaaacagaatgtttaaagttatgttttatttgcttaacataacacttaaaacaagatgaacagcaaaatataagaccaggcctgaatccactgagctgtctcctctatgaacttcataaggcatcttacatagagtaagcagacagacttccagacttacagttagaaaatgctggtttgaacctgggctctaacactgtgatactgggggaaaaaaaatcacataatgtattgaaataataagtattgttgactataaaatggaaatctatcctacatattttacgatattcttttaaaattaaatgaagtaatatatgcaactttatgtaagtaggtactttataaactagaaaattaaataactgctaatttattttttagtttagtaaagtctacaaaaacatcacttaactatatatcaaatatagtcacttaggttattattctgtttattattattattattattattattattattattatttgagacagagtctcactctgtcgcccaggctggagtgcagtggcatgatctctgctcactgcaacctccgcctcctgggttcaagcaattctcatgcctcagcctcccgagtagctgggattacaggtgcacgccaccatgcctggctgatttttatatttttagtagagatggggtttagccatgttggccaggctggtcttgaactcctggcatcaagcaatctacccgcctcggcctcccaaagtgctaggactacaggcatgagccaccatgcccagtcttatttactattattttattattttaaaaatcctaatttcctgaatttttcctggaaatgcagataagtaggtaatgcatttggtgatggtagtattaatagtaatgagctaatacctcatcctgaaaatagctcaaagattaccttaagtacatattgactccctaaatatgtgaataacaaatataattgtcacataaatacaattatgcaatcatgtcaactaaatacaatttgcaaatattttgattgtttaaggttgtattttcagtgtactatttaacagttatacatatcttattagtctacaagactttagactacaaggacagtagtcttcatggtccctacctgcctagtatggcagctatgattatttgctgaatgaataaaaataatactctaaaaagtgtgttcatatgaataatttttcattcatgatgcctctatcctaagcatcttatatataggatcttaatccacagcaatctgaattccctgcaaaaattaaaagaagtctgatattccttcactctatataaccttgaaaagaaacaaggcaaaagcaaacaaacaaacaaacaaaaaatccagtaacttgaaatgagactaccaggtttgctttaggcaaggtaggctatgaactaagcaattttaaagcttggagtgaggacaatttaagtcaaatcagttttttggaatgtccacaagacactaagtatatcatgaaaataacatttaaggaaaaataagtacacaaacatgagagtaaatgaaaatattctagttatttgcagacttggatgtcttaaaatctaaacttttttaatatggtaaattaaatgacaaattcatatttaagtgtaaattaaataaatgtcaactataaatgaattatattatttgaaaatggaattatatctgtgctattacgcttttcattagttgaaagtacaagttgcaaactagcagactttgggctaaatttggcatgcacaaatgttttgattagcccacacagtttttttttttttaatctgaattactcaacatttaaatattcagagatattttacagaataatccaaccttctgacttctcatttaaaaggaatgatttgtccatgctgggctcctattcttgcatgacaataactttccggagccaccattctataacggcacatgtattctatagtccctaccagctcccattaacttacgcttcgctagccttgcccagttacagtagcaggctagcccctctgttggcatttcagtttgcaacctctggtttagaccagcaaaggctgaccatagcaatcttagagtatcttagtgtgctttaagtcaactgacactgacaaaagaagaaatagaaaattggaatagccctgtactatttaagaaataaacactgtaattataaattttcccactaggaaaattccaaggccaaatcatatcactggcagaaataccaatcttaaagaaactcttccagagactagaagaggcaatgcttccctacttgcctttatgaaaccagaataatccacataccaaaccttgacaagaatggcagaccaatataactaataaacacagatgcaataactctaaaggaaatactatcaaatgaattctaaatgaatgtttagcatcaagtactgggccaactagatatccatattatgaaaaataaaactcaatctctatctcacatattacacaaaaggtcaattccaggtgtactatatatctaaatggaaaagttaaaaaatagtaagtttctagaagataataaaagaggatacattcattatcttgtattaggaaagatttcttaaagaggacacaaaagaattaaccctaaggaaaaatttacatattggactatattaaagttaagaactatcaatcaaaaaaacaatttaattaaaaggaaagctataaaatgggagaagatatttgcaacacatacaatttacaaagggctacaaactagaatatgtaaaaaaaactcctacagatcaataagaaaaagaaggatgaatcaataaaaaaaataggcaagagactgaatagatacttcacacaacaggatatccaaaatggtcaataaatacacgtaaaaatattcaacctcataagtaatcagacaattgcaaattaaaataacaatgagattctactcacacactcactgcaatggcgaaaattttaaagactaacaagtatcaagtattgttgagatgtggagctactagaactttcatatactgctaatgatggtgtaaactggtacaaccactttggaaaaccaggagtatctactaaagctcagcatatgcctaccctcaacataggcaattttactgcaaagtatataccaaacacagttgtacacacgtgtgtgccaaaaaacgcattaaagaatgttcataggaggccttattcataatgtcttcaaactggaaagaaccaaaatgttccccaacaatagaatggataaattatagtatacattttaaatgggatatcaaattgcaatgaaaatgtatgacagattcatgcaacaacatgagttaatctcataaacacaatgttgagtcctagatacaaaaggttatatactgtacaattccatttttatagagttcaaataaacaggcaaaactcaaccatagtgttataaggcagagtagcagttacctttaagatgagggaggaatagtgattgggagagggaatgtgggtgaggtagggtggtgatttctgaggtagtggttatattctatgtttctcctcaagcttttcattttgaaaattttaaaccaattgaaatgttaaaagaacacccataaaccattcacttagactccccaactgttaacataatattcgctttctctctctctctctcaccactcccccaacccggtgtgtgtgtgtgtgtgtgtgtgtgtgtgtagtctggtttagtgtgtgtgtgtgtgtgtgtgtgtgtgtgtgtgtgtgtgtgtaatctggtttagggctactgataatgttttatttactgtcctagatggcgaacataggtgtattcattttgtgataattgcattgagctgaacatgtttcatctgtatactttctgaatgtgggtcattcttcaagcaaaaaaaagagattcaatcaacttattttttgaaaacgccctcgaaaacaatgcattcaatacaacacattactgaaatactatgggtaatgattttttgttgttgctgtttagacagcgttagggaaaaactacaccatattttctgatctatttattgaacaaggatacctcaatgtggcagtgaggcttgggttaaaattgttatgtcacagcctcacctgctggttgttttccgtagccatactctacacttgcttctgtattatatggagataagaaatctccccatacttgctgcttttaaaatgtttttaagacaaggttgttcagggcacagaatgagacacagagcggggctatgggggttactgccagtgcagggtagatattaaattgtcctatcagttaatcgactaagtaaaacacagttctgactccccctgccaaacaaatggttaaacgagcaagctaaagaaaggacataataggccaggtgtggtggctcacgcctgtaatcccagcactttgggatgccaaggcaggaggatcgcttgagccaaggagttcgaggtcagcctgggcaacatggtgagactaccccctgctgccatctctacgaaaagaaaatacaaaaaaaaggaaagcacataatattttccaaagcttagataaaaagtaggatagatgacctgaggatgaaaaagaaacataattatagaagtttttcctttgtgttgtttaccaacagaaatgaattaacaatacggcacaacagaacaaacacacagcttagacaaaagcaacttagtcccagattctagtccatagcaaatgatctaagatagatccagacatctcaaagcctcagtttccaagtctgtgggaataagaataatcatatatgatactcaaacattccatgggatattgtaagaatcaagtgtgataatagaggtgaaagtgttcgataaagtgctatacaaacacatggggctatctataagttatctacctgaatatatcctctacccgaacatccatggcattagaaagaccatgggatcaggtatcagaagatctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatggcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctcggctcactgcaagctccagccccgggttcacgccattctcctgcctcagcctcccgagtatctgggactacaggcgtccaccaccacacctggctaattttttgtatttttagtagagactgggtttcaccgtgttagccaggatgatctcgatctcccgaccttgtgatccgcccacctcggcctcacaaagtgctgggattacaggtgtgagccaccgcgcccggccgtaggtttgcttttaatatactttcagaatgtgtgtgttagcatttttttttcatataacagctttattgacatttagtatacataccatacgattcgcccatttaaggtgtacaattcaatatttttgtttgtttgtttgttgagactcgctctgtcacccaggctagagtgcaatggcatgatcttggctcactgcaacctccacctcccaagtccaagcgattctcctgcctcagcctcccaagtagctgggattacaagcgctcgctatgaacgcctggctaatgtttgtatttttagtagagatggggtttcaccatgttggtcaggctggtctcgaactcctgacatcaagtgatctgcccgccttggcctcccaaagtgcttgcattacaggcgtagccaccacacccggccttgacttagtactttgtattggtgatatatggaattgatttcaacattttttgccattctagggtgaaagtgctacaataaattaaaaccttataccagccaaagaagaggcagctctcaattgtgaatgttgagaatatacttacaagaaaaatttaactttggtgatgtaatagcttcatttgcattacctaaagcttgaagtcaaaagctaaagtattaagcgtacagaagcatggactctatgaaagaaacaatccaaaaagtgacttttttttttttttttttttacaatgggagacattaagaactttggtaactaactcttcaatatgtccctgatgacagaccaaggatttatgaccagaagaagctattaagaaaatcttcctgaggtgttaaacattgaacatggattattcatgaaaagataggaaatctcttttctgaatcagaagagagtagattcttgttgatctggagtggtttccatttacttctgccatgggaataaactgaatgattgctctataattgaatagtcttttaaaccatactctataaattctataactatcttataagtatggtatctaaaaataagactgatagcttgaggactcatagttgtgaaaaactattgaaagtatcattgaaaaggctcaacgttttctattttcaaaaagctaatggtaagctattttttaatccaatggatgatggtttcagtaaaggcaattttgtcacaaagatttttatgggaatctgcagtatgtagaaagattctcctgaggaaacgtgcttactgctccctttacagtaggtcaagagtctctgatttctagcacagaactattttctaggcatcttttaaaaccctacctaaaggcagatgagtgggccctaatgttacaaagaactactctgagctaagtgaaagaattacagttggacaagtgggaacaaataacatggttcatagctgcaattactgctcacatgaattttacttataatattcctgatgccaagtcataaatgctctcaacatctcatctgactggtagaactttcttactggcatgagattcctaggatttttgttatcctttagcttttatattctacaccatggattggtaccactctaaattggatcaaattttggaacaatagacatcaagtaagatgtttctaaacaattagctattcttagtcatttgaatttctatgtcataacacatgctttggcatttatagagtaacctactcttaagaaaaaataatctcttctaaagcccgtatttaattttacaattgtgtatacacaattgtgtatgtatatagtaagcatggtcactgacaaatgctaatgtctcagccagggaaattgattgacaggaaactggagaagagcccctgaaaactcaagtctgtaattatatactacatctgtgagtggactacctgtatcagtttatacaccatcttccaaatcccaaagtttagtggtaaactaaaccttgtctgatgccctgtatggtctaaaaaagaggagaggggttgaaaagagcaagaggtagagtagagatgcaatctgaagaccgctattcccagagtgatagagcaagtgactagtagtgaatgtgagggacctcctgtttgtgtggtttgtctgtcatataaatcttgaaacttacatagatttttataagggaaaacatcagcatatcgagaagaaagatataatgtttaaggggatcattgccactggactttatttagattttggcttgcacattctatcagaatgaaaagccaacattgaaatcttttcatcatataagagaaaaaggaagatagtaggtgctggtatcacaaggctagaagcggttttcatagtagtcagccattaatctttcccttatgagtttgagttatcctaacattgtgcatattataaatacagacacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgatagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaattagaataataaggaatgctgatgcacaaaatacaggtttgtgaatcactactgagcctacactgtcaaaattaattactacggatgaggatttggtacttttctttttttaaagaaagctttagagtagaacagttgtattttgacttaaaaggaattgaaaactctctcttttaaatttgaaggtaaaaaaaaagcacatctccctaacagtacacataaaaactaactgcaaagagcaaaacaaaagttggaacctagggtcagatatttctgagtaagaactgaagaaaagtcaactaattgttcgtttagaaaatagggtaggctgggtgtgatggctcacgcctgtaatcccagcactttgggacgctgaggtgggtggatcatgaggtcaagagatcaagaccatcctggccaaattggtgaaaccctgtctctactaaaaatacaaaaattagctgggtatggtggcatgcaactgtagtcccagctacttgggaggctgaggcaggagaatcgcttgaacctgggaggtggaggttgcagtgagccgagatcgcaccactgcactccagcctggtgacagaggaagactccgtcttaaaaaaaaaaaaaaaaaaaaaaaaggatgggggggatgatacaggtaagctatttgaatatttcaaaaaataactatctgaggaaaaagtgctgcatatggtaaataccttgatattagatatatttggatttatgtgtccacacaaggaaacagagaacatttaaacaactgggaatatacaagaggaaacaaaaataattctattctctccaatggtaaaagattgagttaccttaaaataaagatttttttttcacctgcacaaattttaaagcaacatctgaagatgagttggaaagagtatgttccatatttaaatttgtttccacatggtttgctgcaaagactgcgtcggttgattttattttcgatgctctacatttccattctgggtcaccccctattcagtgaaatcattttatgtcattggtgcagccaacaaaaaaccgatggtgtatttgctggatatggaaggtgcaacacgcatttttcatgttacaaaaatcttcctacagaagttccaaacctgttggatttggcaagatatgatgaagggagatgataccaatactttatatagtttctagagtaatccttgaaagacttgtattctgggtcttcagtcaagtaatattatagggtctgtagaactatcaaattacctgtgttattgaggtgaaaggtgaatttgtggtggccttatttgtctacctgatattaagccaagggtactgcacttgggaagacagctgacatctgccgtcaaaaatgtaaagtaggaagttagagtatcttcgtatttaggtttaaacttgcattgctcaagaaaaggtaggatacaaagttatataaacaatatcttttgtattttatcagcagattttaaaaaactggaagaagacattaccaacatgttcattgcagttgtctaggtggtgatgggcacttaaatatttttaatctttttctatgttttccacagtgaacatttattatttttgttatgacacggaaaacttacaaatattaatttctaaaatgtattgctcagacttccagtttcaacttggagatggagatggagagctgcaaagaggttgctcccatacttgtagcaagaaaactgctggacagataaattaatgacttttcatcagtccatcagagaaatgacattatagaacaacctgaaatctggagagagattggcctttagccagaagcagtgcctgagcatttggatccctggagcagatgccatataaactagtagggagattaaattgttgggggacatgtgggagctagcctgagagtgtgaagatcctgggggctactgccataggtggagtcccaaccttttgcaagcttcttccttcaggaactgtaccttgccttcacaaggaggatgcgaagaatctggagaaagcctccccaacaccctctgtgttgctgattggggaagggtcacagtagctagtcaccatgaatctgcttatacccttctcttcagaggaaaagacatcacattgctataaagaactacccgtgactgggtagtttataaagcaaagaggtttaattgactcacagttctgcaggctgtataggaggcatggctggggagccctcaggaagcttaaaatcatggcagaaggcaaaggggaagcaagcacatcttcacacagcagcaggatagacacagtgaaggggaaagtcctacatactctcaaataactagatctcttgagaactcactcactatcacaagtacagcaacggagaaatctgcccccatgattcattcacctcccatcaggcccctcctccaacatgtggggattacaatttgacatgacatttgggtggagacacagaaccaaaccatatcaggcactgaggaaataccactgcattttaggggaagggaacaccagatctcatctatgtgtggttttgttttgttctttttttgtttgtttttttttgtttgtttgttgttgttgttgtttttcagccttatgcaggagaaagggccttggggccatagactgagaacactggtggatatccactgcagctccaggaagggaatgggaggttgaagttactctacctctggaggaagggaaagaaataattgtaaagaccacatccccaagacccaggccaactgtgtattaattcaaacattagagaatgcctctgcccgacactcaaccactacactaacaagcttccaatgaggaaacaaagttaccagaggaatttgaagtctctggtggccacagcagcaacaaaactcaacaatgacaaccaaagcaactaccaacatcaaacacagcccaattcccagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataattaatattttaaagactcttgagggaaaagaaagacaatatgcaagattagatagaaaatatgtaagattagaagacaatatgcaagattagatttgattcactcttatagtttccagctctatatttcagtatatttcagtatagagctggaaactataagtgaatcaaatggaaatgctagaaattaaaagcagtaacagaaaagaaaaataccttagatgggctcatctgtagattcaacaaagacaaggaaagaaccagtgaacttgaatatagggtaacagaaattatacaaactgaaaagcagggggaaaagtaaaaaaaaaaatgcaattgcaatacaaacacagtaggttttcagtattaagtagggctctaggaaacagctatttttcagattaagtaacagtttggtgcaattatgctgatcaagcataaagaactataaattaaagacttcactcaaagaagacctctgacaagcaaccaagttgctacaaagtatttaaaaagctagtgaccaaccagttgtttacagtgatatattttgcaatatttgatttagattaagagttctaggaaatacaaaaagatccacagtacaaaaaaacaaatgtgttccttctaatgctcagaattaacattttatctttgctcaaagcttcttttgaaataaaatacaccattcaagatgaaattccgatcctctctgatgccccctctcccatactacaactagtatcataactttggtgtttatctttccaggcttttcattttaatttaatttttaaaaattagtcttttttatttttagtattgcacctgtacttcaaaaagcaaaacactttaaaaagtgaccttccagaatttagcatcagaatctcattcacactcatggtttcagttactagctatatacaagtaatatgtaaattagtgactccaacccagatgcgcctccttctttctttaggtgcacactatctgtctatttacagtgctttttggatgtcaccaatcatttgaaatccaaacatttacaatcaaattgccaccctaaatctgatctttctttagagttccctaactcactgtaaagaattaccaactgtgcattgcccagaaatctaggtgtgattccttgacatgttttgctttctctttgcgcccttcctcctatgatatctatcctcaaatcttaaggatttttacctcctaaaaatctctcaaatctatgcctttctcaccatatccaaactatcatcatcttggtccaaatcccatcttctctcacctggctttcatcagtaaccttcaaacgtttgtattcataggctcctcatccaattcatttgcatcagccagaggactttttgagttttctcctcacctcctccagccctagtcatgctgtccttttaatcccttgtattgacaagttccctcctgctaaattgccttgacacatgactctctctctctttttgtgttaatatgtattcattcttagtgtcatttccattatctattccctggctatactttggaggtatcatgcatgttgctcaccaaatgtaccctttacatctagcaatgtatctggtgcacatattctgataaataaacatctattgacaaatgaatcaatgaatgaatcagtcaagagtatatctttagataaatgtttttcttaggtaaggagaatcaaaccatttaagtgcattagaattaaaaagcattttagcatttgtgagaaattctgaaagcagtaacaagtagcagtttctacttttacaaatataactgaggttaaacaaaatatacccagtaaaaaataacttcttactaacttggctaattatgggtgaaattggtcatttatgctgtgacaatgatcagagacacccttggaaactatgcttctttaaggaataatgatgccattttatagttttatgctttcattttagcatttgagaacagttcacaaacacactaattaatctctgcaatgatattgtactcctatattacaggccaattcaagaaagtaaatcacacagatttcaaaagcataggaaaaatttttagatgcctaagaatatactctttacctcctgtaccttgttatatatgtctttatagtcttagatagatctttaataaagaattgaaacagaaacagagatccttattttagctcctttatgtaaatcatatgcatatttatgacttagttcctttattttgtgagcattttatatatatatatatataatataaaatataaaatttacaatagctggtacaatagcccccaataaatatagtttgcttaattaatgtaatgaattcattaatacatttgccttttgcaaaacagaaactagctcgatattgtgaagtcccagggtttcctccctcatcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacgtatccattacctcaccaacatatcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaagccgaggagacacctggattgccctctttctgtccctcctgacctccaatgcatcagcaagacctgtgattgtttctaaaccatattccctgattccaaccacctcttgtgatctccactgctacctttatctagatcttatctaacaccagtgcttcccacactactatctggtctccctgcttccactctggctcttcatatttcctcacccctaactcacgtgttccaccaaatgcattctccacacagcagccaattatgtcttgccaatctagtctactttcaaactgcattataacaaagcaccagcaaaaaaccaaacacctccaacaaacttcacctaggctttgataaaggtcaaggtttgcatttcaaaaattttcctctttggagttgcagaaaagaaatattcagggctgaatttcagcaaccttcttattagtatttacaaactagttatacttggctaatttgtaacaccattgaaagtgaggtttggcaataagtgtactttacattgtgaacattaaaaacaaacaagacatattgtctggcaaaatattttttgctgttgttgttgttgtttgaaattgtatatatttgaactaccttaaaagataatcagaggaagtcccaggtagctggacatttaaaagtttgtcttttttctttgaaaataatacatgaaacttggaaattgggaaaacatatttactataatattcaagtcaaagaatggagaattgcccaattagggtttatataaaattagttttcaaatttaaaaaaaaatccagactaaattatatctttataatgtataacccttaagagttgtttatatatcttctggttggttcataagcggaagagctgctgcactgttcagtatcatttccccatatttcactgagaaatgaagttcagagagtaatgaaattatgtaagggcatacatattattttataacatctatagaatttacatctttggactctcatgcctaaatttaatttcctattggtttattatttcatctccgcctgacttctgtgttttatatcccaaattaaatttcccacagatttccttaggtatattattactctataaaatggcaataatctgttcactatagccaacactattgcttaatcatctttgtaattattttatcatttctctattttttgttttgtaatacacatatttaggaaaggacaagtaaaccaaattcctaaattgacaaagtactacgtataaattaaacagaagttggtacagtcaagcatgaatctctgaataaagccaccaactttgagaagtgtttccaacaacctcaagtactttttttcttcactccactctttataaaacttggtgataaaggtgttcacgatggaactaaaagttatttggattaaaatattgctggtctgggattcatgcttccccaagcaatattgatttgctaggggatttttttctgttcttattcagtctttttaatttaaaatattttatatttatgttgctttttttctgatgttttactgaattaattctatagtttccaggccacggcaactactgtaagggtatggcccatactgtcagattatattattcagtgttcctctgctcatctcagatccttcagaggctgctatttttacacgttctattacacatcaggacttttaggttttaattttaaagaagtgttccacatttgagccctctgatataccctgagttatagttacagttacagttacagtcagataacttctcagaaaaaatgactttgtagtttgaacatgttttctccatccctccatgttaattttttccagttcacaagtgaaaacaagattagtatgctctgaatctaccagtcagtatgtttcatcttccacctcaacattgaactgcttcctttcaccttatacatctttttaaacaatacattcaaggacttggaatataattggcaattttgttgatgatgaatgaggctgagcaatataatgatgccttttgctactctatagtgctttcagtaaaaagaaatggcttgaggactaagagtatatgaaatatgagtgagagaaaaagctctaaggtccttgataataaagcacctttaaaacgatatcatgagatgatgtttctccctaccaaaaaaaccccaaaaaactatgtgtgaaaaaaaaatcggctctcttgtatcaacatcgggcattcatgcaattaaaatcttttgtatgtgtctggtaatgatatctaatatttaacagagaaaggcaaaaactggttgagtataactgaattctaaacttgaagtcttttcttccctactggataccactgcagctctgcctcaatgtatgtcttaggatttaccacttaccttactccaacttttttcaagatctattaagacagtggtccccagcctttttggcaccaggcatgagttttctggaagacaatttttccacagactgggaggcaggggcgggggtatggtttcgagatgaaaccgttccacctcagatcatcaggcattagtttctcataaagaggtcacaacctagatccctcgcatacatagttcacaatagggcttgtgcacctacgataatctaatgccacgactgatctgacaggaggcagagctcaggcagtaatgttcacttgctcaccactcacctcctgctgttccagtccatggtccagaggttagggatccctctattaagacataggcttacatgcattcactgaacaatgctggctcctgaagaaagcttgggagttttgatagaagaggattttaaggtgttttcctaagatattctcacaacagttttggtaataggagctactgaaggaatatattcacttaaagatgctttcttcaaaacagtaactttcaaagatttatagtttatagcataatctagccaggcaatcaaccccatcaacactcaaccccatctgctctcaacaaactgaaatatacaaaataaatggactgctaaaaaatcgcttccaaatgtaatttaataaactgtaacaccagtggggctatctagaatttaaaaaaataacatggaacttctttatctgttattgtctattttttaaaaattatttatttatttatttatttctagatggagtcttgctatattgctcagcctggtctcaaactcctggactcaagtgatcttcctgcttcggcttcccaaagtgttgggactgcaggcataagctgctgtgccgtgccatctatttttttgtgtgtgattttttttttctttggagatggagtctcaactctgtcgccctggctgaagtgcaatggtgcgatctcggctcactgcaacctctgcctccagggttcaagtgattctcctgcctcagcctcctgagtagtggggattacaggcatctgccaccacaccagactaatttttgtatttttagtagagacggggttcaccatcttggacaggctggtcttgaactcctgacctcaggtgatttgcccacctcagcctcccaaagtgctaggattacaggtgtgagccaccacgcctggactgccatctatttttctttaaataagcatacctattgggatcatagctcagcttccagtgcttaatcatcaaaatcaaaacaaatgatcaagtatttattattatttttacatgtgagatatataatacatgctagggatgatgcaaagatgcataaggcacaagcgttgtcagagagtttacagctgaactgaggagacaagggatctgaaaattaacaaaatatttcaagagttaaacaagaaagaaaacttggggtcttagctgggacgttatagaggctcttgctatttctaggatctgcttaaaataaggttaaaaattaattattacttatataattttaaaggtagacatgtataactgttatatcacttcctagtcctgaccctggccttttcttagacttgtgatttcctaaaacttgggacaagatgttaaggaaaaatatgtaggcccgctcatcctcctttttttcccctcttgctcatggcaaagataatttttaaactaaaataaacacaaattgtgtaagtataacatttggatctcacatcagactcacacaaatctcagattcttatctagtaccaatctttattaatgactgaaagaattatagggaagtgctgggcacagatagaacattatttccctggggaacctgaaataatcacacatgcgtttccaaaacatccatgttatttcccattatgatgtgctttggtttcatattaacagatacgtttttaaaaatttacacagaaacattgaaaggaaatcatttcagtctcaaaagttttccattttataatctgtcaattacaaaaatagaaaaacgttcatgtagctatgccctattctccagccagccacgactcataaatccaaacattccaggtttatttacaataagctatctagccaggccaggtataccctactaaaatcattttatagatagggatttgcaggtatctttcctctagttaaccactattaacaagataaacaagaaggtctgggaggtcattaacatgtttatgaagtggtctattaaggtcatttattcccttcacatcccccagggaataagtcacagacctgctgttaataccctttattctctttagtttcctcttcgttgtcctctctctctctctctctctctctctctccatatatatatatatatatatgtgtgtgtgtctgtgtatgtatgtatgtgtacatatagatatatgagtaaaatgtacacaaattacttttaattggatgcataaagatatttccaccttgaacttttgctgtgcctgctcagcccctcctgctctatctaggattcattcttttctattatttgatttttttttttggcagaaaagttcttgtagtattgatataagtaagagcgagaaaaaacaattaatctagcctttatttgataaagcacttgtatttacatattaacacagggtgcctacatttttcggatagagatttttcttttctttcttcttttttttttattcctagagacagagtcttgctgtgttgcccaagctggagtgcagtggcacaaacacggttcactatagcctcaactttcggccccctgggctcaagcaatcctcctgcctcagcatcctgtgtgcctgggaccacaagcacatgccaccatgccaaggatttttttttttttttttttgtagagaccaggtatcattttgttgctcaggctggcttcgaactcctgggcttaagtgttccttctgctttgaccccccaaagtgctgggattacacgcttgagacactgtgcccagctatattcagacagagatttttcttaatcttcagaaaacataagccattatttatcttcaaaaacatattaattgcccagattgcttttgtaattttgagtcattatgagaaaaagtatgagaaatacttcttttgcaccatgtagttataatgataaaaaataaagactaaagaatatcactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaaggaaggaggggaagactgaatgggatttggagttttcccactgagaaaggggcattttctgcaaccaggtcagtgttcaaaggactaatgctctaaggaaattatcccaaagaagagagaggcagttcagggttattaagttattttaaaacattgcctgggctgttgctgctgacctttgtgaagggaacaggatgctgcttcccaggggaacagaataagaagcaattagagaagcctaggagaggcccgggaatgtttgggaattcacacataccccaaattacgtgggaacgctaagaatgaaaataaactaactttgattagggacatatttgggttctagaaaatattctaaaaatgcagctcacactggggctatatctctatgagtgttttcctaaaaacctgaacactcagtatctaatagaggtcaataagacttcaatccagtttcagaggagaaaaggaaagccaattaacatttcttaagcaatattccttatgtgtcataaagtagaatgggtgtcacgttaagcaaatggctcaaacgaacagagttgggatatgatacagttgtttcaaatgcagatttatttgatgtgactactggtttttttctaacacgtgattatgtaagaaagtgcatgtttaagaaagttagaaaaagaaaatggggaaatagctgaaataatttactcctcttcttttggataaaccaacttgaatatgttctatgctcattctcacatttccaaaagtgccacgaatgaggcagggaatgctataccatgtgtattataatacaggattattttccccatacacacattaaattttagctgccacatgtataggtgtatgtatatatgttgccacctttccacatgacatatgccatatagaatgttacaacatttttctgtaaaataaaaatgtatcattgatgacattctgttaagactcagtggctactatatcctggcccaaaaagtaggtcctgtccacaatgctcagtgaaaaacagtagttgatcaatttaaagctctattgaccactagaaaaccagaagaagcctcatgaatgatatttaggaaaaacagactctagttctactgaaacaaagctagagctgagagtggtcccaggcattatctagttcaaccttctcattgaggttgagctaagttatactccttatcatattgttagattaagatagaacggaatctagaactcatgttttggtatgtaccattcatacatccatgccaaggactgtcccttaagcaccaaactgtaggagctatgagaaactctatcaaacactcggcatgcttcctaacactaaagttcatgtctagagggcatgagagatggatttgagtggtaaatctaaattgacacacaaatactacaagattgttttgaaggtgaaatgagtcagcaaactgaaaagcacatagaattactgacatatgttcatgaattcattccaatatttaccaagtacctgttatctgtgaggcactatgctagaaaaagagataacaacagctatcctcctggagtctgttatttcagtcaaggtgatacaaatcagcttatgaaactacaaaaaaggatgtgagggtttttttcatgaacctatgagacacagatgatatcaacatctacatctcccaacaagatctataaaaccaaaaccagactcagcactctgcacaacactatggcacccctttcactctctttcagttaatatcttaacctgaattgttttcatgattatatcatcaataatgtattaccaactattccttcattgtggttccagagcttactgagactcaggtaacgtgacctttgaaaccatcaaatggcagaggagaaaacacagcagagaagattgacctctgggttatctttgtgtactaaagccttttgaaaagtcagagcatcaggcttttggcagtgatttcaaaaatttaattaccccgaatcattcaccagcatcctcaaagactgacagatcaaattagacagctgattctctgttgcatccacttcttatcatcaatagtgctaaatagttaagtgaaacatttaatattatttgtcctttctatcccgataagattgatggtgcaataagaatcctcaagggcaatatgaagattcattttcacttctctggaaaatgatcacaaacaatttctatttcgaagtcaacattcacaaaatcagaaaatgttagtactggaaatgacctatgatatcatgtcattctgcttccttaaatgacagagggagaaactgaggcccacagaaaataagcaatttcccattggtcaagtattaatagctaggtgacagtaaagctggaactagaattcaagtcttgcgatgcctagcctatttaaaatttcccctatttaatgttgtcttagctgctaaaaggtatattttgaagaaaaatatacataagaaggatcttaccagaaatagcacaaaattatatactacatgatgtgttcacattgtatgaaagattatgacaaaattcaactgattttcaaacccaatgtcagaagacttgtatcattcttagaagagtgaggtgtctggaataagaaatgaggaaatttttttttttttttttttttgaggcagagtcttgctctgtcacccaggctggagtgcagtggcgcgatctcgtccactgcatgctccgcttcccgggtttacgccattctcctgcctcagcctcccaagtagctgggactacaggcgcccgccaccacgcccagctaattttttgtatttttagtagagacggggtttcaccatgttagccaggatggtctccatctcctgacctcgtgatctgcctgcctcagcctcccaaagtgctgggattacaggcgtgagccaccgcacccggcctgaggaaatgttttctatgttgatatcatactccagtttctttataataagagcccatctcattgtcagaagacgtgtctactgcaaaccagccaacacagggatatttaacacgttgattgctgttaaggctaagatgtagttaggcactgctccctctgtatataaatacaggtactgaaatagcaatcaatattatgaaggaagaaatcaaccaaccaaaacttgaattggagcaatgcctggtaccaacaggggctagaacaagaatgagagcaagatatgctttaagcatgggacatatttggaatccgaaaaaattgccatgaaagtagtaatagaggcaatacagtagggggcaggggaaggtggtgtcaagattcagatgctactggagttaggggaacactggtactaaaaaccagaccaagatccgtgagttcaaaccagaatgtagaccaacaggatacagagagccacatataccaaaaggtaaatctagacagatggccacagttccaggcagagagtcaaatactcgtacaaatagagctataggaatggtaggccataagaagacaggacagtcagaacccaaatcagcaattttgtcagcacaaacagcaacagtaacaagaaatgttgactgaagcaactgttaacttcatccaataaggttttatatcgcattttgctaagcaggaagcagcagaaagttgtgagcaaaactcagatgcaataaatggttgtggaaacatgcctgagattgagagtgaagagaagggtcgatcaaggtcatcaggcaacatatacagcaatgtatatacaacattcaaaattaccagcaggaaaagataaacactcctttggacatgagttgcttcttgagcattgcatgtaaaaaaagctgagcagttagcaagttcccaagaaccccatctttcactcttctgtgaagggcttcagagatatttcgaaagggaacctgatgaaatgcattactgctgatggagtcagcaggtttactcctgagtttcattagtgaattcttcccaatatttagcaaccacagcgtctttgaaggaggaaaggaccagcttgtctaaaaatcaaatccttcctaagggacagctggcagaaatataaggtcaaacacttttgctggtattacagaaaagtagcagaaaaccaaccttcggctagaactaatatatgcagaagaggttatgacctcaattgatctctccatttctgcaccaatgggagacagcaaataacatttactttcttcatgagtgagtggaaactagagacaatgctaacaaatttcataaccaatatttgggccaccctagtcacgacatcccaaagaagatataacagagctggaaaagatccagggaaaaacaactaagataatcaaggggaaagcttatctttccgtcaaggacagactaaaagactaaaaaggattagaatttctcagactgggaagatgaaaatgaaaagcattagtaggggaatgtgaggctaaagtcgactctggataaatataaatgtttttactgaatttcaaagaatttaattaaggccattccttgaggttaaaggatgcagattcaagagaaattaaaatgcctatatttatatagaagtcggtacatttatggaacatattattattaagacaaagctgaagtggggaataggaaaagtttgacaccattggataaactcactgccagttgatttacaatgcattattaagaagtggtcatgatgtatccgaatttttaaggtaaaatgtactaggttacctgacaaaacaaccattggtatcttcatctgggacagagttccgggctagttgccctgttggtctgacccagtgtgatatttcttatgcttttattatgacatctatactggaacatcctgcatgcatgtttgggattcctaaattcttttgacagtccagaatacagaagaacaattttctaactcattaagaaagcaagagagtcccagctcttggctctgtttggtttacccatatgggagcatgcaacataaaaaggtgaaagaaatcctaacagaatgcagcagctggttaaaggctattatattgaaattttcatgagtttgacagtaggccaaaaaactacaaaatggcagagagtagaaaaggcagttgtaacaggttgaacattgttggtgattattttttcagtggcaatgaaagctgtaatcaaataacctgaaagagatgctggcaggaataagggagccccaagggagagggaatatgaaaactgtaacaatgatgtatgctgtggacaaataaactagacaaacacgtagtttgaagtatcaaaatcaaggttcttagcctcatatgaaaagctgatgtcaggatgcaggcataaacactgcctgatttgcaaactagagcaaaagatgttaatgacttaaaatctcaagaatgagtgcacaattcaacaaccaacaggaactgtgccactggtatagaaacctcttgttatgtgggcgatccctttatcccagcattgaaaagaaaaagttacaaagcattaaaaacatagccagagaagacacctggttttgcagctgggcatctgtggtaaaaactcttgactggaagtcaagacaaacaagataaaaaagaggaaaaatgaggactggttgaagcactgtcactgtaaacgtatttttgttctttttagaccaagacggcatctcagattatgaacggcattaagctgtgcataaagtccaccgaaccttgtacatcaaattaatttggtttccatagaacattttagataatagtaatggctaataagacacaagtgccattaatcatctgcttactgacaatgttcattttataaacatgtatgttttccctatattacagtttaacattttacactcatatttgagaaattataccatccctaatttcaaagagattataattgtagagagaattgctctccataaggtttcagagatatttttgagaaattacgtaatttcctcatttcaaggaactgattatttcagaggcttttaaggtctccatactcaccttttggcaaattttcctgcctattgttctctctctcttatcatgagccaggaagcataataatcctaaattatataccaagatttgagctctttaaagaggtgtgtggtgaaattggagtgggttgatagggcatatctaaagctaattaaacagtggaaaaataaaattcctgttttttaaagtaagaatttacattatgttcattaaaataatgaattttaaaaataaagatattatcgaacaaaagctgagatcttcggtttttaagtttggacaggacaactgaatgagtcatgctcattacgtcttagagctaaaaaggatcttagatatcatctagtccaactctttattttataaattagaaaccaaggtttggctgggcatggtggctcaagcctgtaatcccagcactttgggaggccgaggcgggtggatcacctgaggtcaggagttcgagacgagcctgaccaatatggtgaaacctcgtctctactaaaaatacaaaaattagccaagcatggtggcaggtgcctgtagtctcagctactcgggagctaagacgaaagaattgcttgaacccgggaggcaggggttgcagtgagccgagatcgggccactgcactccagcctgggcaacagagtgaaactccatctcaaaaaaaaaaaaaaaaaaaaaaaaaaagaaagaaaccaagatttttataggttaagtgacttgcctaaagccatacagtcgcctaatgacagagcctctaagactagactggaggactaaaattgaagttttcttattcatagatctgtgcccttatcaataccatcaccatggtctttaggtacatgaaggagcattggacaaataggatatgtagctgctctctaattccactgagaaacagcaagagactaatacacagaagggaattacagcttttctggaatttgtctctttattattttttggacggagttcatttccattccctcacagcaatgtactgggatctcttgtagtagaagtaacatcagggagaagatgaatatatagggaaaggacaatgggaccggggagaccctagcaatccatgtgagacctctagtgagccccaaacaagtagtcatttggagaataatagcttaaaggtgtcttgaattctccagtgatcctaaaacctcatctatgaaaggagaaaaagagtctttatttcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcataaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaagatggcaggcggaaaaaaatgggaaaacatctaatatttttagtcagactcatggcagaagcaagttcaaagacttcggttggtatcgaggactattttatgaacccagtaaattgtaattgttgttgaggtttccaattcaaagttaaatttaagttagactctagtgcacaatggatgagagactgtgaaggtatcgtaatcactcaatatcctctctcctctctcttccacgttgacccaatgtattgtcatttatatttcatgcaaaatactacagaaggtgcttccaagcactcgtattcttttgactggcacaaatgtttccagaaaacagtatctttctgttgttaggtgacaaatactgagtgttatgtatcaagaatgaacaactaagccctacgagtcgaggactgctgctttctgccttttggaaacatgtagtattcattcacccaaaacagttgtgtacatataactgcggaaatcttctatctttgacggaagaagaaatgtgagaaaacccctaaataaaagaaattgttctcgcaaagattgactcccactatcaataaaattatctggagcttttggttctattgtgaaaaatccgccccctctgtcacaaaacacaccatatatcctgcattaaataaacttttcttaaaagtcgttccccattgcatcagcaaatttacaatggtaattttagaataagttttttatccaagcttcctcaggaaaaaaaagacacaggtattgtaggccaggctaatgtcgcattttaaaaataaactcacttgtgaatatacaggttagtcacaataaatgctcttttaaaaatgtgatacttccaacttacttgatatagtagggcactttgtttggcgagatggctctctcccagggaccctggacagacgctgaaaagaagggaggaaaaaaagaaaggcaaggaggtcaaattcatcgcaaacaggaaagacaacattaatctccagaattacaattttacactgatattggtctgtttgctcagctgcccatgaagacaggatggattaacctgctgttctgaaatttctgtcctaatctaagcgaaactgaactcattcaggcacaaagataaatgcgaagaaaaaaaaaacccacaaacatttccactgctaaacctatagaacagataagaaactgaatgagtagactgacggggtttcttgtatgtgtctcccttgagtgcttttttttataatacttcctgttgctggttctcaatattttttactatttgactgactggattttattatttcagtagctgaaatatccctctgtgatatatttacattctaagttattgaagctaaagtaatatgcttatcactctgatatggttgtttttatctttattggtttaaagagaatccaaattcacttaccaaatagatgcttaatttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatatagagtaatagagggatcaaatcacccaacctttaaccagacatgctgttttgtaccttggagatatgtcatttaaacgatataggaaatggatttgtatttggccggtaattatgctttttcattttggcagacggaaatttttaatacagagaaaaaagacatttagctgctgttttgaagtagtctctgactttccatttctttctgtccttctttctctattcctttcttttcccttcctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtaccttcttcttaaaataccagcatcataaaaggaagaagagaactccagagagctcttggtccagccctcactggctgtgaatgccaagcctgtgaatacctaaactgagaaaagaatggctattctttccttaaaggtatctatgggctgaggcctcacaatttctcttattatacctttctagtttttttttttttttatcattctagtggtccagaaattctttctaatttggaggatgctagaccatcctctgatagcagaagaatcactttggatttcctacactattcttaggcgtctctcagaaagaagtgtgctggagagggctgctggctgcctggcctggcttaggggctttcggcctgaaagaaacaacctctaagcagcgagagacagaggaaaattggcgttgcctggctgagctaatgggaagacctacgtagggtatctagagttgactttttatgtttacattaaaaggggaaaattttcaattaaatgtcagagaagttatcagaatatgcttgaactaaatagctgaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttcttatctcagtgtaccagtggaagcttgtcattcttcataaagctagcctacgtaatagacacacacatcttttatgcctgatgtgtccatttttagtagcccatcaaaagcaaatttatcggcaaatagtttctatatgacaccgggttgtcctttggtattttcttatacagatgtgcttataaccactacgtgtaattccagggcagctttgtgattcagattcttgaatgtacaaatcaaccattatcatacggcaccagcatcatggggtattgtccactgaatttagatagcaaactacacatgcatttatttattgcaaaaccaacctctgaatttccttttgtgttacagacacagtatgttattaagagcaagaaagggtagcaattctatcttcaaatgcttttccttccttgaggtgacaggattcaatattgtgcccaaggtagttttgaaaatcacaagcacaggccacattatttaggggaagttgttatttcagccgtttttaaatgcatgatgaacagaatgttccaagtgatgcaccctggtgttaagtcatattttaatcaacataggggcctaaccagaaaattaaaaagaatgctaatgttattttaagacatgccaaaagagcactttctggaattccaacacaaataccttcattcatctctctacttttctcatacttggtggatttggagtttgataacataggtgggtcaaaaaagtggggacagtttagataaataaccgatacagcaatcactggaggtaaaatagaaaactcacctctggggttgaacaaaaggcattagggaggatctactagacttgttttgtcttttccagaatgtcatataaatacagtatgtaaccttttgatactggtttatttcactcagcataatgcataatccatattgctgtatcaacgatttgtttcttttcattgctaagtagtatgccattatatgggtgtactacagcttagttatccattcacctgttcaaagacattaggttgcttttagcatttggcaatcatgaataaagctggtatcaacatttgtgtacaggtgtttgcataagcataagttttcatttctctaagatgaatgcttaagagtgggcttgtagggttacaacagatttttcattgctaaaaaattcccacttatggatgtaccatgatttattgaataaattccctctttgggaacatataagttgtctccagtttttcactgttctaagtaaggccacagtgaacatctttgtagataaatctttgcacatattttagttacttttttaaagcaaaattcctagaagtatatttacttgattaaaggctatgaatgttttaaaaacattttacataaattacacttatggcagcagaagcctctctttattgatataagtgtaaagagaaaaatcaattttctgcaggtcaatagtatttagttggcataattctcaaagcaagttagatatactgcttgatacagtagattatttgggaacattcctctcacactctcctcttcccctgatagactgtaaaactcagagtttagaaaggcactcaggatgttggctttctatttcaaagcccaatccagcatcttgagagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaagaaggttcctaccattggtgacaatgtggatgggccttgcagacatgctcagtgaaataagccagtcatagaaggataaatgctgtatgactccacttttatgaagtgtctgaaatagtcaacctcatagaagcagtaaatagaaaagtggttgccagaagacagggcaggggaaacgagaaattgttattcaatgagtataaagtttcacttatgcaagatgagtaagttctagagatctgctgtacaacatagtgcctatagttaacaatactgtgtagtgcacttaaaacttaaggggattaagagggtccacctcggccgggcgcggtggctcacccctgtaatcccagcactttgggaggccaaggtgagcagatcacgaggtcaagagatcgagaccatcctggccgatgtggtgaaaccccatctctactaaaaatacaaaaattagctgggcgaggtggcgcgcacctatagtcccagctactcgggaggctgaggcaggagaatcgcttgaacctgggaggtggaggttgcagtcagctgagatcgtgccactgcactccagcctggcgacagagcaagattccatctcaaaaaaaaaaaaaaaaaaaaaaaaaaaaaagagggtccatctcatgttgtgttcttgccatgcacagacacacacaaaagcaaagggacacaaaacttttgtaggtaatgaatatgttcgttatctttagtttgactgtggcaatagtatcttgggtgtatacatatgtccaaacttaccaaattacatatattaaatatgcatatttttgcatataattataccccaagaaagctataaaagtacaaaaaaaaaaaaagatgagtacagtggaggaaaacaaaagggaatgtaccctggcaaatgcccccaaatggcggtggcagtagaactgctgtcaaagaaaaataatacagaagctagaataaagtgggatgaaacacaagaacagcctagctggtgaagtataagcaattcttgagcctgacagactaagggtgtagaagaagaagatgtatttgatcccacgatcactggtgacctcaaaagggcaatttcacactagtgatcagaggctgaaggagggagtagacggaggggaagcaagcatttgagaagttgtgtataaaaagaggaaaacagaaatggaaaggggcaacatctgattgttggtcatccctctcttgtgctctgtaacccagcctattcagttcacttcattactgaatttgcttagggtttctttataacgttaaattatatgcaaaatgtatttctatcgttttcatttcctaaagtcataatcaggattataatacagtatttaagctttcatgtagttattagtgttgaatatatatgtatatatgtgtaatttttcccattccaatttttttctgtatgatttctattttcttttgatgtgacgcatatagttcctgtagcaagagtaagttttctgtcatttaaatgaaaggccaagttaaatttaacacttttcaaaacgttaaattaaaataaggatagtgctttatatgtctatatcgtatatcaaaagtaaagattcaatgaaaactttaagatcacttactaaactttcaaagatgggcagactttccataaagatttcaacagcagagacagatgggctacattccagagaggaaggtcacaagagtgatgaatgagacctctaatgtctgccatagctgtgaaaatctttatggctaactaaaattcctaacgaataacaacctgtaaatattatatgagctgtcagacagataatgctgagctctgagaccattgcacatggtgaacagaataccacaccatgggatttgtcagtagattgccaagtcatttagagtatcaggctcacatttgatctgggaagtcaagagttcatactaaaattcttggcaaggtgactgagttgcagagataaaactatatctaatatccagtgctgatggctgcacagtcacacaaagtctaatagccaaagttgggcggcattactcatgaaaaaaaaaaagaaaaaaaagctgcttctaaccgacttatagaaaacttcaaaaacatcacggtgattattagaagagtaagaaagcaatcaagcttcctaaggtcagatataggaagatagatacctacataaatagagccatgaataatttatgctcaaggaattttcgagtaaattcgaacataattggctgactgcattaccagggaactttcctccaggtaatggtggttacagtctttgggccatctgggttaagtcaggttactaacaagtcaatgcaatatcgccaggtgcctttactgtctctgcagatgtacttttaaaagacgacaggcagtccacaccatttgctgaacgctctctgtgtgaaaggtattgtattaggcaccagggaaatttcaaggaaagtaaaatttgaaacctgagacagtagggagcaactcagatattaaaaaccaaatgatcatagatgggatgtacatccattagaaagcgagaagagtgagaaagaactagcaattaacgcaaaaagagtataggagagattgaatttggggcccatttttcactcagttgtgaaagaactaaacatgtataccttagccatggcctcatggtgagcgcagtgtgcttcctagctccttgaccttggcttgcttgaccatgtgacttgctttagcagatatgatgtgaacagaggcttgtcacactggcaatctgccatgagaacatgccccaggttgcttctgatcctttagtctggggctcacaacccaacacatttagaaaccatctaaactgaactcacagcctagaggcgaacccaggcatgcttcagtatgaagtagagctttccagtcaagttttatccagatcacccgaattacagttgacctgtagacccataagcatgagaacagaagctttatattcttgtatagtagttatattgtggcattattgtggatacagctgacagagagaggagtagagagagaaggggagaggggaaacagtatcataaagattaaagaataaaaaatatcctccagccaaagtctctcccatttgttactagccactgcctctactaacatgcaaagattaatggggattatcatcctctttggtctgtgcagttgagacgtgtgggttgctattcactggtgtctggaaccccttttctaaggctgataatccataatagttacaagtatgaacttgaatatgttagtaaattgttctagtctcagttttctcttctgtgaaatggagacaataacagtccttattttaaaggttggtgtgaggattaaacgggttaatctatgcaaaatgcttcctctgtgttaagagcacagagcgctcgatactttttaaaaattccaactcctacgtttataattattttcatcattaatgtagctagttatcaggatatttatctcattcacgaacttactgccaatgtgaggaatcccagggtaaccaggaaagtgacagagactttccatggttctagagttaaactgactgttaaccaccaaagcatgggaccagggaactagttaaggaaataatctttcttcctctttttctagccattttctgactctttaaaaaatgttacgcggttctcagagtaataaaacatgaacggagacaaatcttcctcttggcattctgatgctgatgtttactatgaaaatcaactgtgttttatcattatatactatattagtattgcttcagaattcaaaataaatagctaaatatttttagaaataaataaaacattcttgtttaatttcaattgttggttctgatttttaaactaaatttttacataaccaagcttactattttttttcctatttaaattggtgtgggtgattcatgttaatggaattctctgacctgaagttatgtgctgtcttgtttaagacataagccttgctgcccccgccttttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgattttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggcggtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcccaaagtgctgggatcacaggcgtgagccaccgcgcccggcccgagatattcatcttatcagaatggctaagtagaagggagaaactgatttttcatcactgaatgcatcttgtgactcttgctaggtgagatcagggaccaagcaattataaacattctttgctaagttcctatcaaaaggaataccctctactttggatttgcatgtagcctcagggacaatatgcgttaatactcaactagatagaacatctcctttctctcactgtggaatggattcctcccttccattctactcccattgcacccactatttactaccactgtaggaggtcattttttataggtctgtcttttgtgattggtatttaaatgtcccaaggcaataattctctttttatcttcatatttcaggtgactcgtttttgttaataaatataggaatgaatgaatgaatactacaggcacagtaagtaacaatgctacaggcaccatgtcacttcttagctcagaattctatgacttcccttctcacaaagcatatatgccaaaggcttttaacgatagccaaccatagttgataagacccttcctcgtctggcccttggtcactcactgacctcctatcattcaccatctttcttccttggcttcagtcatactggcttccttgctattaatatttctcaaaccctctaagcatgctccatcttggatcctttacttttactgtttcctccacctggaacactttgtcccccaatatctgactggtgtacttcctcacatctctactgaaatgtcaccattcctgaccactccactaaaagggtccccttctcccatcctctagcccctttagcctgctttattctttgtttttaaatcaaacttatcatgacctgattgtccatcttctcttgttaaaatgtaagctccacaataaataaactttgttttatttactgccgtttccccagttcctagatcagagtttgatttacattggtcattcaacagacatttgttgagtaacaaagtgaatcaattcttaactgactgaagataaagtgaagttcattaactctttctggacattagactaagcaccaggctaagttctttcattttattagactgggaacaatcttttaagtgcccagttattcattcaatcaaggcatatcctgcatctaatatgcaagatgttgtgttagatgcaaaattatttttaataaaaaagtaatgcaggccctatgcccttaaagtgctcacactccaacatatttcctttcaagatctatgttactgaccatcttacgttctaactcttgcctgtcatgggcatgtatgctgctgagcttaaggtttaaggtaagagattcatgtaattttatgctgtccccaaagtccttacctattaatggagatcatgaggttggacaccttaaataataataatcactacttatcctgaacaaaataatcaacctcattatgaaagcaagagtaaatcaaattacccagtgactgtaatgggcctattataatacctttttcttagatgcttctaaatgcctgtcaatttcattgccccctcacagattggcttcctccaggaagccaactctaaggcaatgattagagagcaggatagacaactgtggaagggaagtgaaagaaacaggaatagaaatagggagaagtcaaggtgaatgcagacccagtgacagtctcattcaaccccatgggagctcttgagctagaatgttaatgttctcctgagttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacatcagacagacaatgtctggagacatttttggttgtcacagctaagggaggggagtgctactggcatgtagtgagtagaggccagagataatgcacaggacagcccccaataatttttgcccacagaggtgtgatcccaccatttctgttgcgcaaagctttgtattctaggacagatgacaaaatgctaccccaggccaaactcacaaatgccttcattttctgagtagtgtaaaaatacacttttcagagccagcattccactaattatctggccccaaatgccaatagtgcccaggtcaagaaagcctagtttacagtctggcctgtggcctgtgagatggcattacccttagatggataataaataactaatccaatcagatgctttgtcttggagagcttgaatgtaatacacagagataaacagagatgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccgtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacatagcacataacagagcagtacctgcagtcgcctgaaatcaagatgatttttactgcagatatctgaaagtctatttaaaaatctagaatggtttttaaaccaggaacagtttatgtaagtctactaaagaacaaaatgccttttgtcctcacttcaaagttctcaccagaaagtactttgtaatcccaaactggttgtgttctgaaaatggaaaacatccaaatggaaaaacgaaagtaatgattcttgcccacagggatgtgatcccactatttctgttgtgcaaagctttgtattttggacagatgacaaaatgctaccccaggccaaattcacaaatgccttcattttctgggtagtgtaaaaatacacccttcagagccagcattccaccaaaatagtgcccatgttataaaactgattcagaactctggtgctggtctcttggccctagctcctcatgaggcccagaagaatctgtcacaatgaggaagatgaaataagaaagaaacagacatttgtctcatctcttccatgccaccgggctaatttccatgtaagtccgtgacgaaggagtggtggttagtgatccagctaaatgcgcccattcagctctaaagccagattatgcatggggtatgatagcagcttcataaagtctaggagaggttaatactattgttgttccactcagatcccttttactgagctggttcacccagccgcagttgttgtgagtgttggttgctaaggcctcattggtcctttcaccagaaatcctcccttggccaaatgggaactgctttgctatctcctactccccagaaatccacagccaatgactaattcacacgggaaaataaaagcccagccctggctgggcgcggtggctcacgcctgtaatcccagcacttttggagaccgaggcaggcggatcaggagatcaggagttcgagaccagcctggccaacctagtgaaaccccgtctctagtaaaaatacaaaaaaaaaaaaaaaaaaaaaaatccaggcgcggtagtcccagctactcgggaggctgaggcaggagaatagcttgaacctgggaggcggaggttgcagtgagccaagatcacgccattgcactccagtttgggtgacagaacaagactccatctcaaaacaaacaaacaaaaagcccaggccccttatctcaaagtagggacaatttgttctccagagctccctgtgggatcaagctgaagtgagtctcttccttcccacttaactccttgaccagcatccttcttactttatcctgcttccctcactccctttcacctgaacaaattacttctacaagaagccccatctatctaaatagggctctacttctagggattttacctaaggctagggtgagcaactatcttggtttgcctgggactacagagatttcctggaaaatgggaattccagtgctaaatccgggaaagtcccagacaaaccaggatgagtggtcactctgcaacgcacataaatatttggatcctgagcatccttcctgctaagtttatgaagattctttgcctacagggacttgagtgatccaaataacatagataaattagtcatttctgggaaaccatctatgcacaaaaaaaaaaaaaaaaaaaaaacaaagtgccccaatttgtagtatttgccaatttccatggagtaaatcttcccactatgcctgatttcaagctaccaaaggtaggcttaataactagctcacaattcctgtatattttacaattggctctcttgagccattgtaagccagccccagcacagaaattcccatagcagaaacaaaaacgttctgtttcctcatgtgttcaaattgatgggatatatagggccaacgatgcaaaatctggttgctaatgatactgtaaagcaaataaatctgagagcttattggggagtatacatttgagctaaaggagaaaagggccatgacaacacattttaagaagagaatataattattactgctgtagctgctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatctttttgattatttatcactcgttagttatacaaacaactattgagccgttctaatgtgcaaaacactggactttcagattagatccttggaaatcatcttcagaaaggagaggaactacttatactgaccattaaatgcaagagaatgaatgaaactttcatgactagtttgactctaacaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccatggcataaagtttagtgtgaaattaactggtgtgcctgaaaaaggcttccacagtcacctaaaactggagaactatagactccttatcctcttagagtctcagtgtataataaaaattccaagaattctaacaagaaataaacttgcttatctttgaaacctagtgtttttccaatcttattaatcagtactatttttttcaagggacagttatcaaaacctaatataacattaatgttttaaagaacctggcttggaaaatattcttttaagggacctctggaacttgtaaaatattaagaaaaccatggattctttttactgttatagaatgatttctccctttacccaaatatatagtgatctttcttggtgagaaaagtagaatttagaacagaagaccagagaattgaaataatggtcaggaaaaatctttaaattctttttttgagacagagtctctctctatcacccaggctggactgcagtggcatgatctcagctcactgcaacctccacctccagggttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagagactgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaatgcttttctcttctcattttctcttagatctaagataaaagaaaaaatttctttaacatgtagagattgggccaccaggaagaaacagtgaattcttttttttagtaaaaggctgcctctgtcttctgataaacaacagacagctggtaatgtaatttccaaataatttccaaaggggagtgtgtgtgtgtgtgtgtgtgtgtgtgtgtgtgtgtgagagagagagagagagagagtgcacacacgtgcgagacagagagagagagagaataagataaacagagacagtaagcatgtttacgctggcgggtgcaattagtagttcctccttatttttcttttctttgtaatttctaagctttaggagccaccctattattatttatagtaacctgaaagcacattactaaacatgtatcaactcaggcctgtctaaaaaaaagtatcaattcaaattcatttaatatgaccttagaggaatatttaaaacatatttttattcattggtggggggaagctgcttttatagtagcaaatacgtgacttcagagatgtcctgcttcaaatatggtgattttttttttttttttaaatttagggtcagggtcttgctctgtcacacagattggagtgcgggggggggtggattatggatcactgcagccttgacctcttgggctcaagtgatcctcctgcctcagtttcccaaagaattgggattataggcatgagccacaccatgcctagctcaaatacggtttggatggcacacccaatttctggtgcaattttctagaggtaagtttggcaatacacttgaaaaggcttacgaatgtaaacattctttaacatgacaattccacctttaggcatttatcctgtagaaagaatctgagatatttgtaaaggtataaaaaggatattagccataatgctcgatataataaagattgtgaaataatctttatattgagcaatttagaattgtgttggtaaatttggtacagccacagaagagagtattagccagtcattagaaaaattactctgaagaagaatatttaaacacacgaaaatattggaaagatagttttaagggaaaaaagcagctcataaaactgtagcatgtttttatctgcgcatggtttaaaagaaaagagagaggccgggcgtggtggctcatgcctgtaatctcaacactttgggaggcctcagtgggtggattacttgaggccacaagttcgagaccagcctggccaacatagtgaaaccccgtctctactaaaaatacaaaaaattagccaagcgtggtggcgtattcctgtaatcccagctactcgggaggctgagtcatgagaatcgctagaacccaggacgggggaggttgcagtgagctgagattgcactctgtctcaaaaaacaaaaaaataaaaaaataaaagatagaaccttgatacacacacacacacacacacgcaaccacaagagaaatacagaaagtatataaaccaaatttctgatagtgattatctctgagtcataggattatggatactttttcttttcttgtttgtactgtgggctttccaaatttttcttgatgtgtatagagtacctttgtaattttaaaaagtacaatgtaaagaaacaatccatccttagtctcaccgtcctatttcttaaatatcccttaaaccaagttggtattttctttatacctgcaagcaaagcttttaagcgtatattgatattccacatgggcatccaagagactgatgacttccggggctggctccattcaggcaggtagatcagtctctttatgaatacctgtgtctaacaggcctgacctttctggaagtgggcactgatgtgatatggtttgaaaggtgtgagaatgctccccttggcccctcaaagttccttcctcacagctcagagcttatggccgatgttctaccacctcaggcttatggattttcacactaataaaatgcaaataacccaggagaagtacacattaaactttacctatcacttgggttaaatgagtatatcattttctgaaaataggttttaatgggtaagacatgggaattcagagggggagtcagggagaagaaaatatgaatgaatatacctggtgtctgaggagtaattaatattcataatagtactattttttatttatggtttatgagtcgcttaggagtatgttatcacatttaatctcaattaaatcgaatagaatggctgtcaccaaggcaagttaagtagaccagagatttggaaagatgcagaagacgaaatctgtagcctttatcatttttctagagccgttcctaaaagccacgatcccactcatttagataaactgctttaacttatccctttttcttggcaactccaaagcattgtgaaactgtgtccaaataactagaccacatgcggataataaagttagagccagtccagaaaataagatacttcttcttaatctattatcgatgtatgacaaaaacacaggaccaacaccttccaggaaattttgttcaaaaagacaacagccaactggagacacacatgacaacatctactcaaatactttaaagtatttgtgagcgtggatctttttattaacccgtggagaatggaaaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctaggcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaacataattaataaaatagcaaaaccagtaaataaaaagaatggctagaggtcaagaacaaaaggagaatacaaggctcacgaatgtaatcctagcactttgggaggccaaggcgagtggatcacttgaggtcaggagctcgagaccagcctgaccaatgtggtgaagcctcgtctctactaaaaaaatacaaaaattatctgggcctggtggtgtacacctgtagtcccagctactcgggaggctgaggcaggagaatagtttgaacccgggaggcggaggttgcagtgagccaagatcacgccactgcactcacagcctgggtgacagaatgaggctccctctcaaaaaaaaaaaaaaaaaaaaaaaaaaaaaaaaaaaggaaggatgcaaacagttagggaaaggaaatgcccataggctgaggtttcaacttggaggcatagtatttatttattattgatatataatattttacatatttatgaggtaatgtgatattttactggcatagaatgcataatgatcaagtcagggtatttgaggcatccattactttgagtatttgtcatttgtctatgtattgggaacaattcaagccctttcttcttggtactttgaaatatacaacacatcgttgttaactacagtcactctattctgctgtcaaatgatataacgtagtccttctatctaactggatgtttgtacccattaaccaccctctctttatctccccctctacccacacacctttcccagccactagtatctatcattctattctatgtttattatcaatttttttagctcccacaagagtaagaacatgcgatttttgtctttctgtgccagggttatttcacttaacataatgacctccagttccatccatgttgctgtgaatgacatggtttcattcttgcagtgtttcattgtgtacagataccacatattctttatccattcatctgttgatatacacttaggttgatttcacatctttgctgttttaaacagtgctgtgataagcatgcaagtgcaggtacccttttgatatactgatttcttagctttgggatggataaccagtagtgggattgccagatggtaaggtagttctatttacagtttgttgagaatcttcatactgttactaatttactgttacattttcatcaacactgtaaaagagttccctttcttcacattctcaccagaatctgttattttttgtcttttgaataatagccattctaattggggtaagacgatatatcatgtggtcttgatttgcatttccctggtgattagtgatgttgagcattttttcatatacctgttggccatttgtatgccttcttttgagaattgtcactcatttcataaggcagggatcatttaatgaattatttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatccaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctcattctatataatgaggaacaattaaaacaatgtatcctttctgataagatactttgagtctccaagactgagaacactaaagcaacatttcataactctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtctgtgagggtgttttgcagacaagattagcatttggttcagtggattcagtagattgccctccccaatgtgggcgggcatcatcctgtcagttgaggtcctaaacagaacaaaaaggcatgttccttttttccctgcaggcctgcttgagctgggatgtcagtcttctcctgcacttgcactgggatttacatcatcaactcccctggttctcaggccttcagactgggactgaaatcacactaccaattttcctggctctctagcttgcagatagcaggtcatgggacttcttagtctccaactgcatgagataatacttaattttatatattcacacacacatagacatacatatatacacacacacacacacacacatatacatacatacatacatatgtatattgttgcttctatttctctggagaaccttgactaatcaatgtccctgggtaaattattcttaactttccttatcagtaaaatgtggaaaataatataacttatagggttttgtgggaattaaataagatgatacaatgtaaagcatttagcctagtttctgtcacgtggtaattgctcaataaatgttaccagctactgttcttgctactattatggttaataaaaggagaggaataggccaggcatggtgactcacacctgtaatcccagcactttgggaggccgaggcaggcggatcacttgaggtcaggagttcgagaccggtctggccaacatgatgaaacgcagtctctactaaaaatacaaaaattagcttggtgtggtggtgggcatctgtaatcccagctactcgggaagctgagacaggagaatcacttgaatctgagaggtggaggttgcagtgcgccgagatcgtgtcactacactccagcctaggtaacagaacaagactccatctcaaaaaaaaaaaaaaaaaaagcaaaaaaggagagcaatagactataatgtgcagggcaccacatacaatacaaaaatggctaatgtttattaagcaatatgtggcatgacaatatgaattatgttatttcatcttcacagtaactctgcaataggagttaatattattccccccgacttcattgacataaaaactgaggcatgagaggttaaaaaaaaaaaacttgcctaagcttcagtagttagtaaattggcagagctaggattcaaactcattcagtctgggtcttgctcttaactgctatcctgaagattaaagttgaaaaaaagtattttataaatatttaataagtaattggctttttaatttctttaatcagtttattgaatgcagaccaattctagtgtgcatatcgatgaaactgcagttgttcaacgtattttatggcccaatgcaaggtcaattcctggtcttgaagaatgtgataccataagattatagagaaaggttgtgggaaaacgcgtgcaaataaatgttgggcatatgtcattatttctaaatttagaatgggtcatttcatgaataaatcaatctagagataaatgtgagtgtttgggggtagagaggagaagatgaagatgccatatgggagtggacactgatcagaaatctttgcacatactgagaaagaaatcccaaggggaagatgtagatggtaaaggattatgactgtgccataggccactttctctagtaagaatgttagtttcatagggactgagccgatgcagcatcaaagttcattctagactcccaatcttctctctgaagaattttgccttcttatacaaggagcgctccagtggtagtttccagtgtacattcaatattgtcaagattttaaaatgagatcaaagtgaatttccatcttcataactcaaacttaagagaaggtatgacagcgagaagaattaagcataaaatatttctttccacaaattatcactggagaaaggttttgtgtggattgaatgcacaactggctaaataaagaaacaaatttatgaatgagaaaaacttgaaagcaaccaaagtcctcgaaagctttagcttgggacttaggaacaaagcactttattctttgagcaattatgcaaggaaatgaaatttgataatctattaaacgagagcctccatgcattagatctttctaactggctgtatgttaaatcaatataccgtggtatatacaaaacaggaagcaaaagccagaaatgatatacctgtgtcttatgttctggcacaatcagttctttccttggtggtttattcattttataagtatttgttaatattgaaagagataggcaaaaaacaaatgctatagtccctgatctctgcaagtgtaaaggtttggaggtaagaagtagtgacaagctgaagaaaggcttggggctgcagaacagtggtgttgaggacgacagtgagatacaattagttagtcatgttgaaagccgatgatgcaaagcaaggcgtcccagactctgaggctcaagatttaccctgcaggcaaagagaaccactgaaaatttctgtgacatgactcactattttagaggaaagttagggtttgggaagatcagtatagtgtaaaacagattcgaaagggcacctgagactgagatcagaaagaggctgttgtaacttactagacttgggttgatatgcattagaattaaggctgtattgtattcaatgtaaaagaaggtacatatgagaaggtattttgaaaggaggaagaactatccaatttggtgttggagattaatatctgaagaagcaaataaactcttggatttcgagtaaggaagactgggagaatgaagatattgctggtggcaatatgaaaatcagaaaaggaagaaatagcatatgtatgtatgaattcatttggaacataatgaatttgtcctaacagtgaaacatttaactggagatgtcatgtatagccagttagagatgaacaatttgtctcagcaattaaagaaaggaaagggaagtgagactaaaaggggtaagagtgagctttggaaggtgagccaagaaagaagagataaaggagtttaaatagaatgatttaaacagccaggaggaacccaatctcttctgaattaatagggcatgtctctgtttccttttataaaagtaatacaaatataacatctttttggaagcatacatcctgtttcaactattagatcatagatcacgaaagcttagaactggaagaaaccttgattgatacacgagggtctattcttcagaactatcccagatgggcagaaaactgccatctggtccatgagaactcataatctaggttgcagcaattcttcagtaaaagcatctcaggaaaaaaaggtccttttttatatgttccatgaggacagggacacatctttccctgctaaatcctcagtgagtagcacagtacctggcatataataggtgctaaattaatattagttgaatgaattaatgtactgtttattcacggatctttactattaacaactatattttgaatgaatcatttctttttcaagatccctgacacaagcttttgaaaaacttccctccctcccttcttcctttccttcttttcttccttcctccttttcttcctttcttccatttttgatgatgaaagtaaaaaaaagaaaagaagaaaaccatttagattcaattttgcctataatactagatttaaaaatgtaaaacggcaatttataaaacaaccctgaagtccaaatctcctccacatttgttttactctagtttttaaataatcatatttaagatttgagagttatgagggctatatattattctccttggtcttctcatttcagatgagttctgtagacagtatactgtttgcagagaccttcctttcttagcttcagtaagaaatatcactacattcattcaaaagatattgactagaatgtaagtttattgtccacaaagacagagatcttatctgtcttgttaagaatttatcacaatgcctagtacatagaagatgatcaagaaatactgaatggatgaatgaatgaaaggctttttgagttcctcttatttgtcaggcactgagataagtatgaatacggtagacttgaaagcgtaattctgggtataatgaatgagcaccaaatcatccaactaaattacgatacgacacacactcttaattccaagctgtgactgtttcccaaagctcagtccattcctctgtgtattgtgaaagataagctttatttcattttttcttcaacattgcttttaaataagccaaaagaataaaagaaagaaagaaaaaggaccgataacaacatcatggctcttagaaattatttcaaataaatttatctaaatgtaaatgttggttctttaactttgttttagattctcaagggcttccactttgtcttttgacctttctgttaattactctactttgagttttatcttcactagaagtttaggagagacaggcattacctccccatgtggaaatacactgctaggcaatgtggtttcttcctagtgtccaagctacatcttactgattactacatacataaatcatgtttactccagtctagagaaaatatgtaactaggaacgtatgttttgattttctggttctcagtttgtctagaccctagataaatatccatgggaatgcaagaaacagacatgacacttacacaaatgagcctattaaaacaaaaacaaaagcaaaagacagaaactcttgtgctgtgatgctagtaaataaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataataaaaaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatggcactcactctgagtaggagcataattcttaatagattttgtgtgacttatggcattgatactaatgccgtgccatctgagaccatccttaatctaccttttaaggttcctgcatcacagctttttttccttccattttatatttctgtgctgacttctttcttaatctgactcctttttttattccctcctttttctgtcctttctcctccagccctccccctttattatgttctatacaacctaccagaagagtacacagactctgctgaggcaaacagtgcctcaaatgaaggggctgtgcatgcttgcaagacaagcgaggcaggatatgaataggactcctagcctagtgccagcccaacgcttctccaagaacattcttcctctaattctgatgaactctgccatcaaactggaaggcaagagagaacaaaacagcaagctctttgtccgttgttaagcctttaatctttcacctcaccgatttctaaaatgcactttggatgtttgtttattggttttcttgcttatgcaactgcctcattctgtgataatggagtcaggttatatcaacattaaattgacttcatagacccaagtaccttaagggtatcattcattttaatttagaaaagcagcaatcaacctcctatcctgtttcatttgtcaaaatctttagttttaattacatctacagacttatgaaaattgtgacaggaagagaagagatcataggaagcatttcttctgcctttttttttttttttttttttggtctcagagagaaaagaggaaagttgaattactttgcctggaaggtgatgtaacttgatacagattttatcttaaaaaataggttcccttttaaaagttttcctaatgtatctcatgatttgcaacaggaactaaagtcaagtggctctcaccttacaacatcattacattaaatcatttacattccagccttagctatttattcttgagctttatttataccacatttggaagatatcgttctcacagaaattttctgaggccattggagcattcctttctaggggcattttggcccataagtagcataatgttcacatggtaattacataattatgcctcctggtatttgaacacaggagtatttccaaggaacaaaagtggcaatttgaaataatcatcagtgagataccatagaactggtattgtccgaaaaaaaaaaaaaagacggcatatattaggaaattcatattaacgaatgactgaaacaggtagataaatgcaaaaagataaagcactggaaatcaaacattttcatctcagtggcagaagcttttatattttgggtaacaatatacttgtagattttcagtttgttctactaaacacttctttaataaaggctggaagggggaatttgctgaagtctgcaacaacccttaaccgaggaaatcaaccctccttaaatcccgtaccatccttgcagcatttccaaagcttcctgaccttgactcccttcacagtcaatttgaccaccactcaaggaagcttgtccgccagaagaccctgtttccacttcccggctctcctcctctggcaagtgactgaaaagcgcctttcttttctctcactgatgcagaactgacaaaccagtatcaagccgttctttacaaatcaataaaccggaagatctcatctactgtacttccaaatcctacaacattctgtcttctctcttcttcgcatatcataagccacaagttatttacttcacgcttcttagtaaaggacaggggatggagcaatgtgcttccattgtttctctgtgtagatgtgtgagaaccagaattaaaactctgccatggactcacagtctctacggtctctctccctctgtcttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgggcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaaggattctttttctttctttaaaacaggttgttcccatattttccataagagagacatgtgtcggcttaaaagaaatgaaactacaatggtgtgagggaggaatctcctgattgttagcgtatattttctgcattttacctgaaattgtcaacgaagtgtaggtaaagttaaggcggggccctaggctgttcaataacgtggctaacatttggtttgagggccttctcagttctgttcccaaatagtcagcctttctttcccaactgcttgtccttagctgattagtaaataaccctaggaagataaatgattgttcataacaggcttccagtaccacagctgtgagtatttgcattttaagtgcaactttaaataattaagccattaattactcaaatacttattgagtgtttataaggcactttgctaggagaggaagcagaaaaaataaaaataaataagaaaacaaggggatggtctttagtgaatttgtagatttgatatttacaaataagcataataaagtattatgggaaagattttaatgtagtgcagtcattccccaatttgacagtgtatcacaactatttgagaacttttcaaaaaaatacagattcttagctcgtctaaataatttctgatttagttaatttgaggctgaggcttgagaatctttactttctttaagtctccacagatagttctgatgtacagcctggtatacatccatcagtgtagtggaaatgccacgaattttatgactcaggaagacctgagttggagtcccttactagctatttaaccagcatcttatctaacagcctgtgaaccttagtttctttatgtgttaatagaaataccacataacaacactaccaacaatgacagtaataatagcaaacatttatagagcatttactatatcccaagtgctatttcaagagcattataggtatatttcatttatgtctttcttatcagaaggtaaatttgatgagggcaggactcaatctattttattcattactgtacccccaggacccaggtcagtgcctgtctcatagtaggtacctaactaactacttgaaagaatgaacatcactatgaggaaagtacaccatagtgaccattttacagatgaggaaatggaggcacagagaatgagatgttgtaatgtgcacagttggagagaccactttctggcactcggtatgtactcatttttctgataactgcaaattgctagaacaagcctaaacagctatgggggttacagagtatctggatgaaattaatgaaggaggttgctttgaaactgggccttcacaattgggtaagcttttgatgggcaaaaacagaagaaacactctgggtgacaagagtagaatgagcaatttttttttttttggcactagtaaaggcccggatatgaaggataaacagaaaaagagttgaataatacaaggctagaaatgtagcttggagtcaaaccagagctgtacttgactgtcaggtttaagaatagagacttcatttagttgttcatgggaaggcattcaaatatttttttaataattattttaaaattgtatttctttcaaatgcattcacatgataataaaattcaagaaaaacaaaaaaagttatttaaaaatcaagtctctctttcaccatgtctctctagccattttcttccccattccctgatggcaagtatttccatactctacattaattttttaagtaagaaaaatattacgttggtgcaaatgtgatcgcagtttttgccattgaaggtaatggtaaaaccacaattacttatgtaccaacctaaatatcattgtcagaatggtgttttaggatgaatgaaagcatggagaaagcgaagagaggataagctgccagaaacgaaaacaagagatgttctgtgttaaatgtaacaatatcagaaagtagactcaaggaagcctcagactctcaccctaggtgaggaggagatggataaaaatcagaaggaaccactggtttgttgcagcatagtttgatgtaatagcaaatcagtaaatcatggacggttgaacaaagactggaggaatgatgggaaaattatgaaaggtgtggcagtgaattctccttaaagcccctcttatcattcattctcattgttagcaagatccctaccatagctggggcaaaaacaatgtatttaactaaaaatgagctaaggcgtgtaaagcgtttaacagcatctgttataaggtgagcactgagtaaatggtaactgttacttatttgtattaaaaggtggggctgggcatggtggtgcaagcctgtaatctctcacagtgacctgggaggctgaagtgggaggatcacttgaacccaggagttcaagaccagcctgggcaacatagtgagaccctgtctcttaaaaaaaaataacacaaacaaaaaacatggtgtcagagcagaatacaatggggtgagtttgacagacccatctttaggggaagttccatatctagcttcccttttttatagtaaatacttgagctggtttgttgagggtaacccatacgattttaatcatttaccaggacttaaatctggaaagtatgacagttgggttcaagaatcaatgattccaccagcattttcaagggctgctatgtacactgtactgtatgttcatcgtgtggtggatggcaaagatgggacatgaaaaatttcttttctcaagaaccttgtgtcttgctgggagatgactgcagctgagacgaattagagacttttgaactgatagtctctgtgttatgaccaataagggcaatatgtatttttggaagtgagacagcagtgaggccaggagcaatctgggaggcatcagaaaagaggtgacacagaacatcattgtcctaggtcagactcagtatcagcagcttagcatctcatgtccatgaggagtattttttgaacaggtattttgcatgccatttgtgatataatcttaatgattcagagattcctgagatttcaaacagtatcacttatagtgtcaatctttcctttattttagtaagcaacaagtcatcattctcttaccatcttttttttttttttttttttgagacgtcctgctctgttgcccagtctggagtgcagtggcatgatctcagctcattgcaacccctgcctcccaggttcaagcaattctcctgcctcagcctcccgagtacccgggattacaggcatgcgccaacccacccggctaatttttgtattttttagaagagatggggtttcaccctgttggccaggctggtctccatcctcctatcttttaaccatttcacggttgtttgcaaagaactttcaaaatacagtgattagaatgattcgttttcttgtcttttccttactgtattgaaattgattttttatggttaggtgaatatagatgattaaatataaaagcattgaatgattttgtgttgtttagataaaaactgtgaattttgcatgagtaaagggctagtatcgctattgttcctacttgaaaatgatttcagtgcactgatatcaaactttttctagacttttccaaagtaatcggaaatgctccaaattttgaaactttttgagtactgacatgacgtcacaagtggaaaatttcacacctgacctcatgtgacaggtcacagtcaaaacttttgtgtttcacgcacaaaagtatttaaaatattgtataaaatttccttcagggtatgtgtataaggtatatacgaaatataaatgaatttcatgtttaggcttgggtcccatcccaagatatctcatgaggaatatgcaaatattccaaaatccacaaaaataaaaaatccaaaacacttctggtcccaagcattttggataaggaatacttaacttgttttccgatctaacctggccctaacattcaactttgtaatatataatgaagaaataaaacaacagagtaaggccgggtgcggtggctcaggcctgtaatcccagcacttcgggaggccgaggctggtggatcacgaggtcaggagatcgagaccatcctggctaacacggtgaaaccccgtctctagtaaaaacacaaaaaaattaaattagccgggcatggtggcgggcacctgtagtcccagctgctcgggaggttgaggcaggagaatggcgtgaaccccggaggcggagcttgcagtgagccgagatcgtgccactgcactccagcctgggtgacagagtgagacaccgtctcaaaaaacaaaaacaaaaacaaacaaacaaacaacagagtaaacttccagagtaaacaaatctatacctcagggatatttaaatatcagaaataaactcatacttttgacttaccatcttcataaggcaatgcatatgctgaacacagatgattcttatctgttcaccaaactaaggtctttaaggactttaactactaagaatatttacgttaattcaagttaatatttgttttaaaaaacagaatcttttaaatattcaggatatagatgtttcaccaattcaatctaccctttctggtcaaaagttaaataaattggatggaatctcaagtattcataactacatataagaacaaaaactatcaagaatgtatcaacaaaaggtttccgtggcctctttcagtacacataagacatgtatctttttttttttttttttttttttttttgagacagagtcttgctctgtcaccaggctggagtgcagtggcgccatctcggctcactgcaacttccgcttcccgggttcaagcgattctcctgcctcggcctccccagtagctgggactacaggcatgcaccaccacgcctggctaatttttgtatttttagtagagatgagtttcaccatgttgcccaggatggtcttgatctcctgatctcgtgatccgcccacctcggcctcccaaagtactgggattacaggcgtgagccaccgtgcccggccaagacatgtatctttatagagcaaggtttctcaacttcagcattattgacattttggcctgggcaattttttgttgtgctatctatcccacgaattatagagaatgcctagcagcatccacaacttctacccactagatgccagtagcacctcctcaccagttgggacaactgaaaatgtctccagaaattgccatgtcccctgggggacagacttgctcttggttgagaaccactagtgtacagtaaactttcaccctctacttcatatacacagatattgatgtttgagataagagagtcctattctatgtctataactggttgaggaaggagaagttaacagtcccgagttatatacagactattgtcagatctgcccaattcagtattcctctaattggcagtctttgctctggcattccttgttgtgctgacacagagtctagaagatctgcattgtgatctgatggcttcccttgttcaattctgcttccacccctatttcttcacaggtgttattctgcaataaatctgccctggcatctgcttcttggaggactcaacctgcaacaataatcaatcaatcaattccacgattccattcccctagcctaggtgggcatgtgacccaatttgggccataaagagtcaagcccatacttgaccagtctttaagctctcgggtcagagtagctctctcttttctgcagggtatgttgagggtgttaagaggatggcaggtgggcctgcagcaatagtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggctgatccactctctctctctctcaaaaaaaaaaaaaaaaaaaaaaaaaacataaaaaaaaaaataaataaataaaaaagataaaagaaaaaaaagaaaaaaaacttaagtaggagggaaagtctagagttgacagagctgaaaggctctcaaaattttaagacttttttttttaagtgtcttaaaatattttagggactttaactttgtcttagtaaagatgataaaattaagttcactacacactcattctttttagaagcttttcacctcccttttaactgtgtgcatttaatttgtgtaataatcactgtatgtccccttcaatgtccttttgtatctttttttttagcattttagtctatttctgtctgtctgatttttttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattattattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagcatagccagccacaggggttagtgctttggcagcaattctctttttcccctcccaacttctgcacagtgtttattgagcttactcatatcatatagttcacagctttgatagaaaaacttcttgtttcctttttgtatttatacttagattttctacattgttttgaatctttccgacgttgtgtgaagttcagagcagcggaaaaggcaggggtgcactggagaggatgtgtcccactcagatccaatgcttgcccatatcagatgaaaaaggaatcaattctcaaccagtgggagcaggagcaggtatacacatgctctggctttccatatttcaggctgtagctacctatatccagatttgttttcttctgtacacttctcaacagttccagagaattgctcatctttctttgtcgcttcattcttcttgttctcttattcctgcttcttagaattacttgcacccaggtccccccgcccttttttttttgagacagagtcttgctctgtcgcccaggctggagtgcagtggtgcaatctcggctcagtgcagcctctgcctcccgggttcaagagattctcctgtctcagcctcccaagtagctgggattacaggtgtgtgccaccaagcccagctaatttttgtatttttagtagagacagggtttcaccatgttggccaggctggtctggaactcctgacctcaggtgatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctctttgtcatcaataaatgttcatggaaattcaggcactatcttaggtcccactgctgaggccgggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgttagatttaaagataaaagtagattcagaaataataccctaatttttgacttgggcaattgggtgaagcgtagcgttcataagaacagcacaattagggagggaaaaatgttgagggtggattgggacaaaaggaggataataatgagctgctggggacatgttaagtctgaggtgtctgtgggacattcaggttgtggtggacaagaaacatagaaggtggctgggtctgaagcccaggagagaaataagtctgaccttacttcaataatcaagccagccatttcaaataattatgctagagcaattgaacatccatatgcaaaaaataaacctcaacttaaacctcatactttatataaaaatcaaatggatcacagacttaaacataaaatgtaaaactataagacatataaaacaggagagccaaaatggtgaaaccccgtctctactaaaaatacaaaaaattagctgggtgtggtggtggaggcctgtagtcccagctactcgggaggctgaggcaggagaatggcgtgaacccgggaggcggaacttgcagtgagccaagatcgggccactgcactccaagctgggcgacagagcgaggctccgtctcaaaaaaaaaaaaaaaaaagaacaggagaaaatctttgggatccagggctaggcaaagtattcttagactcaacacaaaagcatgatccataaaaggaaaaagcgataaattcaacctcgccaaaattaaaattctttttcatcccctgttaagaagatgaaaagatgagagagaaaacatttgaaaaccctatacacaagaaaggactagtatctgatacagaaagaactctcaaaaccgaactataaaaaaacttttgaattagaaaatagacaaaagacatgaacagacatttcaatgaggaggatatacatatggcaaacaagtacaggaaaagttgttcaacagcatttgccacgagggaaacgtaaattaaaagcacaatgagatattcctacacacatatcagaatggctaaaaataaaaaataatgacaacaccaaatgttggtgaagatgcagagaaactggatcactcatacattgctggtggaatataaaatagtacagacgcttcggaaaagtttggcagttttaaaactaaacattcaactaccatatgacctaacaattgcactcttcagcatttatctcagggaaataaaaacttatgttcacacaaaaacctgtacattaatgttggtagctttattcacaatagtccaaaactacagataactcagatgtcttcaaggggtgagtgattaaataaactagggtatatccaaaccatagcatacaactcacgataaaaaggaaacaagtcttgctgcatataaaaagagaaatctctagggaattatgttgagtgagtcaagtccatcccaaaatattacatactgtatggttccattcatataacattattgaaataacaaaattaaagaaatggaaaacagactagtagttgctggaagtaggaggtagggggggcagggaagtgggtgtggctataaaaggccaataggagggatctttgtagtgatgaaaatgttctgtatactgacaatattgacgtcaaaatcctggttgtgacattgaactagagttttgcaggtgtaccattagaggaaactcggtaaaaaggtatgtggagtccgtgtataatttcttacaactccatgtgaatctacaattaaaaatgctgagatctagtagttctcagtaatgtatcaatgactgaattttcatcagattagttatattgaatattaattctaaggttctgtcactatcccttttcaagaatctagaagcttagatttctttttgaagcaatataccaatagttttcttattaaaaattcagaaggcttcaatggcgaataattttttggtaataagaaaaaaaactaagaattattttttattaaaaaacaacaaaatcagctcttaagacacttacagttcagatggggaaataagatctagatatgtgaaaatgagtagtgtccggtgaaaggctcgtttctgggtggttagttcaaaggttccctggaggacgctgagcttgagctggatctgcaatcacatctggattgagggaatccttccagcactcagcaaatagcaggaaaaactgtccagacacagcaggtatcaagatttggagactttcctcatcaggagggaagcatttgttttgtttgtttggacatacaaggagacagaaagaatattgataatggatgtatttgaacccgatcttggtgacaatgttgagccaaagttgtaaacatgatgattaagaactcaggtactgaagttggactgcctggtgtgactacctcgtttctcaactgagagccactgggcaaagcacttaactcgctaagtttctgcttttgtatctaaaaatgatactactcatcagaggtacctcagaaagtagttgttagaattaagggagataacgtatgtcaagtccttagcacagtgactggcagagtctcatctggcatatattagctctgagcttaatgggggtgctggtggtgataatgacgttgtctctccaaaggttgcaaacggcttaggggcagagactatcgcttatcttagactacctgatgtctgggacactcctggcacacagcaggagttttgcgaaattaaactggcaaaagtagtgttcttgcaagattaacttgacagcaattggctgaccagatggaggaaggagagattttaggcatagagtacaagtagaaagctgctgcaatgatacaacttcactcctcatgacaagggtcagaaaaaatggttggtgtcagcgggaatgataaggaataggtaagtaatgaaagatgaattgaaggacatagttcctgggctttgactccacattttaactatgaatagattctaagcttgactgtagtgtgcaaattaggcctctttcggagagaaggcccagtatagcagaaagaacatgagttttgaagttaaacactgttctgtcccatatgtcatttgtgtgaccttaaaaaatgtatttacaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcaaccccaaatctccttaagctgataagcaacttcagcaaagtctcaggatacaaaagcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacaggaagcaaaacagcatggtactggtaccaaaacagagacatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacgaaaattaattcaagatggattaaagacttaaatgttagacctaaaaccacaaaaactctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaaattttcgcaacctgctcatctgacaaagggctaatatccagaatctacaatgaactcaaacaaatgtacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtacgtttattgtggcactattcacaacagcaaagacttggaaccaacccaaatgtccaacaatgataggctggattaagaaaatgtggcacatacgcaccatggaatactatgcagccataaaaaatgatgagttcatgtcctttgtagggacatggatgaaattggaaatcatcattctcagtaaactatcacatggacaaaagaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacctgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactctgaaaggccaaacctactccagagcttccctgcatgctcctgctgcagccataattgcaactgcatggtgaaccagcttttcctctgcgcagtcatgcccctttcagtttcttagaggtgtaaatcctgagagcacttcccagtatgacaataatccttctgcaagcaactctccaactgcttctgcttctgagcctagtcttggagagccttttattcctaatctgtgaaagggaaaaaaggtacacagttgttattgagagttgtgctgggaataaaacgagatcatgtgcttggcagaaaaccgtgttcaagcaatgacagctaataggtgatacttgaggacattatgctacgtgaaataagccagtccaaaaaggaacaaatactgtataattccgcttacatgatgttcctagaatagtcaaatgcatagagacggaaagtagaaagatggctgccaggggctgggggaaaggaggaaatgagaagtggtttaatgggtacagtttcagatttgcaaggtgaaaaagttctgcaagtccactacatgacaacatgaatatacttaacattactgaactatactctaaaaaatggttaaaatggtaaattttacattatgtgtttttaccacaatttgaaaagaaagaaatgatggctaccataccattgattccatttaattgattttacccacaagcaggtaccttttctggcttctcctgtattttctcatcctgttgggtgggacctatagtttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggccagcatttaccacctctgatgccagtgcatggggaaaaacaaattgccccatttgcaaacttagtacatatatgcagttaggagttgctctactcgttacacaaaaagattttataagtaaaaaatacttaaagtctggcactaagtttctactccctgtttgttttgattttgatacctgtactctattctaaagacttggtagtgagagtagagcgggaggtggcggggggaattgaatgcctcccaagtatttgaagggctgtctttgccaagagggtttacacttactgtgtatatttccaaagcatacatatagacagaaaggcagaggttatgggaagatcaacttcagctcaatgcaagagataacagcctaattattagggtgtttgtgaactgaacaggctgctttacaaagtgaggagttccccatcactaagttttaagcctaggccaaagtgttttctagcagaaatgtggaagaactcctgaaaggatttagactagatcttgaaggcccctttcaacctaagattttattactcaaacttgttaagatgtgattaacactagcttaaataagttaactatcgagagtcagcctaatgtaatggttaggattaccaggtctgcagccatattacctgggtttgaatcttggcttcttactagctgtgggctttgggcaaattactcaatctctctataccttagtcttcttatttgtaaactgggaattacaacagtacctatctacaagatcgttgttgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcctttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggtaagcggcctctttttactctctcctccaacctctcactatccctcaacctctttctcctttcaatcttggcgccccacttcaatctctcccttctcttaacttcagttcctttccttttctggtagagacaggagatgcgttttatccgtggacccaaaactccggcaccggtcacggactcggaagagtcttcccttggtatttaatcacgcggggatgcctgcctgattattcacccacatttcagaggtgtctgaccacacggggacgcctgccttggtccttcacctttagcggcaagtaccgcttttctcgggggcaagaaccccccaacccttctctccatgtctctaccccttctccgcttttctgggggacaagaaccccccaccccttctctccgtgtctctactcccttttctctgggcttgcctccttcactatgggcaaccttccaccctccattcctcctttttctcccttagcctgtgctctcaagaacttaaaacctcttcaactcacacctgacctaaaacctaaatgccttattttcttctgcgatgccacttgaccccagtacaaacttgacagtagttccaaatagccagaaaacggcactttcaatttttccatcctacaagctctaaataattcttgtcataaaataggcaaacggtctgaggtgcctgatgtccaggcattcttttacacatctgcccctccccagtctctgttcccaatgcaactccttccaaatcttccttctttccctcccacctgtcccctcagtcccaaccccaagcatcgctcagtctttctaatcttccttttctacagacccatctgacctctcccctcctcgccaggcccaattattcctcagcctctgctcctccaccctataatccttttatcacctccgctcctcacacccggtccggcttacagtttccttccatgactagccctcccccacctgcccagcaatttcctcttaaaaaggtggctggagctaaaggcatagtcaaggttaatgctcctttttctttatcccaaatcagatagcgtttaggctctttttcatcaaataaaaaaacaagcccagttcatggctcgtttggcaacaaccctgagatgctttacagccctagaccctaaaaggtcaaaaggccgtcttattctcaatatatattttattacccaatctgctcccgacattaaactccaaaaattaaattccagccctcaaaccccacaagacttaattaacctcgccttcaaggtgtacaataataaagtagaggcagccaagtagcaatgtatttctgagttgcaattccttccctccactgtgagacaaaccccagccatatctccagcacagaagaactccaaatgcctgaactgcagctgcgaggggttcctccagaatggcctcccccaggagcttgctacaagtgccagaaatctggccactgggccaaggaatgcccgcagcccgggattcctcctaagccatgtcccatctgtggaggaccccactgaaaatcggactgttcaactcacctggcagccactcccagagcccctggaactctggcccaaggctctctgactccttcccagatcttctcggtttagtggctgaagactgacgctgcccgattgcctcagaagccccctagaccatcacagatgccgatcttcaggtaactctcacagtggagggtaagtccgtccccttcttaatcaatacggaggctacccactccacattaccttcttttcaagggcctgtttcccttacctccataactgttgtaggtattgacggccaggcttctaaacctcttaaaactcccaaactctggtgccaacttagacgatactcttttaagcactcctttttagttatccccacctgcccagttccctattaggccgagacactttaactaaatgatctgcttccctgactattcctaggctagagccacacctcattgccgccttttcccccagttcaaagcctccttcacatctccccttgtatctccccaccttaacccacaagcataagacacctctactccctccttagcgaccaatcatgcaccccttaccatcccattaaaacctaatcacccttactccgctcaatgccaacatcccatcccacagcacgctttaaaaggattacagtctgttatcactcgcctgctacagcatggccttttaaagcctataaactccccttacaattcccccattttacctgtcctaaaagcagacaaggtttacaggttagttcaggatctgcaccttatcaaccaaattgttttgcctatcaaccctgtggtgccaaacccatatactctcctgtcctcaatacctccctccacaacccattattctgttctggatctcaaacatgctttcttcactattcctttgcacccttcaccccagcctctcttcactttcacttggactgaccctgacacccatcaggctcagcaaattacctgggctgtactgcctcaaggcttcacagacagcccccattacttcagtcaagcccaaatttcttcctcacctgttacctatctcggcataattctcataaaaacacacgtgctctccctgctgatcatgtctgactaatctcccaaaccccaatcccttctagaaaacaacaagttttttcctcctaggcatggttagatactttcgactttagatacctggttttgccatcctaacaaaaccattatataaactcacaaaaggaaacctagctgaccccatagatcctaaatcctttccccactcctctttccattccttgaagacagctttagagactgctcccacccgagctctccctgactcatcccaacccttttcattacacaccgctgaagtgcagggctgtgcagtcaggattcttacataaggactgggatcacgtcctgtagcctttttatccaaacaacttgaccttactgttttgcctagccctcatgtctgcgtgcggcagccgccaccaccctaatacttttagaggccctcaaaatcacaaactatgctcaactcactctctacagttctcataacttccaaaatctattttcttcctcacacctgacgcatatgctttctgctccccggctccttcagctgtactcactctttgttgagtctcccacaattaccattgttcctggcccagacttcaatccggcctcccacattattcctgataccacgcctgacccccatgactgtatctctgatccaccagacattcaaccccatttccccatatttccttctttcctgttcctcaccctgatcacacttggtttattgatggcagttccaccaggcctaatggccacacaccagcaaaggcaggctatgctatagtacaagccactagcctgcctcttagaacttctcatttcctttccatcgtggaaatctatcctcaaagaaataacttctcagtgttccatctgctattctactactcctcagggattattcaggccccctcccttccccacacatcaagttcgaggatttgcccccgcccaggactggcaaattggctttactaaacatgccccgagtcaagaaactaaaatacctcttggtctaggtagacactttcactggataggtagaggcctttcccacagggaaacataattcctcggtttggccttcccacctctatacggtcctataacagactggactttattagtcaaatcacccaagcagtttctcaggctcttagtattcagtgaactaatggtcttttaaaaacacacctcaccaagctcagccaccaacttaaaaaggactggacaatacttttaccacttgcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctcctatcttctgtctagtcatactcctattcaccagtctcaactagtcataaatgccctgctcttgtttacactgctggtttacactgtttctccaagccatcacagctgatatctcttggtgctatccccaaaccaccactcttaactcttaaagtaaataatctttgctggcaaggctatgctgaacctccttaggcactctctaattagacgtcctaggtcctcccaattcttcgtcctttaatacctgtttttctccttctcttattccgtttagtttttcaattcatacaaaaccgtatccaggccatcaccaataattctacatgacaaatgtttcttctaacaaccccacaatatcaccccttaccacaaaatcttccttcagcttaatccctcccactctaggttcccacgccacccctgatccacctcgaagcagccctgagaaacatcacccattatctctccacaccaccccgaaaattttcgccgccccaacacttcaacactattttgttttatttttcttattaatataagaagacaggaatgtcaggcctctgagcccaagctaagccatcatatcccctgtgacctacacatatacatccagatggcctgaagtaactgaaaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcgcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgttttcctgctcaaatgttgccttttccaaaaccacccatagcccaccctgccctccatcctgtgcctgtaaaaatcccaggctcagccggcacagaggagaagcagctggatgttggaaactatggttgtgcattggagagaagtggcttgacttccgagggacagcctggcagcatagcttcagagaggagtctgattgcggacagctggactcgaggtgaagattaccttcctgctctgtccccttttcagctccttttcctgctgagagccactttcatcagcaataaaatcccccgcatttaccatctccaattagtttgtgtgacctcattcctcctggaaaatgggcaagatctgaggtgccacaagtgcgagtacagaaggctgtcacactgaccctccactgagctgttaacacttaagccatctgcagatggcaaagataaaagggccctgtaacactccttctggggattcaagggtcgcgggcaccctcctagacactgccatggggcccacacagagttttgttcctgctggcgcccaaaagcactcaccctggctcctgtacccactcacctgtgcttcctctcccatgaggggtggaactcagtgagactgagccagtggagtctgcccctgccagcaccgaagcggctatgcagtccagttcccgcccgcgaggggatcagggtaatatcctgcttcactactactactactactactactactactactactactactactactactactttagcttcatagatatcaattcttgctttttggttgtgattttgtactctgatgaccagagaagagaacagggacctgtggaatataaattcatggtgaagtacatgttatgttatcaattcttgaaaaaccctgaaatgtagactcatttcccccatgcaggtttgttgtttttgaggaaagaaatgacagctgtgaaacaagtctaaattgtgccctaatgtctgagtgtccaacagtatgctgctgttgaagcaatagcaaagcagagacaaaacctattgtttcctctccctgtataactgaaaccatggccggttgcccttttctgtccatgatgtggaaagctctgctctcatgacctcaaaaatgggcatgtttcaccattcactcagagaagatcctattacagaaaaacaatacccagctgcaatttaactcagagctgagaaaccctctacccaatgattatgggcccacttttgtgatctacctgtgaggcaaaaagaacattctttcaacgatgtgcgtaggatgtctgtattaggaaaactgataaatggaaacgtggaggacttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctccccacttctttcaggtctttcctcaaatgtcacctcctcagtggaaccttccctgatcaccttatataaaatgacaattccttccatgaacaactctctagcgtcttccttgctttatttatttcaacatgctgtcactatttaaaattgttatatgataattgtgtacttgtttatcatctttcttctttgtttttcggttttttttttttttgagatggaatcttgctcagtcacccaggctggagtgcagtggcacgatctcggctcactgcaatctccagctcccaggttcatgccattctcctgcctcagcctcccgagtagctgggactacaggtgcccaccaccaagcccggctaattttttttttgtatttttagtagagacggagtttcaccatgttagccaggacggtctcgatctcctgacctcgtgatccacccgccttggcctcccaaagtgctgagattacaggagtgagccaccacgcccggcctatcatctgtcttctttacaagaatgtaagctctcctgagggcaggggttttgtcttgtttgctgctttattatcaatacctaaaatggcgcctggcatataacagacccacaatagatattaattgaatgactaagtgaatatttaaactcctagctaaaaagtcttcagggtttcttaggtgtaatctggtttaacacaccaagttgagaatcacagaattattagataattaaagcgaaaaaagacattaagtttacctagctcaatacctcattttgaagacagaaaaagtgaaagtcaaaatggttaaatgaggccaggagcggtggctcatgcctgtaatcccagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagagctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgattagcttagtgagttttaaaaaatcatttctacacttctgtgccctacttcacacagttaggatgagggttaaatggaatagacacatctaaaggtgctttgtgaaatgtaaagaattatatacatgaaacctgatcttaggatattcaagaaaattgaccatagaaatgcatttctccaatatactttaagaatcctttgtttttctaccatctgtttagtttagtctgtatacatctaacttttattcccatgtccaacagaactgaagttagagtgtgagagattccttcttcagctaatggaataaatgatatagagctcagtggataaacatgtgcttgagtgccattctagagcaagccctcatgacagctgagccagagaaacatatttcagccacttccctatctcattgcttcatatctcagataatttagaagtatatgattttaaaaatcactgctttctgatcaagtatcaattaacatcctcagataatttgggagggtgtgggattcgtagccggattgtagcaaagttggaacttaaaatggaaaaaaaaaacaaaaagcccagaccgaaagccatccatcacttacacatttattcacatccttgaattctgagatgtcatattcttttgatttttgactgacttctcttctcctacctctgcttgacttctttttcttgaagtttatcaaggtttggtcctaggccatcttcccttccctctttacatgctaagtgatttccattctggatgctctaaattccattttgtatcaatatttttctcatttacgcttctagctcgggtctctcctttgagctataattgaatttgacttctgcacttggacatatcacacacatttcaaactgaacatgtctaaaactgaactgttgatcttttccaaatctgcttcctcctccatctttatcacctcagcaaacagtacaacaagttgatcaaacaaaaaaaacttgggagtcatcctcaatccctcatgcctgacatctaatccatcaccaagtcatacagattttgtctcgaaaatacatctcaaatctgttcatttctctctatttccattgccgccatcttactcccagtagtcattttctttcatcaagacaactgcaaatgcctcttacctggcctctttgcttctactcttgccacattcaatctctcatttatacagcaggtccatcagattgtatgatgttttgcaggtacatcagctcaggtgtactttcacaggtacgtcagattatattatttctctgcttacccataaaataaactctccagccttgtcctgtaccactcaccccctcagtcattagctcctagccatacttgcctccttttaggtcattgtcttgaaaatattattccattcccctccctgttcatatgactgacctaaccttcagattttagcttaaatatatccttttcagagaggccttcctagactatgaagaagttcccactattattcttccaaagtagcctattctttgtcttcataacatttctcactatttttctttttattttatttttatttttttgagacagagtcttgccctatcacccaggctggagcacagtgacgtgatctcggctcactgcaacctccgcctcttgggttccagcaattctccggcctcagcctcttaagtagctggaagtacagacagggtttcaccatgttggtcaggctggtcttgaactcctgacctcaagtgatccgcccgcctcggggtcccaaagtgctgggattacaggcatgagccactgcgcctggagcatttctcactatttttaataatatattaatgctaacatttttactggctatttgtctcactgtcttgcaaattccttggcacgtccaaaaatatttcttcctattttgtgccagacaatatgccgggtgtttggactatgaagatttataatgaaaggtccttgaactaaaaggctacacattggctgggtgcggtgactcacacctgtaatcccagcactttgggaggctgagatgggcggatcacgaggtctggagttcgagaccagcatgatcaacatggtgaaaccccatgtctcctaaaaatacaaaaattagctgggcgtggtggcacacacctgtaatcccagctactcaggaggctgaggcaggagaattgcttgaacctgggaggcggaggttgcagtgagccgagatcacgccactgcactccagcctgggggagagagtgaggctccatctcaaaaacaaaaaacaaaaagcaagcaaaaaaaacggccacacatttagtaggaaaaatcaagaaaaggtttataaatagagtggtagacactgttggttgcctcatcaacaaccattccactctcccttttttctctagtgattatctatttccacacacacaaaaaaaagtttaaaaagcactgatagtcaatttcttagtttcccttgcaggtagatgcagctacttgacctagttctggccaaagagatgttagggagacatgctgttgcttctgaaacatgacaagaactgccactcttcctttattttccattcacactgtcatgatgcaattcctggagtgtggcagccattttataaccatcgcgtgacaattccaaagaccaaagccaaaggctaaggatagcaaatgcaaagatggaaagacattggattctgaatgaaactgttgagctaataaaccaattttgggtatatctttctcttaaattcctattatgtgagaaaaataaacgatggttgcttacattttcattatatatccctttactagaagttaaagcctctataccgacacaaactgttcctgctgtgacaacaatatagccagcacaagtccccccaaaccacagatcccctgaccctggtgtcaagattgggtcttctaattctgcatctgggtactctaggaagctttgtggcttcccatttatatgactgaagcgcgaactgtgtctatatgtgtatgcacacatgcacactggagagaaaggacaaaagatcattccacaattgagacttgaaggctaaactgtaagatggctgtacgtaataaagctctaatcctctattaggctcctgaaatctaggttttatggtttagtaatgttttcattatttcaaagactcagaattctttctctctgaggcatcacaaaagcttccatagaaacagatagagaatgaatgtcacaccaagaataggaaataaagcaaagaaaaatttgcagtgaactagtcattaatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggacgcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagtcttcactttatgcatgttaaacactgttactgttagctaaattgctctttacaacaaggcttacaagatgatgatactatcaacattttgtatatgaggaaactgaagtcttaagataaatctagctagctatggcagagccagaacctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttgttagcaggatatctaatatccattcttgttccattgatagcatttgaaatttatttatcaaataatcacttcagtttttctaaactaccttaaaaatatttttaaaacctgaggataaagaggacacatttttaaactagtgcatttttctcttacaattaaatcgatattccagctgggtgcagtggctcgtgcctgtaatcccagcactttgggaggtcgaggtgggtggatcacctgaggtcaggagtttcggaacagcctggccaacatggtgaaactctgtctctactgaaaatacaaaaattagctgggtgtggtggcacgtgcctgtagtcccagctactcaggaggctgaggcaggagaattgcttgaacccgggagccagaggttgcagtgagctgagatcatgccattggactccagtctgggccacggagcgagactctgtctcaaaaaaaattttttaaagttgatattccatttatttttctccacttaaatacagattttttttatgatctcataaggatcacaatgaatagctaggccttagttttgcagctttagtttcattactatgagagagagagaagggtgagagagagagagagagagagagaccaagtgtggtgagaagacatatgttgtctttgtgggtccagtatttcatccttctactaactgcctggttgttgtttctgtttttgtttttcctttgaggaatcgctttccccatatttcttgtgactctagtagagctgccaatcatggtacctttttgccttcctcaattcccctaaagagttcaaagaccccataggttactcagactctgccactcaggaagctgacaaaggaagaaaataatacaaggttggaaagactttggagcttagtatttcaaagacaacacttaaaaagaagatgcatgtgttcctgcttttgagattttagaactcttatacttcatgtcctattctgagacctagttttcaaattacttcgttcatttctatgagtatcttttaaataaagagcccctaccccatcccctttgttttccctgacttgaattagccagagttagctgctggtgtttataactgaagaccggcagacactgccggttagctacttcaatacctgttgaaaaccacttctccctagccatctttttgttggtggctgtcatgtgacacagttctacacaatgatatacaagtagaagtctttcaaaaaaggtttctgggaaatttttggctttataaaaatgataagactcagatagtacaccctttttgccttctctttttcaccctgtgaaataatggtggctgctatattgcatgaggaaaagtcaataaaaaatatacagatgccagtcctgatactgttgggcccaaagcaccttatttccagacatcttaatattggagataaataaaactctatttatttaagccactgtagatagcttctgtgttttttgctgccattgcaattctaaccccagccaataaaatgggaatatgaaaaacaaacaaaaaatatgaatccttctaaacaatgaagaatttatggggttagggtttgggaggaacagaagatatagccagatgaatttaggcatatctctcaggaactgacctttgtcctttagctattactgttgattagtcttagatggcagtgaaccttgtagctgatgttaatgcaaaactggagaacattgcatcctggatataggtatattctgatactctgatacagggcccttagcttccaaagatgacaattttttttttttttttttgagacggagtctcgctctgtggcccaggctggagtgcagtggcgcgatctcggctcactgcaagctccgcctcccgggttcacgccattctcctgcctcagcctcctgagtagctgggactacaggcgcccgcaaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccaaagatgacaattatatgtgtgtacataaatatgtgtgcacttgtactgagtaaaatagagactgatctcacccatacgtcaattctacttagacaaaggaaatcccagggtttttttttttttttttttttttttgtctctccataatgtgctattaaaataaaatgctattttgtcagtgcctttttcttttgctttcaatcctggactgtaggcaagacatacagtctcctcagagattgagaaaggtcaataatagaaatgctgttttcctcctttcactaactgattaaataacgcatgggcatatgtatagctacacgtgtatttctaaggaaaatcattcaaaaactgcatgatttcctgaggtgacctccagggtgctgaaaatttagaaaacgtaacatctaatgcaatcaataaaatcaagaatctgtgttaggcattttgagagttttggagtgagtgacagtacagccaattgatatagtccccgtgaaaggcaggtaaggcatctttatgtggctctctattgatgagaaaagtcttcctaagagaataaactagatttagagtgtgtcttatgaaaactgttgtttcccccatgccttcccagttaactcatttgtataattttggggcttcagctttgatggggctcctttatttgcaacatttagattaagttaatgactgttttatcatagctaagagcactagaattaggaggtcaatggctattagcatttgattttcttgatgataccaaagagatgagtttgagggggaagaagtgtgggcttgattactcatgttttaatttcatctcagtagacaaatccaaaatgatgtctcagggatgactcagaattccagatgggatatgtgtacttttgccctttgtccagtcctttgcacactgggcatatccactgacaacacaactgtcagaggaacaagctttcaatttccagtttcaagagggaatgagatcaggcttgaatgatcatttatggtgactgaattgctttctccgacaaggaagcctcacttgttcgtggactttacggatggtgctctcaaaaattggccagttaatctctttatctgttgcatctttcctagattccattgtgtctttcgaaaatactgtaaaatttacaaatgtagcttaggcaaaatgcaaatgtgtttctgtcttaaaaagaggaaatagctatctgcaacgatatgggatggagagaaagcgaacaggaggaccgtttagaatcatgatgtaggaaacataatgcaaaattgtaaggctggtgtgggggtatggcaaggataactagtgagagatccccaacggagatgtgaaatttggagaaaagcataggaactgcacataatgcaaagtttccttctctcactttgagctcagtgaatctgggatttgttttatgaacaaagatagcaagttgctttatgatggcagtggttataacaaatgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgacagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaattctcctgtcttggcctctcaaagtgctaggattacaggcataagccactgtgcccagccaggaggaaggaattcagttaagaggctagatcagtgaattggagccacatcatatatattttttcttttttagagatgagatcttgctatgttgccaaggctggagggcagtggctattcacaggtacaaccacagtgcctacagcctcaaacttctgggttcaagagatcctcccacctcagcctcttcagtagttgggactataggtgtataccactgtgcctcactggagctgaaggaggatatttccctgatcccttcgtgggtgggaactggaggggagcaaactccactcactcgctggtccacccctcatggaagggggagcacaggtgagcaggtgcagcagctggggccagcatttttgagtgctggcaagagtgaacaccgtacgggccctgcagcagcctctaggggagggtgcccatgaggaagtgttacagcgcccttttagctttgccattcacagatggcttaagtgttaacagctcagtggagggtcagtgtgacagcctttttcacccacacgcatggcacccaagttcttgtccagcatccaggaggaatgaggtcacatgaacaaattgaagatggtaaatatgggggattttattgccaatgaaagtggctctcagtgggaaggggagctgaaaaggggatggagtgggaaggtaatcttcccctggagtctgaccatccacagctggactcctctccaaagctatgctgtcaaactgtccctctaaagtcaagccgcttctctttgatgtccaactgtagtttctgacatccatctgcttctcctccttctgccagctgagctctggggtttttataggcacaggttggggggtgggtggggggtaatggatggttttggaaaaggcacccttcaagagggaaaacagggatgtaagttctcactttgggccatggttccaggctttttggcttgagggtgggtcctcaatggggacctgccctcttctgcccagaatttccctgccttctgtcctttatcaaagccacatcttgacaggctatggatactgacctggagggagagaaagctgtagctatagaagatttttttaatataatggggtactaggattagatctgttgtttagcaagataactagccatagtgataaagatggataaaagtctggggacagggaggctaatcattagaaggccaaatcattaatagtcactgagaaaggactgagggaagggcagagtagttagagaggaatagctggatttgagtgtttttatttttagatataagagtcagcaaacagaatttagtgaccaaataaaaactgaagataatagagaggaagaagtaaatgtggccccaaattttctaaattgcaatgacatcattaataaagaaagtaaatgcaaggtgcaaaacaggtttgattgtgatatggtatgtaggaaacacaatcatttccattggttgggccatatctggaatattatcatcagttctggatagcttatattgaaagtgtgaaaggaaaataaatcttggggcctcaaaatcaccaaactaaagggaaaagtcaagctgggaactgcttagggcaaacctgtctcccattctattcaaagtcatccctctgctcactgagatagatgcttatctgattgcctcctttggaaaggcgaatcagatactcaaaagaatgcaaccatttatctctcacctacctgtgacctggaagcccctccttgcttcaagttgtcccacccttctggatggaacaaatgtacatcttacatatattggttgatgtctcatgtctccctaaatatatataaaaccaagctgtgccccaaacaccttgggcacatgtcgttagaacctcctgaggctgtttcatgggtgcatattctcaaccttggcaaaataaacttcctaaattaactgagaccagtctcagatatttgaagttcacaaaagggaccactgttaattcttgcagaggaagataaagacgaagatgaaagtcttgactgagggtaattatgaggaacaacagagggaacgaaaaaaatcaatataattgaatacttttacaaaagcagttatttagagtgtataccctgaactcaagttctgttacacagtgggatatataacagtgatgaaagagccaagcttttcttagcttttcgacttagcaggacaatgaaaacaatcaaaaacccaactagttcacatcagcttgaaacgaggatgcttagagaagatacgaaaattgacaacgagtattttacagatgtagagaagtgacgtttctctttggctccagtgggcaggaatagatcaatatatagagatttcaggaaagccaattttcatttattataaagactttgaaacaaccagaactgctccctgggaaaagggtgatttatcatcaatgactgtactcaaactgggtttgaatgaccaaactgacagggattttatagggtcgaatcctgccttaggaagaaaatgaatgattcttaaatccctttaaattctgagattgcatggcagaagcacgatgaagatcacactacctaaaaagagaggatctgatttcaggtcctagaagccttggttttattggcccttagtttccatatctatgatatgagtttagatgagttatttctaaggtttcctgttgctttaaaacattcaatgattttagagttgcttgatgtcgttagaaatattgaatgccagaatgtggaatatttatttaattggataagaaatagaaaaactttgttcaaaaattttaagaaacaatcactattaaagctgcacttagaggctatttatctgcaacaatgagtagacgtaaccatgtcagctaacatttattaaatcctatttcagctagtgagctaagcacctgatataaatgatctcatttaattctcataacaaccctgtaacataggtactattcacagtcagggaaaccaaaccttggagaggttaaaacatttgcccaaggttacacagtttctaagtggtagagaggattcataccctgacagctgtcaacaggaattaatgaaagttctctgtaaagggccagaaagtaaatatttctggctttgaggaacacataaatctccgttacatattcttctttgggtttcgtacaacttattaaaacaagtaaactgtttttagctcccctgctattaaaaaaaacccaggccccatgttgaatttgtactgagacctgtagtttgctgtcccctgctctgctctcttactacaacaccctactgcttccccaagactactatttactgaggacttcttatgggccagacactgcgctaaatgcttttcatgcaatatctctgtaatacaacgagcctctgggttggtttccattttatagatggaaaataggcttagagagtttcagcagcaactgaaacacaaatacaaggctagaaagtggcagagctgtgagctttgtgaatctggaaactgtgattttatccattgcagtagagaggctgagtagagtgaactgggactggggcagggagggactggaataagaaaactggtgtgtagagcatggcaacagcctagacaattatggtatggtttgaaaaacactgtagcttcataatcaactggatttgtcagtttattggatgtcaggcagggtggattaggggaaggtcactctaaggtctgagcttggcttacttagagaacagaaataaggaaatcaggtatagggctgctttgaggagataaacggatgggccgataaagcttatggtggcaagatcccttatagttttggctgcttcactaactagttgtgttatggcaggcaaaaaaattagcttctcttggcttcagtatcctaaagtacaaaacgagggtgttgaattagatggtcccttagtttacttctagtgataatgttccagttggtgaaaagcaaaggaaaattctaggaaactgccaaaagaaagagcctagaataggctttttgagggaacgatttctgaaaaagaattgaacagaagggtgctaaaaagtttattgtaattcttctgtcttactgctctcagcaaataaagatcaaacagggtatttgtgtttgcaaggtcaaagtaaactagtgtccattatcaaatggctgaatgactcttaactggctcagagaaagatcagaaaatgtataggagaaaactaatggaaagagtgattaacgtgatcgtttctggctccaaagaataaggaaacatgggaaatgaagaaatatgaagaagtatgaggcaagaaataaagataatataaatgaacaggtcactatgattatttgggttgcctatttagacaagaaaatagggcatcgataatctctcatgcctcctagtacaattggaaaagaaaactaatgctagtatcactaggaaaagacatagaagaattacttttagaatcatcaaaaaataagtttgaaagcttttgcaaaaagcacagaagtgaatgttttgaagcaaatgaaactaatgggaattataatgagacacatagcagttttataatcttgcctctcttgtaatgtgtcagagaacaagaaccctgctattttaacacgctttgtctatacggtgccaacactgaacttgacacgaagagaagaaagtcctttctgatgagagcatgtagtatctggatctgtttctagactatgtgattcattttaaagatttctaaggaaaggacacatctagatcatctatgacgttaaatccgctgttctgaaataatatcaataatacaaacaaattctaattttatgtatgtgaaaaaaactacttatataaactcatattcattcgagaaacaaatactccaagttggatatcaaggagtttcctttcagttatcctttgttcagtggatataaatgctgtgctccttaatactgggtacaaaaagaaaaataagtttattagaaatatacacatcaaatacacttctgaaaaaaatgagaagctattgaaatgaggtcaactaaacagaaatctatttgtagggtttaaaacaccatgaatgagatcatcttttgtgattccatctatccttgcatttctcaaattctattttgaaatcactgcctatgttcattgcctaaaatagcttttcctttgattcttagatgatcttatgaaaatgaaaatatatataaggctattttgcatagaaatgattagacatagataaatatttacaccaaacagtttagggagtggggactagttatttcagagattatacaatgaaaattttagactgatttaaacatattattttatatgccagtttaggatgatgaataagtaatgaatcactgaatttctccctcccttcctacccccagccttcttcacttctttcctcctttattccttcatttctttattgacatacatacgtagtgtgtacaccccccatcttctaaagtaaccccatgggaagaaacgctcaggtggttatattaaaaaaatcgagggtatgaaaatctcagggtcgtatgcccaaacaccaatgcgatataaaaattaaggtgcacatatatgatttttcaattttttcatttttatgtgtgaatgaatttggaagaaaaacctttcatacactccagactttctgtgttttgtagccacagccttcatttgcaactctgacatggcaagctgctgttttctagatttcatttgtgtgggcgcctgctgcacaccaatatatattttctctttacaaccatccaccatgtggatgcatttctttattagtcaatatatattctgtaggttacattctgcaaatttgaacatggacaaaatgcaatcaatataatccataacactgcacagatgtcttggagagattgcagaaatcattcaccaggaggctgaatgtcgaagaattataaaattgcatttagatggacaagtcagaaaacaggtttaaaaagtagtacatttttaaatttgtgatttcattatgaccatggaatgaggtaaaagcataactgtagtcagcaatttacacttaaatacagaaaatgcaaaagacactatgtacataggaggaaaggaggtatggatgtgagaagaaacaggagggagaagcctaatgaatgatcttcagatgaaaagaatcaatgaaaaatatccagctgtggttaaatgctttcaaattgccatttatgcaattgatgcatggaataggtatttgtcagtgcagagagtgcgaacagaacattattatgaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaaaatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccacttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcacaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaactagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggttatatatctatcaatggagtggattgattagaattggatctgtccaattgcagagcccctgttcctataccgccttttcataaacagatcaaggtcagtttagttggcatgtagtttgtaaaagaaaggagtagcagttagactagaagggtgacttggagtctcctagctgcatttacaaaggcacatttaaggcaccctaatccaaggcatgttcatttccacaagctttaccacaattttttattaataccataaacaccaaaagaatatagtgccatcatcatagaaatccattacattaagtcatcaatgaaaagtatactcagaagttcttgaactctgctcatgaaattcagttatcttttgaatatcataggcatcatagaaaaatgcatgaagtttcaactacatcttacttgtgatactttatcttattttttattattattttatttcattttatttgagacagagtttcgttcttgttgcccaggctggagtgcaatggcacaatctcggctcactgcaacctctgcctcctgggttcaagcaattctcctgcctcagcctccgtagtagctgtgattacaggtgcctgtcaccacgtccagctaattttttgtatttttagtagagacagggtttcactatgttggccaggctggtctcgaattcctgacctcaggtgatccacccacctcggcctctcaaagtgctgggattacaggtgtgagccagcatgcttggccctttttttttttctttttttttttgagacagagtctggctctgttgcccaggctggagtgcagtggtgcaatcttggctcactgcgagcttcacctcccgggttcacgccattctcctgcctcagcctcccgagtagctgggactacaggcacccaccaccacgcctggctaattttttgtatttttttttttttaagtagagatggggtttcaccatgttagccaggatggtctcgaactcctgacctcgtgatccatccgcctcggcctctcaaagtgctgggattttaggcatgagccaccgcacccgatctatcttatttttaaaaattatcactcaacgtacagctcaaatcatccatagtataattttatttagctgaaggatggatttgtcattagttccataactcctgttctctctcttgactttattttttatacacacaacatttaaccagaagacagacccaataaaaatttattaaattatgaaacaggataaaactggacataatgagacaaacaaacaaacaaacgcaaagtggtctaaaatgtttcgatttaatgatgatagcgtaacctgcaatcattcatatatgagagaaggcatcatgaggatctcagctttgggataggttttccaggaagggaactagagcattagtccagccctgttgtttcagcaaggacccctgttagcaatgacaggcatttataagaagtgaggccacactcatcaggtgcagagcacagcaaagctgcatggctcactagagtactgaatctggcatcacgctcatgttatccacttagtaaccaatggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagtatggcctttttctgattttgacctacattacattttgagagtttagagtaatggggaccatataataatattaatcaatcgataattatatatatatatttatatatttatgagatggaatctcactctgtcactcaggctggagtgaagtggtgcgatctcggctcactgcaacctccacctctcaggttcaagcgattcttccacatcagcctcccaagtagctgggactacaggcatgtaccgccatacctggctaatttttctgtgtgtgtgtttttttttttttttttttttttcagtagagacagggtgtcaccatgttgcccaggctggtctcgaactcctgacctcaagtgatccccctgcttcggcctcccaaagtgttgggattacaggcgtgagccactgcacccaaccccgataactttttctgtgtaagggcgtaggtactttaaatgcaaagtgagaaatgcagtattaccagggcagaaaaacatgctctgtgaacttatgtgaattcattattccttacttacaatgattgttcacatccctgtagtaaagaaacttctctacttacaacttcccataggtagcaataaaggtcccaggcacagcagaagcatggcaatgaagaataccaccaacagaggacatcagaacttactttaggccaccattaggttttcttagcctgtgttgtgttttgtgtgcatattttcataatgttttataaatattattattaacaccgctatgttcaaaagtacaaaagagtcaaaaaagtgttcctttaagaaaagacatgcgattactacggcaacaaaagagaacttattgtagaagggtgtacattgtatatattggtcacttttgtatgtcattttggacttaaaaggaaatgaatttccaaacagcccttgagaaccaattctctttgtagagaaaggaggttgtatgttgtctataaattataggatcatagactctttttgtttgttttttgagttagagtctcactgtcacccaggctggagtgcagtggcacgatctcggctcactgtaaccttggcctcctgggttcaagctattctcctgcctcagcctcccgagtagctgggactacagttgcctgccaccacacccagctaatttttgtacttttagtagagacagggtttcgtcatgttggccggactggcctcaaactcctgacctcaagtgatccccctgcctccagagatgatctggctgggcgtggtggctcatgcctgtaatcccaatcccagcacttagggaggtcgaggcgggcgagtcacctgaggtcaggagttcgagaccagcctggccaacacggtgaaaccccgtctctactaaaaatacaaaaattagccaggcatggtggcgggcgcctgcagtcccagctactcgggaggctgaggcagaagaatcacttgaacccgggaggtggaggttacagtgagccgagatcgcaccactacattccagcctgggtgacagagcgagactcttgtctcaaaaaaaaaaaaaaaaaaaaagagagagagagagttgataggatcttaaagtttatcttgtaaaattcccaggtaaaagagtaattctctgtaaaacatctttgtgcaagtactgttgattgtccccatatattttccattttttcttgtggcaatagaactcataattttcagttgggtatgtagatgcctgaaggaaagaatatatttcttagcctcacatagatgtaaatataatcatgggacaaagttctggtgaaggaactatcaggggatacatttcatgacagtttctgaaagattttctcacaacactgctggcacacgccctctctgtgcctccttccttcttccatgttgctgggggctggaactcagatgtgttggctggagctgaagcagacatattggaccatgtggtgacaacgagaattgaggccaccatggcaggacaaggtaaaggaggacttcggacttagtgaagcagaatagcggaaggaggcctgatctacctagttctgggcttgtacatgagagagacctacatttctctattgtttaagctattgttacagtttgtcctattagcagatgaatcagattaaaaaatgatggaaatttgtgaagcagcccatgccacttaataacaactctaacgtttacattttccttactcagagtaagctccactgtaacacttgcccatagttctcttctacaatcttacttaattaagtgtgctgtgtcctttacccaccctccccagatgcatgaagaagctgtcctgtattttcatgttatcttcttactgaacattctagattctttcaaatatttgtcatataaccatcgctatacctttcacaatcttggttgccctgctgtcaatgtattatgatttttcagtgttctcatcatacgtgatgctcataagtcaatatgactgcagatgtggtttaactagtgaagagattaatggaacatttgtgaatttcattaatgcaatctaatactgtattgcctcgtacagtaagccacaccagatcatactggagattaatacagtccttgtggttatttaaaatcccaatttgtttttcatataaagcgccacaaagtcagatgttcctcagcctatatttgtacaaaagactttaaaaatcttaaaggcaggacatcttgcttgttcttgttaaattttattttaatttttttattttggtacagtatcccagtctgttataatcttattttgagtcttgattttgatctttcagtgtgttgactcccattctcacctttgtgtcatttgaaaaattaataagtgcacaatgtatatgcttatctagaaaaatgacaaaaatctgggtcaaagtacaggcaaggaggcaccacttttagggggcactatttatggagggttgtgaaatgaagtagaactgaattcactctgtggttagcaccacaaaacacttctcaaattgacagtttaacacaacattcctccttgggcatggttattgaaacatcaccaaatttaccaaattatatttctctccatgtataattcatgtagtttaataagattgtgagcagccacgtaaaaggcactgctgaaattcagatacactgctgcagcataacaccactttaaaaaagccagttaagttggcaaagtaaaaaaaaaaaaaaagcctacaatattaaggtgaaaactttacaacatgactctagtgaatattaaagtctaaaataaaggaaaagaaacagttgctcaatgtttccaaatacggtttctcccagatttatagttttctttatttctttattttattattattttttgagatggagtttcactctgttgcccaggctggagtgcagtggtgcaatatctgctcactgcaaccttagccccctgggttccagcaattctcctgcctcagcctcccaagtagctgggattacaggcatgcaccaccacacccggctagttttttttgtattcagtagagacagggtttcgtcatgttggtcaggctggtcttgaactcctgacatcaaatgatctacccacctcggcctcccaaagtgctgggattacaggcatgagccactgcacccggcccccagatttatagtttttaagataaaagcgacaagccaaattaatgttttaaaaagctcgaaacatatggggggaaaaattaaacaaagtgccaagtagtgaacatacagctaaataataaaaagtagtcatactgatgctttgttattcaaaaatcatttttcctcaaagagtaagggtgaaaaattgtaaggactatcccactacatgttcaattaaatgactaaattaatgtagagacatttaattaaagttccactagtttttccaaatgctattaattacgccgctatctaaaattaaatctctccccaaacccttttacatttcttccgctcatctgatacagacataattaaaatgctgcaagtttacctaaacgcatccaaatattataaaagaaaatatgaaaaactggagtttcagtagctccttaagaagctggaattttaatgggatttctacaatccttggggaaaaccaatagatgtgtaagcaggcatgcacacacacacacaaactgtctcaagattcctctgaaaataaatttctctctttatatctaaggtgctgcagtgaataccacagacaactatagtttcaaaggttttctaccagcaaaagacaagaatttttgaagacactgggtaattaattgcaggcacaaggtgtactctagttataacacttctgtgctaccattttcgaaacaataagcattccttaatagcggctcagaaaggcactctttaagagaaacagtttggaattcaggcttccttgtattgtatccaaacttccaaatggaaaaaaaccagcctggacaatcccagcttcattctatatgcaagttattctccagtgagtaaacaaaggttgatcctaactcccaaacttattttattaatcatatacaagatgaaaacacattgatcaaacaaggtctactaacatgagacttctcttatttcctttctcttacttgattctgacagttgtccttttaattgctctgcacggatagtattcagccatctaaaatcaacaaattctctatttaccccagtcgtcttccagattgctgtaggttcattatgcaaatgttcctttaagaaatacagagttactccaggaatgaccactacctgccattactatggagtccagaggtagggtcaggtacaggctggggtcttttgaaagtgacttgtctcttttccaaaatttcatttgcttctaatcaagagtctggtaaattaggaggagtccttttctcactcatcatcgtagccaaagtctcatgagacaaggctgggtctcagtaggactgtgattcatgaaaagtcaattatggataaattttgtttaccaatatccttcctcattcctggttctgcttggcaaacagccatccctcctcccattctcttattacaagggtttgcaaacttcaccgcactttgtaatcctggggattttcaacaaatgctgatgcttggagcccacccccagagattgaattggtctgagatgcagcctgggcatgaggagctttataagctgcccaggggattctgatatgtggtctgcgctttaggcctgtcaaggtgggataacaacttgataataaaggtttatttcctgatcagttaaaggggttaccacatctcaaagaaatattttgcatactcaaaggacctgtaatggaatttaagttaaataatggtgttacaatatctgtaattaattttaaatatctcaacatagatagttggatattttatatgtgcagttagtgcaaccttcaactctagaggcttgaggcaaatggttattttaattaggaattcatattctaggacagcacagccttcatcttatgaaaaaggccaaaacccagagactgctactactatatatctctgtgaaccttggaggattttgtaatgcatgtaatagatatcgcaaatgtgtttttgctgagggaaatagtggattgcaatgaatatccctataggatctcattagtaaaatttaagacaatcaagatacatggattaactaaaatattttaatgacatcccctaacattgcataaacaggatataagaatccagcaaaacctgttgcttgggcttttaattttacgtctggtctccaatggccttgtatccaaccattggcttaggaagaattcttgtgacctgatgccaaatctaaaggtaagagaatactgtatttgcaatggtgtcaatttaagcctaaaatcctacacttcataaaaattgtagaacaggctgtaagctgacttctgcctgccttctaacaaatgttggttaacgacatgattgcacttgtggaggacttcagcatgaagcatgaagctgcggcttgaggtagccattcctcatccacctcaaacacatctgtggttctccattatttcccaaaaagaacctaatagttgcacgtgacctaaattcacttaggtcagttcacagcaggtggaatttgaggcagtgtgccaataaaatgagcggtaagtaaatatttggggtaagagggtcttctgcacaacgattaaatagttctaggtgattttctaatctcctcatttataagagtggtcccagcaagaacagagactgaaataaagtggtcgtttcaaagctttaaatactctgctttcagctactctgtccacttattcaaagacaaacttgaaaggaaacaggagcccatattatagcacaggcttttaaatttgtcaatatgaggaaccaggaaatgccctgttcttcttcggggctctttcatttagcttgcattccaggaatgttcatttgttccaagcaacattagaaattaatggggtaagtgctgggtgaatgtaggtaatcggtataaaggctgctttcttgagttaatgcctgagaaatcaccaagcctataatttcttttttcttttctttttttcttttttttcttttttttttgagacggagtctcgctctgtcgccaggctggagtgcagtggcgcgatctcggctcactgcaacctcctcctcccaggttcaagtgattctcctgcctcagcctcccgagtagctgggactacgggtgtgcaccaccacgcccagctaatttttgtatttttagtagagacgagtttcaccatgttggccaggatggcaccaagcctataatttctaaagtcctgtttcatttgaagtttgaatgcaaaagtactaatgactgcaggggagggatgttttctatatcttaagaaatacgtaaataatatgtggcatagcttctgatagtactgcaatataactatctataactaatatatacagcaaatatattatcacttcttttttttttttttggagacagtttcactattcttgtccaggctagagtgcaatggtgggatcttggctcactgcaacctctgcctcctgagttcaagtgattctcctgcctcagcctcctgagtagctaggattataggtacccaccaccatgcccggctaattttttgtatttttagtagagacggggttccaccatgttggccaggctggtctcgaactcctgacctcaggtgatccacccactgtggcctcccaaagtgctgggattacaggcgtgagccaccgtgcctggccctattattactctgcatgtttctgcagagatctgtagaaaattaaaaaaaaaaaaaaaagaatgctggcttataaatggagtagattttctggaaaatgaatgttttagtccgttggaatgctataacaaaatatcataaactgggtggcttatagacaaccaaagtttttttctcacaattctgaaggctaggaagtctgatatcaaggcgctggcagattcagtgtttggtgaaggcctgctttcttgttcatagatagcaccttcttgtgttctcatggcaaaaagggcaaagcagctctctgggtctcttttataagggttctaatctcattcatgtgggctctgccctcatgatctaatcacctcccaaggggcctacctcctaataccatcatatatggaattaggtttccacatatgaattttggggagacacaaatattcaagccacagcagtaaggcaatcacaaaatagggcagttagatttaagtgtaatatactagggaatgacaatgagagagatgtatcatcaatttctttgccttctcccctatcatcagggaaggtacctaactgctccaaggccacatgactccatgcgcaccaatagcaaaaactacatccaatgctttataggttaggaaagtacaggttcccacacttatatgtgctcacttccatttcttgctgcccctctctttatttacgaaaggatgagaacttgatccacaagtgatttcattgagatgtaactcttattttatccaaagagaagtgttggaacatgctttgattatcaggtgagggctctgtgcacattttcatgcaaatgtcttagattggtaactctcctccaatgaatgcaagaccttctgccttcggtgatgactaaggtggtaacagttatcaggtagttgcttggcactgacttatttactagacattctttttttttgttttttgtttttttccagagagtctcactctgtggcccaggccggagtgcagtggcatgatctcagctcacggcaacttccgcctcccgggttcaagcaattctcctgcctcagcctccccagtagatgggactacaggcaccaccaccacacctggctaatttttgtatttttagcagagacacggtttcaccgtggtggccaggctggtctcagactcctggcctcaagtgatccacctgccttggcctcccaaagtgctgggattacaggtgtgagccacattgcctggcctactagatactgttaaggcaggcatgtgctaaacaggtcacatgacctctactatccctggaattataatactagttagaacaatagttttcaaactttgaccatgacctacagtaagaaatacattcatcatagttacttagaatacattctccacacgtatacattcatgggtgtatgtgtgtgttgtttgtctaaaataccacttccccaggaaactttccaggcctactacaccaggtcaagtccctctgttatactctctcagcactctgcttttgtcctttctaagtactcattacaattggaatgaaataattgcataacaaagatgttgaacccatctctagatctgtattctagggctttctgagggcagggaccttcttcctctcttatagaacagcagtataggaaaaactgacctgaagcaataacattttgcacataagagctgcttaattagtacttgtgacctgagtaaatggataaagacctcagcaaggagatccctgggtccttttcttatttggaaatcttgaggtagagctggagtaggtcatccaacatgttcattggcatagcttacagaacaacagcatcaacatggtgccaggacagataggatgtatctggggagcaaggtgtgatacgagagcgggatgtattattaatagttctaccttttctcattattttttcagggcttgaacatgtttcttgttggtatccactcatatttattgcctctttcttcatctcatttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttggtcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatcaaacttcttcttataaccagacgtggcttcatgttccagcaaagcaagatattcccaggccataaggtaacaaaggcctgggacactgtggtgtccacatttctcacttctatgaatgagtgcccacaggaatgtgttcataacatgtaacaaagtcaacttgtgagttgctgatacacatctctcttatgtcatacaactgctgccattagcgattcatggcagtgtccttgcccggcagtcatgcatatccaaatgaggcatactccctagctattacaagagtcctgtctggctgcaggcattgactgacttctcctttttatctcaacttaaaatcagtgccttgctcccatccagtgccacatgaaatccaaggaatcaaagtgtaatctccgctgccactcctcatgttcaaaacatggaccattatgcaatattaaagcatgaatcctggaactctgttaatgttgtgaaataggtgagtagttagcaagaattaccattctgacagtgcagtggaaaaacttcattcattgtaaaaagcagggagttgagtttctatatggggttgcctttcacgtcccctccccttgcagagataatgaaaaaatgcccagctatttttcagatgtgatgtttactttcttttccaagaggttctttggaggaatacacagaaatattttatagaaccacaaaataatagaggtaaaataagctttggaataaaataagcaaataagactagtttctagtctacgatttctgggaaaatgcgagaactttagttaaacttgtttattttattctaggtgaattttattaacttaaaggatcataaaataataatgatcatctctacttttaaaatccacatttctatcaattattatatgcatattccagtgtgtacagataaaaagatattcaagtacaactaaacctagagatttcatcagaaaataatccccaaaatgagctgctattgcaaaatggaaaatatgatgtaaacaggcattttgggctttcagataaacagcataaatttttgaacaggatacgtcttgttttccacaaagagaaaaacaaggtgtagtgaagagcgttgaattgtgtctgatttctgatcttgcttttaacaaatgagaacgtctcagctaagtcaaccagaaactatttcctaatctataaattaaagggtttggcctagataatttctagtcttttctggcttcaacccctccctgcttactctctctctctctctctctctctctttctatatatatatatacacacacacacacatatatatatatatatatacacacacacatatatatatatatatacacatatatatatacacatatatatatgtatatatacacacacatatatatatatataaacacacacacatatatatatatatatttttttttttctttttctttttgagacagagtcttactctgtcacccaggctccgggttcaagcaattctcccacctcagcctcccgagtagctgggactatgggtgcatgccaccacacccggctaaatgttttttgtatttttagtagagacggggtttcaccatgttggccaagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaacctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaaatctccaaaccactgggcagttataagactttttttttttttaagctcaaacacaggtcaaggctataggtgggagttcttgaacaataaacaaagtgagaaatggtcttaattttttgttattgctgctttgaatgacacacagacacatgtactaacacaggcaagactcttgctgcacggatatatgtatttttgtagaaaagatcaaactaaaatgaattcactgcctggcatcatgttttcatctgccttccattttccacaagggtgtactccacttgcttagacttaggcaatttaaaaattcttgatcttaatgtcctctaaaatgtacagactttatagcttagattttaagagacaccattacctgacagggtaatgacagttttatttgcactggtgactggatttgctgtgatacttaagcaataatacaaataaaatgataatttttttgagaggatgtcagggaaggagaaagaaaagaacaaaatgcatcgcatttaacttggtttaaaaacacaacacactgcagcttcccaaagcttcttattttactggaaaaaaaaatcccttagcaattcatcttcctttgggcgcatgaatgacattttactgtgatgtgattataagaaacaaaatccctcggagatgctgccttaaaatatttttctttataatgttctgagctcgacaaaccttggtagaaaacagaatactcttaattatgaataaattaactaaattagtaacatgagatggatatgcaattaagggattgttaattgaaactggaaacacagctgtatacagcttagagatgaatcataccagtaatgacgcagatgtttataaaatgtgattatctttagtggagacagcgctgcatctcccaagcccattcttatattgtgtcactgaaatggtttttaaacccgtgaacaccaggaatcaggatctcagggacggcaaattaggctccctggatatgggaattagtgttgtctgaatgtcagcaatttgattctccagctttcaaagaatgtagatatggagccaacaacaaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgccgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggtttctggacaaagcttgtggcattattcaaaccaacaactattaggctggatggtgcttacaaagatggaagatggtagacatcagttttttacgtaaagtgcaaactaaccactgtaaggtgtagtcaaaaaagaaataatacataattttagatattgaccaacagaagatatatttgtcaccttagcttagcttctctttcaaaattatcaatgtccttaacaaaatctagtgctgtaaaggaaaataaaacaacagatagtctgacattagttaatactttcctctatcaaaaggatgcagaaaacttagggcatcctccttgaattcaggggagaccttttactacaacgtttaacgaagtatttggatgacttgaggctcaaataaacaactcagttttccactgtgttgactgtgggcatatggggtgtagctgagttgtgagtctgttaaaagaaaatacactttcaggaatgaataaggagaaaaacgcaaacacataaaaagacacaccactatatatagttttctctctatgttggatacctataaatgtgggatttgttgaattttgatcacaaagtctttctatcctatgtgttagtctgcacaagtacaggctttgcctataatttcagtattgatttgctgttatacaggttccaacttgtctaaatttcattacctgaagggacagcttgcaattccatatacaggtataataaaagcaagatgagtacatgcatactgtgagctctgaaaaggcactttttctacaatggctgtgccaaattcttcatgagactgttattctgttgcaaatggtgataagaaagccaatatcatacattatttactagcatttgtactaatattttcaattctgaacctcattataatcacacttgtttcagaacccatttgtggacatacccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgttaaaaaaaaatatattcccaagtctattgcatcagaatctccagtgaaggggcttgtgaattaataatttaatcaagtgcccctggtgattcttatgaccagaaaaccttgggaaagacaaacttaagaactttaaagtcaggtatctgttactggcctctgaaagtattctaactgacattccatctgcaatctcctgtttcaactggccgcagctccaggaccactcaggtaagcagatactagctcttgccttggcaaatatattatgaagtcttagcttggagagcctttgacttaaagtgaggtttacatttctaagatgttggtttcttgacttaactgtctatttgaattcctgatcttttccattcagagcctgtttacccgaactccccacttcagctacagtctgaattcctaacctcgtgtacattcttgatcagtgttatctggtggcctcaccaaccctgccagaatttcagagcccctctcaagtaattacaggggtaatcatgcattccttaactcttaggctgcattcttagggggcagattcctacctactaaccttgaacctgctgatgcccatgaggctggcatgaaagcaggaacaattagtctgttaaaaactaaacatatattcctgaagtctgaaaaaaggttctactcatccaaatagaaataattgagaactctaaaatatttaactttaaatggtctggaatcatcaatgttctttcaggttgaatgaatattttacattaaaaactttctgtcccttgtttacttggccaaataaggtaaaaaggtcaaaacaatcttagtgaaattgtttccttatgaatgacaaatgtaaagagtcaaaagaggaattaaggtaaataatttaattatatttcatctcccctaattacatgtttttcatttgcttagatattacttatttcacctctgctgccttccccaccatatacccgataactcagtcattccagacttataaactacctcaggttatatcagatcttcccagacctggttttcttcctagaaaaccattccatttttttctttacctcttggaaccctactcattgctcgagtctaagctcaaatgtcaccccttgtgcaaaatttattgctaactcttctgcacattaatatcatttctggggggctcacatctctagtggagcccttgtaatactgtatgtagttcatgtattaatcatctttgaagggagcctgtgtcatgtacatctttgtccctcctattgggtagagggtctcgagactaatgtagtcactgataaaatactgaactgaacttcatgcaaaagtgatttctgagaaaaggcattaaccaaatagtgccttaattttattacttgttttgcaggttttatgtacttaattgcaagtaggaggctaatgaaaaatgtttagtttttgcagtgtggtggtggtgaggggcatcccagcttgagtggtagaggtcccagcttaacacagaaatttagataaatgtggcaaattggtgggatgggcaatgtatctcatctgcactgagagaaaagctcaaggtgtaaccatttctggggctacatgtctagtcatctctaagagattggtggctccccagacatccattgcagggacactaaggaggtctcttaggagaaggcgtaatgaaagaacatattataaaccaggtgctttgctcagtagaaaagcctcggtcaacaagagaaagagaaagagtggttttgagaatactgtggtgtctgctacttagatttatcttctggttcagtcatatctgagtcccatgcatctaagtcagaattatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttgtacatctggctcctcacttgggatggctgcggatcttcggccaacagctgggggctagccacgtatttgtctttccatgcagcttccccatgtggctagcttagatttgtggcttcttcatgtagacagcacagtggccttagagtagacttagtacagggcagatcactttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggggaaaagaaaacaagagtatctttcttccccacaccctggggattaaacaatactccttttgggcctgtctaacaggacaactcatcccattttcccagccctagatcctgactatcagcagagaattcttgtgcttggtgtaagagcagaaaaggctggaaaggcagcgataatgaccaggatcagcatctaactcacccagtggcaaaggggccaccacccacagaaggtttaaaagtgtacactcaacagataagcagtaggtagcattcataatgggaaaatatgactctgaaagaaaatttttatgtggcactgagatactttgagatgcatgatcaatgaaggacctaattcaaagagggtaacattaaaattcccaagtacagcacagccacaaaagctgtagccacatgggcaactttactgcccctacagtttaagtgtctgatgggaatgccagacctaagaattggaattgggggtcctgacttgtttgaagcaagttaaggtcttttttttttttttttttttttttttttgagagggagtctcactctgtcaccagtctggagtgcagtggcatgatctcagctcactgcaagctccgcctcccaggttcatgccattctccagcctcagcctcccaagtagctgggactacaggcgcctgccaccatgcccggctaatgttttgtatttcagtagagacaggatttcaccatttggtcaggatggtcttgatctcctgatctcgtaattcacccgcctcggcctcccaaagtggtgggattacaggcgtgagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttctttcttttcttttctttctctctctctctttctttcttttttagatggagtctccctctctacccaggctggagtgcagtggcatgatctcagctcactgcaacctccacctcccgggttcaagtgattctcctgcctcagcctcctgagtagttgggattacaggcatgcgtcaccatgcctggctaatttttgtatttttgattgagacggggttttaccatgttggtcaggctggtctcgaacgcctgacctcatgatctgctcacctcggcctcccagagtgctgggaccacaggtgtgagccaccgcacctggcccaaattaaaatattttcattgcaaatacaaaataccaagaggttctatatataatctttgaaagtaccctttctatttaaagatcaggattttttttcacatgtctagaaagaaatttggttcaattctattcactatgtatttattgggaacccattagatgtgtaatataatcaaatatcaatagattatagaaaagaagagagtcctttttcttacaacccagcagggcggaaaggattaaattcttcttataaagggagaacaaatagattagaaaagacgctgcgtagtcaagttcagaaaagtgagaaagtttagaaaggtttcatagagatgaactgcagttctaataataaaacttaacatttttataacatttgatagtttcggaagcagtttcacagaccttatctcattgcttcacatggaccttgtaagacaggtgggatttggataagtagttcctttaaaaaatgtcttcgaatattgtacatttagactgacaaatgcctttattagaataaagggaaaaggtatgtgagagacatagagagcaaattttgggttctagttccacaactaactagctgtgtgaactatgaactatcatgtggtgtctttgtaaactcaagggttggatttctggactttctgtgctgaagtgtaaaactaaaaatattaaaatattcagtaattcaaagtggatattttaaaagcaatgaaacatatcagtagattcaattgttttcttatttatttttatgatttgatattttatatttttagatttcaatttttattttagactcaaggggtacatgtgcaggtttattacatgggtatattgtgtgacactgaggtttggagtacagttgaacctgtcacccaggtagtgagtatagtactcgataggtagttttttcagcccttgtcccacaccctcctgcccttgtcactagtgcctgttgttcccaactttacatccatgtgtacccaaaggttagctcctgcttataagtgagcacatgcattatttggttttctgtttctgctttaattcgcttaggataatgacctccagttccaaccatgttgctacagaggacatgatttccttctttttcatagctgtgtagtattccatggtgcatatatgccacgttttctttatccaatccaccattgatgggcacctaggttgactttatgtctttgctattgtgaatagtgctgcaatgaacatatgagcgcacgtctttttggtagaaaaatttatatttctttgggtacataccaagtaatggaagtgctgggtcaaatggtagttcttttttttctttctttcttttttttttttttgagacagagtcttgctctgttgcccaggctggagtgcagtggcatgatctcggctcactgcaacctccgcctcctatgttcaagtggttctcctgcctcagccttccgagtaactgggattacaggtgtctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttatttttatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattacttcaaatgatccctagttattcaatttacatactggaattttacaaccctgtttagttagtcccaggcttcaggccatttaaaacaaaagatatagatgaatagaagagtcactcagcttgtcttcatccttcagatctcggtcaaaggtcacttttattgggagggtgtcctgattgccctttcctgcctctcacccttactgcagcgcgcgcgcacacacacacacacacacacacacacacacacacacacacacacacacacacacatttaggtccttactatatattctggtagtgtcctgtattttctttcctgacacatttgtaattattttatgagatttaaaaaattactgtctgtcatcccaagaaaccataacctccatgagggcagagaaggtctgtctatgactgaatccctatcatctcaaacagagtttggtaaagagtagacaccagaaaaaaataattattgaatgaatgattgaacaaaggaggatttccgttcacttcagcaagactttgatgattcaaccctcttggtcctacagaagagtgattctagtttttagtctgtgaatgattcaggctctgagttaaacaggcaattcttgagatcgtggtctgaaattcatacaaccctcctactttaaatttcctcaactcatgatccaggtgattcctgacaaattaataaatgtgagaatgatgctgttctttttgtttaaagggtcgaatcataaatgaataggaaatgttgtcatgtcaattcaactttttatcagaggagtggtactgcatagttaggagttctgacagattccccaggcagactgtctgggttcaaatcctggctctctcacttacctgatatatgaccacaggcaagtcacttaacccttgggctcctcatttttctaacctgtaaaatgaggttaaaattgtacctccctcactgggttacgtgaggcttaaaagcattagcacatgcaaaagtgcttataattgtgaatggcatacagtaagtgctaggtaagttctcactattaatctcagtaagcgtaatgctcactaaaattattttcaaatttataccatatgactacattgattgtctgaataaagtaaaactatgtataaaggctgtacttctgatataagaatcatcttctaatttattatatttccaccctcccgtctcctttagtaaattaattaatatattaagggagaggacaacttatatcacagtgatcattatattaaggacattatagcatttataaaaataaagaagtattatgataaactgtatgaatttgaaattcactttgtggtatttacctttaaaagtagcatttctgaatttcatacgctagtttccattcccctttatggagttggctttaacacgcagcttctcatgtggcctgaaaggggattctttctactttctagaggaatgtgctgtgaaggaggagtcgggaatcttactggcggccatgtgagaacagcagctctttgaatgctgggtatgatgtagcatgggaactgtgagcagctactggcggagtgtttcacatgcagcgcagcggggcagtgggaaaggcaatgaagaaaacaaccagtgcaaacaaatgcagaagaaagggtggggcggggtcaaactccagggaaggagagaggtcagcccagagagacaagaacacttacaagaacaaagaataaagcagtgagaaattggagacaagggcaaatgtcagttgcagaataagggaaaaggacaagaaaacatgaccatcatggcaattttaaatgcctggaattatatacatgtttctagtaaggaactagaggtctcaggaaactaaaataaatacatgcatgcataaatacattttgctatttaaacacatttactaggaacacattccatttttaaaaacaataataaacacacttacatggattaccataatagctagccttagaactagcaaaaatagttcccgattaaaacaaattagaaattagtatataaagatcaagcaatcaagtagcctaattaatactttataatgatttgggttcactttataaaatatctgaaaataataatatgcttttcattctcttaaattcataaatatttctttggctcctgatggcttcattcccattttatacttcatataattttttcatcacattctgtacatcgttcatttatccccctgtagtttcacacatcctgatgccttcaaaaaaaaaaaatagagaattcccttgaaaaccagaccattcttctcctagggtgagaaagacagactctggaatatttgggccatattagtttcaaggctacctgagcaatttcgataacagtcctcttgactaaagtacaattagttgtacaaacattgaaaaccaaatgttcttaagcttgacagtacgctttgacctcagtatgctctaagggtggtcactaacctgggcatttaaatttatactctccttcttcaattctttaaagggttttgtttacatcctttttttcctaacagagttgaggttaagcataaatgattattctctccttactgaaaagatgttttcctggaacttaattgtccttttttcacgggtcattctattcctaatatcaacaaatccttctgtgacctaaccttttcaaaaacaaacacatacttctttcttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgttggaaaaaaactggttagtttttttaaaatgaagccacacaaatactcctattgtttagctaactatgatcccatcacatcctctcacaaagcttactactatgactatatagaccaagtttccagtaagaaattattgaataatttgtaaaccagagataataatgggtactgcttttgtagtatcagtgttatgatagtatgtaagtatgtatatttctggtttttaacactgagaaaggatgagaggggtgggccatcatggaagtaataaaagagaacccatctttaaagctttacttaatatagcataagcagtaaagggagttttgtttagtatgtccttggaccaaacaggatcattacaatgtcttctaggtacacagtagatgctcaatcagtgctgactgaatgaaagaacaaagggatgaaagaaggaatgaagtttgcaaaagatgaggctctagatccctgcgacagcaagttaccacagaggtatacagatggagtgtaatgatgtctacatgactttggaagaagcttaggaaacctttaaaaaacatacataatttatgatactgttctttgacatatgtaaagaatctaatagctggaaatgccttcatattattcagattttaaaggtgtttgcattccatgagttcctacagtcaataaaacaaatactccttatgttaaagtgtttttgcagcttttgtgctatttgtgggtttactcatgagtaaagaaaaatggtataatattcctttatatactacttgcgcttggtgaataaagagattgactgcattactcagtgtgtgtactatttcaaaattagaaaggtttatcatcattttaacttttttctcacctggtttagatattcgtttctacttggtcaaatattagcattagtttggctttaagagctgattcactgaaatcacttttggctgattttagtacaattgctgagttctaaaggcaatgaggaatataatgctttaaaattttatatttgaaacaagtgtgatttctaaggggtacactgaactgggttcattaatccattggtttataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataataggtaatcataatcataatacaaaatcacaaggttgtgattcttagatgagagaatgcacatgaggactttttctaactgcaaggagtgatggtttcctacaccacaaaaagtcaaatggtcaaatagtaacatgcataccaatgtgtctactttgaggaagaaaataggacttcattcccacagaaaatttcaaacaggcaaaccaatgtctcttacatttctattagaagattcaaagtcagtttggaattctctatacattatgattctatacataggtaaattgtgactgggtttgactgtattgttggtgctcacatcccttaactggtttcaccattttgactgatattacagacagctaaaaaactagcatggctttccttgaaaattaaatgaatggataatgcaaagaacccaggatattctgatatcaagtagacacggcctgatagtatgtaactctaatctttctattatactattttgcccaaatttaagactcttcttcttttctcaggtttacatctgcctttctactactccagttctctatttttattttattttattttatttttgagaccgagtctggctctgtcgcccaggctggagtgcagtggcacgatctcagctcactgcaacctctgcctcctggtttcaagcaattctcctgcctcagcctccagagtagctaggattacaggcacgcaccaccacacccaggtaagttttgtatttttagtagagatgaggtttcaccatgctggtcaggctggtgtcaaactcctgacctcaagtgatccgcctgcctcggcctcccaaagtgctgggattacaggcgtgagccaccatgcccagagagttctttactttttgattgttctttgtcttagtggacagaggcaaagatgaacttgtacttggtttttatcacgatttaaagattgacatagcattgtgactaaattctttattttcatagaaatatgtcttttttgacatttactatttaaaaaaatatgatgtcataatggtggtgggctcaagcttcccgccatagaacttggataatgcgttagcctcacatacattgttctaaatataaaatattctcaacaggatgtatgaattgcttttccagtaatgggaaaaaaattgcttgatgtgaacctcatttcttgctttcttctctttctgaacaaggcctcacatttataatgtagcagaattactatcaaagaaaagaatggaactaacttgactcggttatatgcaaaccaaaaccttggatttatcagctttctgctaaaaacactttttaagcatatctttaaggtcatgttcaaaaatagaaacatgaaatttgctacaatatagagcagacaccacaaactgaactgtttaataggagaaggctgtgtatatgtgggtttagggaagaagagattaaaagttagagttatacaaggagaaatataatttcaacaaaccacatttgtattatgaataaagaaaggaacttcattggttttaaactaaattctgtcaaatgtgtatctcccccagatatctagagacagaatcataagattgaactgtatgtgaccttagacaaaatagatttctgcattttaaaaatgaggagaattaaagctgagagaggttaaatggctttctcacaataacacggtcaaataatggctgagcttaagtttgaagttagacctcctaatagtcaatccaatgctcttttcgctatatcatactatctccttacatgtgttttcctgtacttataaccaagtttttactcattgtaaagaatggctacatagtaagctatttactgtttttgataccttaaatgcaaataaatagtgcaactagaatggatcacttagcattgattaaaaaaaaaaaaacttttcttactagtcataatcctttgacctcatttggaaatctacctgccactgtcacaaatcttttaccacgttctgaaagcaaacgtggcattctgctctctaaaagaaattataaaatatacttctagaacacttatatgggactaatgtggccattggttttctttggacatttattactttccttatttatacttaagatgaaaaacatactaaggatggaacagataaaattttaatagtactcaactactatggagcaaacagagaaaggcatataatcacttagctatatcgccttgctttagtcgatgccacttataacaatctagaatacaaatctttcaggactatccatcacaacaagaattaaattatgtgagatctcaagaggtctgggatttgcaacttatctttattaaagatctagcaattctttaacaggcctctcaatcacacccctaaatggactgacaataggaaagtgatttggtttattatatttttcttattaaaaagttaaaaccaaatagttttaaacccagtttcctcagaggcataccttctgcatcctgttggaaaggagaaaattggaaaggagagaaaatgattctctaattctacggttaaactaattttagggttttggggtataacatggtgtccttcacactgagaaggtagacgcacctcttccaccactacaaccattactctgcatgaattaactcattcgatgttacagtaaccatgttagagatgagtaaatggacaaccacagagattaagtggcctcaaggtcactcagctaatatgttggattccaaaacctgtgtactgtaataataataataataacaacatcaagagctagaatttgtagagtgtttatcatttggcatgttcgctcccgagcactttccatttattttgacttattcatcctaataataaactgatattgcagagaattttattatcgcatttttttttttttgatgaaagactgaggctcagaaaggttaagtaatttgctccaggtcccatggctagtaagtgtgaccttgagcagcacacttacattgcctgtatttattacgcaaacctacgaaaaacttccacatgtaagtttgtgataggatgctctttctttaaatgacttttggacacatcttactattgactcttgtttaaattaggattctaaagggaaagatgtttttgagaatccaagcagtaagagtacaaaggaactgcatggtggcaattcacatcttccatcatgattcagcattattttctgtttatcgtaagaatactgctacacagagtttggatgttccctctaactcgcgtgttgaaatctgatcccccgtgttggtggtgaggcctagtggaaggtgtctgggttgtaggagtgaatccctcatgaatggtttggtgccattctcacggtagtgagcgaggttttgctctagcagttttcatgagaactggcacctcccctccctctttttctcctcctctcttgccgtgtgatctttgtacaccagctcccctttgccttctgccatgagtggaagcagcctgacgccctcgccagaagcagatgcttcttgtacagcctgcagaactgagccaaataaacacctgttctttatgaattacccagccccaagtattcttttatagcaacactaaacagactaagacatatactaagtcttagttgcttccaaaattaatattaataatttgaaaatgtttagatgggaattataaactaatataaaatatcctatcctcacaaatattaccatgaacattacatgaaaaaagtactttcattgttctttacaaattttatctgtatattattttactgtaacaaaggacaacaatgtttacaatgtgcttacctgcagaagcttccatctggtgttcaggtcttccagagtgctgaggttatacggtgagagctgaatgcccaaagtggtaagctggcgagcaaggtcattgacgtggctcacgttctctttcagaggcgcaatttctcctcgaagtgcctgtgtgcaatagtcaaaagcaaattggaagatgagaatatttaaaacaagaagaactgatacctgggcttattctctttagggtgcagtgccagtaatgtttgctctatgctacggtttgaatgtttgtgtcccccctcaaattcctatgttgaaatcctaaaaaataaaaaggaaacgaaatcaaaacacctaaggcaatggtattaggagatggggcctttagggaggtgatttttgggattagcgcccttataaaagagacctcagagagctagctagctcctttcagcatgtgagggtgcagtgagaaggtgctttgtatgaggaatgggccttccccagacaccaaatctgctggtattttgatcttggacttctcaacctccagaacagtgagaaataagtttttgttgtttcacaagctatccaatttatggcatttctattatagcagctggaacagactaagacagtctcttgtggtagtattataacaatggatatttgttaatgggggaataatgataactactatttgttgagcacttcctaggtgcctaatgccatgatgagctctattcatacataaactgattttatttctacccaacaatcctatgaggccagtagttggagaattctaattttatacatgagaaaacaaacttgcagaggtttgttttcaaaacaaacaaaccttgccaagctctcatgggtaaaaattgaggaacctgggatacctatatgcaggtttgcctgcctctagaatatatattcttaactattatgttatatgcttcccctaagaaattctggattggcaaagtaacaagaaaaatatattgctgctggattctaaattctactcatgtcacaaccagaaatggatccttattttttacaatagaaagatatattcagtcataaaatattgcatgcatactttgcaccaaccacatcataacagtttcatttagggagtagggtattttgtcaagtcctcagaatgacttcctgatctcctggtattttagcccttgtagcaatgacttcagaaggctcccgtggggcttctcagctgtctttgaagcactagagcaggagtctctgatgcaatacatcatagcaatccgttgagcagaagaaccctatgcagatatggggaggatattaccacgcctcatatctaccctatcgagatggcatttatggatctttaacatgatgcatgatgtccaaatgttccaataagcaatttctaagggacaaattccctcacttaggagaacagtttgtgtaatgtaatgtctgtgtacaaggacagcaccacttgactatacgtgttgttttgacttgcttgatctgggcaggtgttatttctctgtctggttcactatgttgataaaaccattggttacactgacctcatttataagccttgcatttcctcccactccaaataaaaggagccagtatgaacattcaaaataagaacgacattatcctctcaaatcaacctgaatacttcatcagtaaaccgtggtgctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaaggacaacggttacaaaatgaaatcattctcttctggataataacgtgcatttctagtagccacaaataaatatcatgtgaggggaaactgtaaacaggaacctctgcagagagggcaagccagcaggcagcatctttcagtgatacaggtgagtcctttgtgctaatcatctctctttacaagcaagactctcaagccattaagttgattatcctacctcgttaagccatagctagatttcagttccctttaggtgacacaatgtacattttcaaatgtctcttattagaatattttgattttcattttctctcccaaattcctgagcacacatattaatcctgcttcaatgttttggaggatgaaggggattcaaaaataagttttggtactcataattaattgcaatgctctcccttttcctctttttttttctttttaaaatttacttttcttctttaaactttaccataagatcttgggattttttttttttttttttttttttttgcttctttcaagcaatgatagtggaagttctctgaactaatctccacttaagactcaccaaattagccaaagtcttcattctctttgtgaaacagcagtgatgggaacctctcacagcctcaataaaatgttcgaggtgcctgtcagtatgtgtggaccttctgctcccatcagttgacttgttacaaccgtcagttgtgtgtatgttctcaaacctatctttgccagtaactgttgtgattatgtaatttaataaagaaagatttcctaaatcataaaaatattagtttaaaaagaaaagaaaaaagttattatttctataaaaaccaggccaaatactctggagagttgcttcaaaaagaaaaagaaaataaatattgttgaagtagttgtgaacaagacaactgctaaagatgaagaaaacaacccagaccaggtggggtggctcaagactgtaatcccagcactttgggaggctgaggtgggtggatgggtggatcacttgaggtcagcagttcgagaccagactggccaacatggtgaaaccctgtctctactaaagatacaaaaattattcgggcgtggtggcacatgcctgtagtaccagctactcagggggctgaggcatgagaagcgcttgaacctgggaggtggaggttgcagtgagccaagatggcaccactgcactcactccagcctgggtgacccagcaagactctgtctccaaaaaaaaaaaaaaaaaaaaaagaaaaaatgccaaatattcagtttaatctgaattcctaaatttctgttaaaatatttgacaatggaagctttgactggtgtgaggtcagttgataaacagataactgggggcaaaggttcactttggggaagtctctagatggggttgagcagactaaaggacttcagtcagctagaaatcatcatgagggcactcaacgcatgaaggtggaagaaaggagataacagatggtaggaaagataaaaaggaaaaggaggcaggagaatgctcatgtcagtcttcactttggcatttgatttaggttttggtagcagcttttaccacccaaggatggctcaccactgtgggctctcagtgcccagcagcatacataacaagaagtatggccgcctaaacacagagtcacaagaccttcaccctgtaaagggtgaacacaggtactttgctatttaaatagatgtgacattggtttggctatatttcacagattagagcttttaatatgacacacataaatttgtgtttaaattattaaacactacacctaaaatgtcaaaaagcacagttaacgctgagcaatacgaggtgctatttaagtgatatcaggattgcattaggttttttttctagtttggaagcagtaagtgagaaaacattgaagaaagccattatattgtgggttttctttgaatcacttaaacatctggaatatgttctccatgaaagagcaaaccaagtctaattttattatgactagtttctcacaggcagaattttcagttcattaaatgttgtctgattatagatacaaaagtactgatttagaatgataggtaagtctgatataataagtttttcttcatataaaattaaattgcctgtcatatctttgcttatctttatgtagctaaggatttgttcaaatacacatttaaaattatagtcatctactacttttctaagaaaataaaggaattgtctattaacaagggaatcttatttttgagggaggaattttgacttgacagttaagagaacattcctactgcaaagcacagaaggtcagttggaaagactagaaagagtaaattgagggaattctgcttggaggggttttatttcctctgtgaagtaggaatcaacagacctggcatagtctgcagtgcctggcatagcgtgcagtgcctggtgtgcaatgaatagtcactgaatgaaaacatgaattaagggtaagtgggaacatttgaattaatcgtaatagagactgtgagagggagttgacctaagagatgtaatgaggttggcaaacagtgttgagggcccacttgaggatgaggttcaacattttttagcagaaccaatctgcctgactttctcattttctccaacagtgttgcatgtaagcatggggaaaacagttgatccaggtttggggtttcgtcagatgactgtggctcacacatttagggataagggagtttcgatattagccaggatgtaattgaaaaaatatactgtggaatctaaactggattaggaggaaagcaaagcaaaatgaagcttgtagatggagagaaagtagaggggtcagttgtagaagtccaggataatccataaaaggccacagcaggagtagctgcacaaacaagcgacagagaggggagactctgggatgctcagattagctctactggatttgccacttatgagtttatttataaatggtgtgatatatatatatatatatatatatatatatatatagatagatagatagatagaaatctggctatatatatataaatatatatagtgctactcagtgtttgaaaaacttcccttcttagggatattaaatattcctcctaaaatcttaacctgctaactcatagacgtcctatctcacttactaggaattcaaaattactaggttccaaaaatgaagtgttattcttgggctacatacacgtgcagagaaatttatgttacaaatattacttaagtagggactaatggcattgctgtctaccatgaatccttgtcaaacaaatgtttgttaaccaagactcttggaaaacagcctaaaaagaggaggtgctaggaaagaaaagtcccagcattcttcatgctgagctagtcatgagaaggcaaggatgagcaattagaaatcatgtcctataaatactggtgtttagtacttattccggggctcttcctcgtggttcagggaagccctcacagaatgcaattacccgggaattggcagcaggtacagcccagctatgttttgcagctcctgcatttctcagcagatatatcatcctcatggggccaagagagtcaaggactgtatcttgctttttccagaggatcagaggcctactggaatctctcaaatacctgggcggaatgagctactcaaatgctgttgaaacaattaaaaagaaacacaagttgagctgtaagcaagcccttcatgaaatgtatcaggctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaaggggttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagacttttcttttcttttcttccttccttccttcttttctttctttcctttttttatacaggagacttctttctttctttctttcttcctttctttttttcaagagacttctttctcttttttctttccttccttccttccttcctttccttcctttctttcctttttttttttttttttccaaggtggagtttcactcttgctgcccaggctggagtacaatggcacgatctcggctcactgcaacttctacctcctgggttcaagtgattctcctgcctcagcctcctgagtagctgggattacaggtgcccgccaccacgcctggctaattttgtatttttagaagagatggggtttcaccatgttggccaggctggtcttgaactcttgacctcaggtgatccacccacgtaggcctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaagaaatttagggcttttatttcccaagcgattatcagtaattatattttaactatggtttcttctcagactcaacacgcttccaaatttgtgacattaaaaaaatagcaattaactgctctgtgttttccataaagaatccacatctttttataaaaaacaatctcaaccaggtgcggtggctcacgcctgtaatcctagcactttgggaggctgaggtgggtggatcacctgaggtcaggagttacagacgagcctggccaacacagtgaaaccctgtctctactaaaaacagaaaaattagccgggcatggtggtgcacacctgtaatcccagccactctggaggctgaggcaggagaattgcttgaacccgggaggtggaggttgcagtgagctgagattgcaacattgcactccagcctgggcaacaagagcaaaactctgtctcaaaaacaagaacaaaaaactctagtttctctttacaatatcgaaaaagaatatatacccaaacataaaaggataactttttctttttaacattttctctttgcactgatcataattcttcatcttttaggacatggctttctatgaagcttgtaactccaatgttcttataataaaagccgaattatatcttggccatattaacagtgtctatcttctttcttttctgggtgctcacatttccttcatgtataaaatttggaaatgaggaacagggaagtattgaccacaaaggaaaagtttttatttttaagaacaagttgaacatagcaggagcaattgatattttgcaaaccatacacccggtaaggggtcagtattcaaaatacacaaggaactcctacaactcaatagcaagaaaacaaatcacctgactaaaaaatgagcaagtaacctgaatagacatttctccaaagaagatatagaaatgagtattcagatttatagacaggaaatagaatggtggtttccaggggctgggggcaggaagcaatggggaattactgtggttttttcttttttgttccttttgagatggagtctcgctctgttgcccaggctggagtgcagtggtgtgatctcgatctcagctcactgcaacctccgcctcccaggttcaagcaattctgctgcctcagcctcccaagtagctgggattacaggtgtgcaccaccacgcccagctaatttttgtatttttagtagagatggggttttaccatgttggccaggctggtctcgaactcctggcctcaggtgatccgcctgccttggcctcccaaagtgttgagattacaggtgtgagccaccatgcctggtggggattatcgttgaatagacatagagtttcagttttgcaagatgagaagagttctggagatggatggtggtgatggcagcagaacaacgtaaatgtatgtaatgccatggaagtatacatttaaatagagccaagatagtaaacttcatgtaatttgtattttaccactatttaaaaaatcaaaaataagtacaatttgtaaaagaagaaacttgaacaaattttattaatttccttgggaaaatgtttctataatcctaactgcaactgccagttatctcccctttatagacaaaaaacaagcaaaaaaaaaaaaaaaaaaaaaaaaaccacaaaatacttcaagctttccaatgacacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcagaagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattacaggcgtgagccactgcgcctgaagttttacatttaacaagtttttgggcttgcaatcatttcttggtctgagccacatgtgttaaccaccattgtccctgaatgggccctctccctcccctaaatagctcaaaacatcagtctaaggcagtgattctcacacaatagtgtgcatctcattgtcatgtggaaggcttgttaacacagagactgctgagtcccacttagtgcttttgattcagtgggtgtaaggtgggcctgagaatttggcatttctaataagaagttagaaaatgttgagttcctagaactcatcaagctttttatttctttatttatttttattttatttttcagacagggcctctttctgtcgcccaggctggagtgcagcagtgcgatcatagctcactgcagcctcaaactcctgggctcaagcgatcctcctgcttcagcctcccaagttagccaggactacaagcacacaccactggcattgatatatatatatttttaagttagttttttctttttcttttttttttttttttttgcgagatgggatctctctatgttttccaggctggtctcaaactcctgggctcaagtgatcctcccacttcggcctcccaaagtgttgggattacaagcatgagccaccgtgcctggcccaagcttactcttgacttagaaccttcagatacactgttccctctgcttggagttttatatatccactttatgcctagctggctcttattcatatacttctgatctcagttagatgtgacttttaaagatagcctattcccagttggttgccctacgtaaagtgtctcctttttccttgactctcaacaccctattttccttctgaaccctgatcacaatttgcaagtacatatatatttgcctattcatttattcattgtctgttccttcccaagaccagaaaatttattaaggcaatcctacattattgtttttcaccagtatatgccaagccatagtacatgataatccctcaatacatttttattaaagaacaagcagtcaagagaattaggcacttctgtactaattactaatacttcagaccaatagctattgtcagactgcttcgtaaacagtttctcacagaaacctgacatagagttcctaaataagagaaagctacccattttccttatcccatatctgaattatttatatctatcacttgatttatattggagcatttgctaatttctgaagcatctctcattctttgggcaagaatataacatttcagtttttggtctctaccagggatttttaaaataaaaatggagtgagtgggaaaaaaagaggaagtagcctattcaaggaaaatatattctgcttggtggtggtggcacaagttagtgcatcttttggagggcattttaacaacactgaataaaagcattaaaaatatttacatatgaaaagactagaagactacaaaccaactgaaatccagcctgggctctactaccaaattggttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcatttacaaatattttccacttgtgtagaaaagggatagtaacatgcatactttagggctgttacaaagatggatgagaagtttaggcatatttctccttcttttagttcacatatagtcacacaagttcctattcaggctagtccagggagactctgcaaagcagtaggtaataagttcatccatgagagagtcacagactaagatcctttgccgggtagctacctttttggagctgatttctcacatcgccccaggggcaacctctatcatgtagccttataaacgtctcctcgaactagacattggaaagtaggtacatgaaactgataaagaggaagcatagtgtggggaagaaagatatgtgttcagaacttgaacaaagggtaagaggtaggaaagtttaatgtgtgtctgaggaaaagcaaatagcctttaataacttaaaatatgaagtacagggcagctgtaaaagatgaatcatgggtgttttctgggatcaagattgtggtgggtcttgaatgaggtggcctttacaatgtagaatgaagatgtccacaaaacgggaatggcattttctcggcaactcttagatttaattactactcacttgaaaacacttactttatatccactagatactgtgcccacatatatgtgtgtgtgtgtgtgtgtgtgtgtgtgtgtgtgtgtgtgtatatatatatatattatatacctatcatccactggaaaaatggaagtctcaacacactcacaatcattagcagaggtacacaatttaatgggtcattaaaaaaaatgcaatccatattatgagaagttgagtcataggggtttggaaggtgcagagaaagatgctgatggaggggaagagagacctcctgagtagataaggtgactgaaatcattcacagaggggaacactagaagaggcatgttcctctggacatgaaatagtcacctggaaaatctcaagtagatcagtataacttgtggtcattgtggaaaggagaagagacacagagtgtttgtatgcagagacaagaagtaacaatggccagaaataagctggtggcaaatggagcaaattatttgcaaaataatttttaagggtcacgctatctaaaagatagcattttgccctatgcttttgcacaaatttgtttattcatttattccaaaaactattattgggtacctattatatgccagggaatgttctaggcactggaaatacagcgtaagatagaccaagtctctgtaatcatgcagcttaaggctaatggatatcatttcatttaaatgatgactattaataactaggcttataaagaagcaaattccaagccaaaatatatcatggctataaaatacaatttttgaccaagaaaatgcaggacaaagtataatattgcagatagcagtctcaaagagattctgttttcacttattaaagcaaattaagctacctctgcatgtctgaataatgattaatagaggaatctagaattgtgagttacccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagcctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctcaccataaaattgatattttcaagatattattctgatttttatgatcacatcttaaggtaatatctaaattcatatcctgtaatagtctgttatgacaactgctatcatgataatgtccagttaagtacatgcaaatgatgaataaattactacttacacaaatgagtctaagtgtcaagctgtctaaacaacgttctcagatgtgatttccaaaaaaaaaaaaaaaaaaaaatcactcattggccaaatctaccctttagaaaaagtgattgatattcaactaacagatatatttaatagtaatagacttttttctttttcaaaataggagtatgatttagtgccctcaaaaatctgtgggggtgatgctgcattgattatctaaaggagaatacaatttcagtaggaaaaagagttcaaaactctttttaaaataatcttttcactaataattcagtaattttagattcaaagtgggtcagatttcaccaagacccctcttgcatacaacaatcaaccccaaaccctaggcagttttataggagaaacgactttgcaaatgtcttccttcaacctttatacaaaaaaaaaattgagatggttccaaaggtaatattttattcacagcataagccaacggagtaatttatgctcatttgtttagcctgtatttcttttaaccttatgctttattggatgcacaaaagtcaccctgatattggataacctttgtggagattctagtatattgggtttgtgaaagtctaaaacaatggaccattctctcccttgctttagccccatccctgctagaaacatgtgaagaccaaaaaccaactggcaagcagaaggtgaagcaggtaaaatgccgttgcatacagtctgcttgcttgggggcagataagaaacttaaatcacaggtcagttaaatgggtattatttaataagacctaataggctttaggttcacaacaatggatagatctcaaaatgggttacaatgttttaagagtaggaaaaaagtaaatgaaaggaaactcagcagtagtttatcattggttctaaaaaaaacacatcaatgtattgccaaagactctcattcacttttgtttctacttaattcctgtacttcggcatatattgccaataaattgacttcactctgttcactaacttgcttatgccgtgttaagatcatgatgatagaatgtgaatatttgatagggaaaagttctaaatgagtcatttgagtctataatgatgcataatcccggaaaaccaaacttctaaaaataagtgtgtttcgaaacaggactggcaggttcttaactttatgaagaaaaaaaattaccataaaaatcaattccttaaaagaaaatagaaatctgtcttagtgttagatcctccagcctcattctggttaagagaatttggcgtttcagggctgagcacactgtggaaacttaataaatattgaggtttacaaacaaaaagcataacaatgatatgtggaccaattttcaacaacactgaaaatcaatgtgcccttactctgcctaattcagttaactcaattatttaatgtacacttgatttgagtgggtttgaccatagctatttccattttccattgaacattaatcaaattgcttctaatgtaaaatttcattttttctcatccttctcctctcccagattctaggataagggaaaagtttaagtttcatgtctcttgtttaaagttaaaagcaaattttaagacatctgtttccattagtttatcccataattctcttttcatataccactcaccctataccacaaccatgaactttttcacagatatttaatacattgttttttgcaccattttgggaaaaatcctccttcctcaaccacttcagctaagactcttttctactttctcccagttgatcccacatcatctctatttcatctctatttcacctcatctctatttctatacacaaaaatataccctccccctgaacacagagcctcaaggggtggacaaagtaagttataaaatgtaggcactcctggagaagctgttagctattcatatctagcaagtagattttacttaaaaagtgttgactgatcccaactatttttaatatcctagattcagaaactctataaagtactattttatcatcagtatgtttggtagaaaagtgtaaggagaatttttaaatgtaattgtttttattggtaaatgcaaaaaatatttacacaaagtgaaaagttatgtgactaaatatatatatagtttgagacaaggtcttgctttgtcactcagcctggagtacagtggagtgaacagggcacactgcagcctcaacctcctgtgctcaaacagtcctcctgccccagcctttcgggtagctgggactacagacacatgccaccacacctggttaatttttgtattttttgtccaaacgaggtttcactatgttgtccaggctggtcttaaactcctgagctcatgcaacccacccacctcggcctcccaaagtgctgggattacaggcgtgagccaccacggccggccatgactaaatatttttaacgttaaaaattaatactgggaaggcaagttatgctgttggtcatctgaagcaaccccaaaattgtaccagtgtcattaaaataccaacaggaaaaaatgaaataaaccaccgtcaaagtcttccacaagtgagatttagaaaagaagccatttattcatttcaaggttcctaagcgaaacaatgctccctatgatgctcccatatctaaactattaatcaatccaacaagaggctgtgtgcctgcattcatttttaaactaaatcttctggatattgataaatataaaagaaataataaatgatatatttattacttgtaattgaagaaacgctaacactacacaaaatatgtcttcaggtacatacacagtagctttactatggaatattggttctcagaatgtatctctgaaccagcagcatcatgaacacctgggaacaagttgggacttcttagccttgccccagacattttgaatcaggaactctggggaaggggttcaccaacctgagtttctacaagccctccaggtgattctgatgtatgctgaggtgagaaccattgccactgaaaattcttgacattctcaatgatgtctggacatgtctgaatgcctagacatttacagattccataactataaagccaaactcacttatgaggccattttcttactaatagtgatcactttcttagactttttcattcattaactcttctcttccatcactaattctgatgaacagctatcaagctattcatggtagggtggagggtaggtggattttccataaagaaacaaaattctcattatttataaagaattactgtacatgcaaaaacaaaacagcattaaaaaaagccaagttgaatatgaagagtgagtggattactaggtttacttattagttgcaggggacactttacctaacctgggcatccatccttcagctgctgtgatggttgactattaatgtcttatagctacctgccttctccacatgtgacctctgcttatgggagccccctagcccaggaagtaacccatatcccaggagtggaccacagccagtggtgtgctgcagcagagcccaagagccaattgtgtgcatctcctcccaattccatactcagtggcattatgtcggtagctggagatcagtggtagagggagtatttacaccacgaaaactggttttgatacacaccaggattcatcccacctcagagctagtcgacaaatatttgccagcacttcagtgacacagacaatgactggtataaaggcacaactccggctcggtgttgtggcttacgcctgtaatcccagcactttgggaggctgaggtgggcagatcacctgaggtcaggagttcaagaccagcctgactaacatggtgaaaccccatctctactaaaaacacaaaaattagccaggcgtggcggtgcatgcctgtaatcccagctactcaggaggctgaggcaggagaatcacttgaacctgggaggcggaggttgcagtgagctgagattgcactccagcctgggcaacaagagcgaaactccatctcaaaaaaataaaataaaataaagagtacaactccacagcgaggtttctgctcgagggcttgctctctctctggatcagacacaatgtgaggtttcacctgaaatggcatacttgctgggctctttcttctcctgtattgtttccctaactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcaaaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctctcggaagatgcttttaaatagaaaaacctgcagtaagtgtaaactataactaaaaatattattttaacatgaaaaaatcttattatgaaaaagttctttcttaggccccattaaaatgagagagacattagtatcacagacacaactgttcccataatacccagaaaactgatttaccaagaaaaattattcaatgccattacttaacttagttaatttcaggttgtgtaaggcataatactggtgtcaatgctaactgttaaattttgaaaattgtaattgtcaagcatgacaggaagaagcgaactccttgggttatttgatcttaaagcatttcctgttttactgaacggtaggagagtaacagaattgtgaactttattcttgtcacaactttggtagatgtcaaaaaataattaaaaatatatattggctgtgtgattccattttcttaggaaatatggaatttcagttaaataaataactcacattttagcactgtttctagttaatgtggtacatgcacatgtatacacaagctaatacaaattcttgctccctcagcttggtgctaaataataatattcccaggaaaactaagatgccatctatacaactctcaatataatttttgtttttgaaataaattaaatgttcacactctataatgagatcagacttctctgggtataggtttcaatcatatcatgaattaatgaatgagtgcatttgtatatcctctaatactgagagtatattacttaagttttttgaataatcttttattacccgagactcttgaggaatagtatttctagttattacccaccacaaacaaagctttcagaaaatcctagcaaacaggattggcatattataggatcagatgttgatatggttgttttcaaatagtaggaaggatggtattatttggagaaatttttattatctgattaaacacttcttgagtagaatcagatgaactcattagctgaacattttgattacccgtgttctcctaaatatcccatgaccagaagagtagctgtacaactctgatttaatccaataacaataataaccaattctagctccttcttttatcacagtccatcaaaataacacaaagaagtccaaattaaaataagttcaatgacaaaaagaacatgttccttttccaactgttctaaagccttttcctgtctttaagcaaagttcattcagtcattatctcatctatgaaagtaaaagcagaaggatgtttcccttattaaataaatggctttatgctttcgatgtggaaggcatttcataacagtcaaaaaaggaagcgttttgaatgccatcaactcatttcctcccacccactgttttaaatcgtttgtttggttccaatgtatactacacttacataagttgtttatgaagagccaaattaatagtctttgcaattgtttttgttggaatttggagagctgacaagtgaattagtagaaaatggcaattctacatgaattagcttttaagtctccctaagaggctgatgcagaacttaataagagacttattaggagaagtaggacaacttaattcagattgattatagacttcggtgaagacagctggggttcaaatgaaactgaaaaagaacttatatgcacttcaaagtatgctaagcagatgtctgaaacaattactccgctctgccttttcagaagtttcaaaggcgggatgggaatagcatggtaaacgaaggttctgtttgcctaagtcgaggtaggggcttttaaaacacacacagcgctatctaaaatcagatgctttggggaaagaaagtgatttgacattgctgtcctaagtaatttgcttttagctttataaacaaagcaggagatgagagggaatacatggtaactaagtaataagctctcctggcaacactaacttacaattaatttcacattgaataaataatttggtcaggattttttttttattattattatactttaagttctgggatacatgtgcagaacgtgcaggtttgttacataggtatacacatgccatggtggtttgctgcacccatcaacctgtcatctacattaggtatttctcttactgctatccctcccctaacctcccacccctcgacaggccccggtgtgtgatgttcccgtccctgtgtccatgggctctcgttgttcaactcccacttacgagtgagaacatgcggtgcctggttttctgttcctgtgttagtttgctgagattgatggcttccagcttcatccatgtccctgccaaggacatgaactcatcctttcttatggctgcatagtattccatggtgtatctgtgccacgttttctttatccagtctatcattgatgagcatttgggttggttccaagtctttgctattgtgaacagtgctgcaacaaacatacatgtgcatgtgtctttatagtagaatgatttataatcctttgggtatataaccagtaatgggattgctggatcaaatggtacttctggttctagatccttgaggaattgccacactgtcttccacaatggttgaactaatttacactcccaccaacagtgtaaaagcacacctatttctccacatcttccccagcacctgatgtttcctgactttttaatgatcgccattgtaactggtgtgttttgatttgcatttctctaatcaccagtgatgatgagctttttttcatgtttgttggccgcataaatgtcttactttgagaagtgtctgttcatatcctttgcccaatttttgattaggttttttcttgtaaatttgtttaagttccttgtagattctggatatcagccctttgtcagatgaatagatggcaaacattttctcccattctgtaggttgcttgttcactctgatgatagtttcttttgctgtgcagaagctctttagtttaattagattccatttgtcaattttggcttttgttgccattgcttttggtgttttagtcgtgaagtctttgcccatgcctatatcctgaatggtattgcctaggttttcttctagggtttttatggttttaggttttatgtttaagtcttgagttaatttttgtataaggtgtaaggaaggggtccagtttcagttttctgtagatggctagccggtttacccagcaccatttactgaatagggaatcctttctccattgcttgtttttgtcaggtttgtcaaagatcagatggttgtagatgtgtggcattatttctgaggcctctgttccattggtctatatatctgttttggtaccaataccatactgttttggttactgaagccttgtagtatagtttgaagtcaggtagcatgatgcctccagctttgttctttttgcttaggattgacttggctatgtgggctcttttttggttccatatgaaatttaaagtagtttttctaattatgtgaagaaagtcaatggtagcttgatggagactgcattgaatctataaattactttggacagtatggccattttcacgatattgattcttcctatccatgagcatggaatgttcttccatttgtttgtggtgtcctctctcatttccttgagcagtggtttgtagttctccttgaagaggtctttcacatcccttctaagttgtattcctaggtattttattctctttgaagcaattgtgaatgggaattcactcatgatttggcactctctttgtctattattggcgtataggaatgcttactatttttccacattgattttgtatcctgagactttgctgaagttgcttatcagcttaagaagattttgggttgagacgatggggttttctaaatatacaatcatgtcagctgcaaacagagacaatctgacttcctctcttcctatttgaataccctttatttctttcccttgcctgattgtcctggccaaaacttccaatattatgttgaatacgagtggtgggagagggcatccttgtcttgtgccggtttttaaagggagtgcttccagcttttgcccattcagtatgataatggctgtgggtttgtcataagtagctcttattattttgagatacgttccatcagtacctaatttattgagagtttttagcatgaaggggtgttgaattttattgaaggccttttccgcttctattgagataatcatgtggtttttgtcattggttctgtttaagtgatggattatgtttattgatttctgtatgttgaaccagcctggcatcccagggatgaagccaacttgatcatgctggataagctttttcatgtgctgctggattcggtttgccagtattttattgaggattttcgcattgatgttcatcagggatattggcctgaaattttctttgtctgttgtgtctctgccaggttttggtatcaggatgatgctggcctcataaaaagagttagggaggagtccctcttttcctattgtttagaatagtttcagaaggaatggtaccagctcctctttgtacctctggtagaattcagctgtgaatccatctgttcctgggctttttttggttggtaggctattaattactgcctcaatttcagaactcgttattggtctattcagggattcgatttcttcctggtttagtcttgggagggtgtatgtgtccagaaattaatcaatttcttctagattttctagtttatttgcgtagaggtgtttatagtattctctgatggtagtttgtatttctgtgggatgagagctaatatcccctttatcattttttcttgtgtctgtctgattcttctctcttttcttctttattagtctggctagcagtctatctattttgttaatcttttcaaaaaaccagcccctggcttcattgattttttgaaggatttctcatgtctctatctccttcagttctgctctgatcgtagttatttcttctcttctgctagctttggaatttgtttgctcttgcttctctacttcttttaattgtgatgttaaggtgtcaattttagatatttcctgctttctcctgtggggattttaatgctgtaaatttccctctaaatactgctttagctgtgtcccagagattctggtccgttgtgtatttattctcattggtttgaaagaacttattcatttctgccttaatttccttatttatccagcagtcattcaggagcaggttgctcagtttccatgtagttgtgtggttttgagtgagtttcttaatcctgagttctaatttgattgtactgtggtctgagagactcttatgatttctgtttttttgcatttgctgaggagtgttttacttccaattatgtggtcaattttataataagtgtgatgtggtgctgagaataatgtatattctgttgatttggggtggggagttctgtagatgtctattaagtccacttggtccagagctgagtttaagtcctgaatatccttgttaattttctgtttcgttgatccgtctaatattgacagtggggtgttaaaatctcccactattattgtatgggcatctatgtctctttgtaggtctctaagaacttactttatgaatccgggtgctcctatattgggtgcatatatatttaggatagttagctcttcttgttgcattgatcactttaccattatgtaataccattttttttgtcctttttgatctttattggtttaaagtctgttttgtctgagactaggattgcaacccctgctttttttttctttccatttgctgcttggtaaatattcatcgatccctttattttgagcctatgtgtgtctctgcacatgaggtgggtcttctgaatacagcacactgatgggtcttgagtctttatccaatttgccagtctgtgtcttttaattggggcatttagcctgtttacatttaaggttaatattgttatgtgtgaatttgatcctgtcattatgatgctagctggttactttgcccgttagttgatgcagtttcttcatagtgtgatggtctttacaatttgttatgtttttaccatggctggtaccagtttttcctttccatatttagtgcttccttcattagaagctcttgtaaggcaggcctggtggtgacaaaatctctcagcatttgcttgtctgtaaaggattttatttctactttgcttatgaagcttagtttggctggatatgaaattctgggttgaaaattcttttctttaagaatgttgaatattggcccccactctcttctggcttgtagggtttctgccaaatgatccgctgttagtctgatgggctttcctttggggtagcctgacctttctctctggctgcccttaacattttttccttcatttcaaccttggtgaatccgattattatgtgtcttgggttgctcttctcaaggagtatctttgtggtgttctccatatttcctgaatttgaatgttggcctgtcttgctaggttggggaagttctcctggataataacctgaagagtgttttccaacttggttccattctccccatcactttcaggtacaccaatcaaatgtaggtttggtcttttcacatcgtcccatatttcttgaaggctttgtttgttccttttcattcttttttcagtaatcttctcttcatgctttatttcattaagttgatcttcagtctctgatatcctttcttttgcttggtcgatttggctattgatacttgtgtatgcttcacaaagttctcgtgctgtgtttctcagctccttcaggtcatttatgttcctctctaaactggttattctagttagcaattcctctaaccttttttttaaggttcttagcttccttgcattgggttagaacacgctcctttagctcgtaagagtttgttattacccaccttctgaagcctacttccgtcaattcgtcaaactcattctccatccagttttgttcccttgctggagaggagttgtgatcatttggaggagaagaggcgttccggtttttggaattttcaggctttttgtgctggtttttcctcatcttcgtggatttatctacctttggtctttgatgttggtgaccttcagatggggtttttgtgtggacgtcctttttgttgatgttgatgctagcagtcaggaaccctctgctgcaggtctgctggaatttgctggaggtccactccagaccctgtttgcctgagtatcaccagcagaagctgcagaacagcaaagattgctgtctgttccttcctctggaagcttcatcccagaggggcacctgccagatgccagccagagctctcctgtatgagggtgtctgtcaacccctgctgggaggtgtctcccagtcaggaggcacgggggtcaggaccccacttgagaaggcagtctgtcccttagcagagctcgagtgctgtgctgggagatctgctgctctcttcagagccagcaggcaggaacgtttaagtctgctgatgctgcacccacagctgccccttccccgtggtgctctgtcccagggagatgggagttttatctataagcccctgactggggctgctgcctttctttcagagatgccctgcccagagagaaggaatctagagaggcaatctggctacagtggctttgccgagctgcggtgagctccgcccagttagaacttcttgacggctttgtttacactgtgaggggaaaactgcctactcaagcttcagtaatggcaggtgcccctccccacactaagcttgagtatcccaggtccacttcagactgctgtgctggcagcgagaatttcaagccagtggatcttagctggctgggctccgttgggggtgggatccactgagctagaccacttggctccctgacttcagtcccctttccaggggagtgaatggttctatctcgctggtgttccaggtgacgctgggatatgaaaaaaacgcctgcagctagctcggtgtctgcccaaacagctgcccaattttgtgcttgaaacccagggccctggtggcgtaggcacccgagggaatctcctggtctgcatgttgcggaggctgtgggaaaagcatagtgtctgggctggaatgctccgttcctcagggcacagtccctcacggcttctgttggctaggggagggaattccctgaccccttgtgcttccggggtgaggcgacatcccaccgtgcttctgcgccctctgtgggctgcacccactgtctaaccagtcccagtgagatgagccgggtactgcagttggaaatgcagaaatcacccaccttctgtgttgatctcactaggggctgcgcacctgagctgttcctattcagccatcttgccagccacttctttggtcaggattttaaagatgaataattcctgctttagtttctaagctgtattaaaccctagatattctattgaaaagctactgaaagtaaatcaatatatatgaattcacataatccataatcttacaatagcataaaatccttaatacagtactggtttagaaacccagtaacatctcttatcaccagtacataaacattctattaaaaatataccgtacttataaagtatggagtgacactcgctataatatggcctttgatagacatattttcagatattaaaggccaaatcatatgcttttaaacattgcaattgcatgctttgtaaactagataaaaccctggttactccaaataacaggaattagcttcatatttaacccagatttatgaaggattaaatattttttctttgttttttcttctccatcaaaggcttacttaatacacatagcatttttacaacaacaacaatgaaagcctccacacggcaattcatttgtagttctttaacaatgcacaaaacattaataaattttcctcttcctactataggcagtataccttattcattatgaagatatcacaagtttattcagagttgggagagcttacatgttttgaatgatttttaggatcgccctgttcatgttggttctatctgctcattcatcccctaattctataagaaaagataagttttccttacataactcatatataagaaatcaagtaaggttgacttgactcatataaatgggaagcataacaaaattaatacaataagaagaaaactttagaaccaaggttaagaagagaaaagcaataagggaagatagttgcatgaacatggttgcaagtatcttgcttgccaaagtgaagatgaaattctaatacattatatcacatttcacattatctattcagaggaaatatgcttggcttcctcaatgtcaaattctaacatagcgtttctttgacaaatttctcaaaaaaacccaaagccacagggactgaggatggtaagcctaaaaaggtggatttgccagttttcttcttaaaactttagatgtgaatgctgaagataaataaggatggcatcgtcacttcatcataatttctagcctactacacacatcattaaatcaatctcaatttgaatgccaaaaaaggtttaatcaaaacatttcattgtaggaactttaaagaaaaaactcatagaatccctgccctgacttttcacagtaagaaatgcaagttaaaagtttgacaaaaatgcgatatgcataactacatagatgcgacagatttgcatattccaagatggcagcctgggagagttatttacagtgtatgaaaaactgtgttcagagtcaacaggtaaactaagaacagtgaaatattcctggctcaagaaggacataccacttttggtacagagaaactatggtttatagtctgggcgcagtggctcacgcctgtaatcccagcactttgggaggccaaggtgaacggatcacctgaggtcagaagttcgagaccagcctggccaacgtggtgaaaccccatctctactaaaaaatccaaaaaaaaaaaaaaaattagccaggcgtggtggcacatgtctgtaatcccagctactcaggaggctgaggcagagaattgcttgaacccaggaggcggaggttgcagtgagccgagacagcaccactgcactccagcctgggtgacagagtgagactgtctcaaaaaaaaaaaaattaaaaaaagagaaaccatggtttattaaaacaaaaacaaaacattaaaaaacagcaatctggccgggagcggtggctcacgcctgtaatcccagcactttgggaggccaaggtgggcggatcacgagatcaagagatcaagaccatcctggccaacatggtgaaaccccgtctctactaaaattacaaaaatcagctgggcgtggtggtgcgcgcctgtagtcccagctactcaggaggctgaggcaggagaattgcttgaacccaggaggttcagcgagccgagatctcaccactgcactccagcctggtgacagagtgagactctgtctcaaaaaaaaaaaaaaaaagaaaacaacaatccacaaaccttttcaccttgggattgtcctgaagaacaaaaatcttgtatccagactacaggtttaaaagttattctactttattaaagcctttatatattccacttacagatctatgtggaacacctagtaattcaaaaagttattcctattccccattacaaggaaggtagaatatttgtctagtcaaataagcactggtgctattttcagtaaagtgaaaagtcatgatcttgcccttaaaatatttgataagcagtataaatcatgaattttaaaagtaaagaagcatttaaaacttaaatttgattctactgttttttcctatggaagctatgtttggaaggctgagattctcttagtgagcaatatagtcaatattaatattgtgtttccatttattaatttaccatgttcaccacccgcagatgatcagctagcaataatgccatttccataaaggccagggacttagtcattgttgtttcacccattctttaaatccaaaagccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttcaagtacacttctactttttttctgaaataaattttagttaataaaactcattctttgtaaactactacccccaaagcttcagagtttcaaacccagtgtcaataagatgcagtggagaaaaatgatttatttccactgcaaaattaaagaagagctaccgaagggagataaatatatatgaattcatgtaattcatagtttgaaacacgcataaaatacaacacagattcaaaagcccaatcacatctactattaccagtacataaaaattcagataagtaccataacttaagtgtatatatgtctgagaaagatagatgtgctgggttataaatataatttttcgaaaggtatgtttaatgtttatatgttttgctatcattgggatcagaatgagagttttaccaatcagggtatggaaaatgaagtttgtcttaagaccaagaacagataagacagggaaactaaaaggaataccgcaaatagggttgggtgaaggccagctgatacttgaactgttatgcttttagttatttttaattattaaattatgctgtacacattctcttctccatccatactcagtatcttacaaatgcacctgtgtgacaagtatggctaaaaatgaatcccttatgtctgctctacagcctatctattgagcaatttaattgacatattaactaatttagttccactgggacattttcctaacttatttctcatttttggagaagtctgtcaaaaaattagtccctatatttttgaataaaatcaacatatttaatgcttttaaaatactaggtaatacatttcaaaacccttagttttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggccctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttgggggttgtagacactcaggaaagacaacaaagataggtaacattttggctggtccttgagggctgaaggagaattcgccaagtagacaacgtagggggatccagacagagagaacagcatttgcaaaggcagatatatctatatctatatctatgtgtatatatatgtgtatatctatgtatatatgtatatatactatgtatatatctaactatgtatgtgtgtgtgtgtatatatatatatatatatatatacacacacacacacacatactttacagacacacacattcaatacactctgcccatatcacccctttttcccaaatatgccatcacatatatatatatatcatatgggcagagtgtattaaatggtctggagaataggagctatggctgagaaggtaagtcaaggctaggaagaaaagggccacgtaatctccttattcattggatttcattctctaggcaagtattctcccgcaaggagtttggattggaattggaagaagctgggtaatgcaggaacatcagcaaagaaaccattcatccatccattaattcaccaaatgtttaaaatgcagtatctgagatatgccaggcacacagaggggtgaatgggatttaaagatgtatactgttatcatctaagtaaaagatgctggggattaaaaaggacattggttaaaagaggagagaaaacacaaaagagctattctgaggtaacatgagccatcatgtgccatcagtgaaaatgcagaagggtttaaggatgaacctaaagtttctagcctggaaaatttgttggatgatgattcattaactgaaataggaaacaggaaaaaaaaggtcagataagaggggacagaagtagggaaatggaaaacaggagaacaaatgaacttggtttcagaatagttgcatttgtgatcgtaatgccacatggattcagagatcagaagagagatgcggactagagatgtagatacatcaccatccaggccatctcaaacagggagggtttaaacaatcaaaagagaattaggctaaggttagaaacttgggcacaacagtatttgaggggtggctaggagaagaatctagaaaaatataggaagaagaacatggatggaacagttccatgaaagccaaggaagaggacaacttctagaatgaggatgctgagatgctggcaaacatgctgagtgcatgagggaatttaacttcttttgaattttaatctaggaggatttttgtgattttgacaatagatgagtagttgctgatttcaaaatgatactcctaaatatgtatttttttctacagaatatatttgccatctttgtgccacaagggaatttaactttggtcttatagacagtggtcttccaaatatataatgattttccctcatttctgcagtgggccaatgaaacttgaaactgtattacaaatgttgccttccaagggaagggcaacacattaacagccttatttcaccaaaccataacttacccaagtcatgtaatttggttagcaaaagggccaacacctagactcctggcttttgattaagtgttttatttttctgtattctgatactaagtaacacaagcaatacaccaatacacacacacacacacacacacacacacacacacatcagactttagtacaatcacttaatatcaaagtcaaagtgatttcttgccctgtaactgttttaatatttcatttcatataactgaagacagacaaataattagatcactgtcttctcttggagaaaataccatgtgaatgaagactgaatttgtgaaagacggactgatttctctagctttaactttgtgggaagataacactgcactcaagttcagattagaagctcttttgagtctctcaaagggccctgaagcaaagaagtagacggtaccttgactttctcgaggtgatcttggagagagtcaatgaggagatcgcccacgggctgccaggatcccttgatcacctcagcttggcgcagcttgaggtccagctcatccgtggcctcttgaagttcccggagtctttcaagggtctcatctatttttctctgccagtcagcggagtgcaggttcaatttttcccactcagtattgacctcctcagcctgctttcgtagaagccgagtgacattctgggctctctcctcaggaggcagctctaaattggcaatatgacaaggttttaggccacattctttttttttaaacattgtcaaaaaggtcatactggaagaaagaaagagtacagttgaacaagagggtaacctactgattaacggcttttttatactttggcataaattttgatacagcccagaacatctaaagtatatcttcctgagtttctaccttatatcaatccgacaatttaagattcacttaagctattgaggagaaaaacgttaggatgcataccacaagctctaatttacttcaggcaggctcttaaatggaaaattaacttgtagtctttgcaacaatagaattcctcctcacagataactccctttgtttattattttctaaatgttccaataactgattgctaatctcttttgatgtttatttatgaatgcacaaactgatttatgcatggtagtttatgagtccttatttttttttcagcatctatgtttaatttgaattgattctatttaaccaagaaaatatgagagctatccagaccctggcagcaagaatggatgggctgctccgtcaccactgatccttctatcaatatgttattatagttccacattcaattacctctgggctcctggtagagtttctctagtccttccaaaggctgctctgtcagaaatattcgtacagtctcaagagtactcatgattacaggttctttagttttcaattccctcttgaaggcctgtgaaatgagatgaaaagaagtgcttatttggcttgtggcattcttctcaaaattaatcctgggtgctcagaacttgtttatgaaactcccaggtcaatttctatctcttttatttatacactgatggttataaaatgattttttttaaaggctatatgggtctatctgttaatgaggaaagcgctgtgtttgtaaagctattctggggagatggggggagcattctggatagttaatgccctctcattgagataagagtgctttgtttatgtaacctgacagccatacttcaaatctacagctaaagtttcaaggtatatattgcaaaactctagcatggctaatgaggacttaaacataccccaaatagtggatatccagaacataatgggaagccttaagggccatttgcaggaccttaggctatattaaagtatacaatgaatccaactgacaatcaccagttaattctgtcaaaatgtctgacaaggtataaaataggtaagctaagagaaaagtctcaatacttttgaaaaatagtcattacatcatccattgtgacctctttgagaatagtagaaatgttttgagctattatggatgtaggaattgcggacactagtttctataaatgaacagatctagaattaatctttaatctgtaatcttcctttatccaggggatcaagagaaaaacaaaatgaatagtttctgccttcaaaaagtttctagatccaaagaagggagaaaattaacactagaagcagagtgaaaacagtaagttcacacataatcgagtgctaaaaggatcgtgaggtataccgtgagcctagaataacctaacggatactctgacaccattgaagagagttattgacccagattctttgatctcagaagtgagggtattaataaaagtattaagtgcatgctacataaatgctaatataactgtttaacaataacagtaatatttgccctgatctagggcttaatttttgtaacttttttcaactctgtcttttagcaatgttgcctgctgaatttaagccctgttctttcactggggaaaaacaaattagcagtattcttccttgaatttcagatatgccattatgttacagaagtgttccagagctgtattgtatgacacatttattaataaaatcttagcggtgttcaccattcaaaagaatcctgagtctgatactttgcaaaatgattcatcatccacagctatttacaattcaatagagaaagggaaggcgtttgaaccaaaatactggagttctgtaagtagaatattaggattcagcctacagatagggaagtactttctgaataatgggatatttctgtaccctaaaatcatgctagatacgtgagttatttactctgcttacatataaagctgattctcctgatatttcacttgaaatctccatgtttgtgtgtgtgtgtgtgtgtgtgtgtgtgtgtgtgtgtgtgtgttcagttgttgtattcttgtgttttttttcatacaattaagtttcccaaattcaagtaaattatcattttgcctagtttctctgtttggacctgaagggaggcaattaatactgacattactaattataaaaataataatggctccctctattgaactaccatgtgtcagtggttgtacctgaaactggaaatacaaagttgaatgcaaaacagccctttctatttaggaatatttaacatataatagaagagtcagacacgtaaataatttcaatacaatgtagacagtgctatagacttgcgcaatatggggaagaaaatcgggaaaagcttccaggagaagctagtaatcacatagaattcaaaagcatgaacatgacttattcaaggaagagtatgctagagaacattccaagaagaggaaaatgcaagtgcagagtcataggacatagtgcagtatggtatgtatcggaatctcaagcaggccagtgtttctagagcataaagaacaaggagagggcatgtccaaagatgaaaaagacactattgctatctggaaatacattagatttttaaaccagaatttgaagctctgcctctctatgatcacatatggtccactaagaggcttaggtgttgccttgaaggtaatcaggaacctttgaacggttttaaccaagggagtggcacaggaatatgtgtgcttcaaatagatcttcctgatataaatacagagtatgtatttgagaagaacagaaatggaatcagagagataatgaggcaattgtaagaattcagtgcaagattatgaggatttgactcagggcaatggtaccaggaaaaatgacagggataggatagggaaatgtctaaaaatctgaagtgtgaaaatttggtgactgaatagatgctggagagaagagagaaaaagaaacaagaatgacacttagtgtctaggttgagtagatgagcaaacgctgggtgcaattcaactaagtatgaggaaataaactttcctggatgtctcagttcacctacagaaagctctagcctcctgagaaacttcccacaccatggagattagatctgtagcaatttgtctagttcatttctctgatccaagagggtcaaacggttatagctcagggtaggttcctaagctgaactctatgttgttagaaagactggagtgggtatctttctaggtatttacatttcaaaaaatatgaagcccataccttggagacatttccagattgtaaaacatgagacacacagggctagctggtttctgcagaagctggaattaggactcaggcctgttatgtttccacagagaacctttcagaatgagagatggatagcagcctccttctcctttataagcagaaaaaatgatttttcctagtctcccacttatggagtacccagccactcaagtaggaaaatgtttcatcagcgttcatcatgttgccctaggggtaagtctttgggcaaaggaagggcacagcaacaatatttactgtaaggtaattaaatgaaatctgcctctgattcagaacccctcatgctcattcaggataaaattattgaagagtaatattaaaaatgcaacatgatggtgtgtgtgtgtgtgtgtggggggggtgttctgtgcatgggggacagagtaagggactgtgatatgctcagcttggaaagctaacattccttccacaaggaaataataaattctgaggtttgaggagaaaaaaaatacttaggagttattttctcattcagctaatatacgttgagtgcctacatatcaaagtttaatgggcaaacagaggaacaggatctcttgagagatagaaaaggaacaaataggtggagagattaggggaaatgaggagtgtagaaatttcaaggagagagtgagaattttgagaggaagagggtgaccaagtgagtccaatgaaacacagaagtaaagtaagatcagcattgcagagtgttcactagatgtgctgagagcaatttcagtggagggcagaagcctcagaagtaggcatagctgaggagtgagtggaagaaggagtaggtatttcaagtgaaaatcaaatgttcaattttctttttctgagaaggaaaagaggaagacacgacaggaggacagagaggataacaagacaaagggataagaagttctttttagcataggaatgatttgaacctagagtgaaagacggaagctagcagtagggtaaccaaccatcttggtttgtccagcattgagtttttcaggatgagagactttcgatgttaaaaccagaatagtttcaggaaaattggacagtctcaggaaaacgaggaaagttggtcaccctagatatatgttacgaccttgacagaaggtggagataattgttggaacaaggtctgtaaaataaggaaatggatcttttttttttttttttttttttttgagatggagtctcgctctgtcgcccaggctggagtgcagtggcgcaatctcggctcactgcaagctccacctcccaggttcatgccattctcctgcctcagcctcccgagtagctgggactacaggcgcccgccaccacgcccagctaattttttgtatttttagtagagacggggtttcaccgtgttagccaggatggtctccatctcccaacctcgtgatctgcccgccttggcctcccaaagtgctgggattacaggcgtgagccaccacgcccggccggaaatggatcttaaaggtctcatcaaacttaaaaacttaaggcactaaaaacttaaaaagtccaaggcactatttgatgatataattccattgttaaaactggacagtaaataattcaaagctaaggagcatccattgtgagagaccacgtgtttgcccatcgagttgttgccaaggacttagatccaccacagctgcacagttcatttcttaaatatgagtcattgaagattaaaatgaggccaaagaaaagacaaagaaagttctgttattacaaagacataagcaccattattttcacattgttgcctgaaattaagaaaagaaagtggatggaagagagggttaagtgattgtatctttagaatttcaaaagattcagattaaatacaaaaggataaaactcccacaaaaagagagaaatagttggttcaaggaggtcagaggttaaagaaaatggcaataattcttatcatgtgggaaaaactataaataacaatatgtaattttaaacatggttatatgtaagatcctctttaatttagtcacttaacaaacttcaagcaactactatgtatcagacactgttctaggcaatgaacatctgtggtctttgtagcatggagcttaaaacaaatggctttatgtagtaaaaaaaaagcaatgtagaatctgcattaaaataatggaaagccaatttttcagtatctaataactcaccataaactgcatgttgtagtataatttattgcattttaaaagaaagaaaaatgaagacttttttttaaaaaaagacaaacaagaatatttaatgtcaagagccttgattttgataagtgtcttgtctcccaaaaaggcctgtttgaaagaggtttgagaaaatatatactcatatatactgattttgtcatataaattttggttaatattttaaaccagagaagtcagttcctttatgtgatgatagaaaaggtatcagatatagatattttctcccatgtacatacagaatacgtatttacaatattcagatgttagcattcagatgttaagataattacttcctgaatcccttgaacagataaaattatctttgttaaaacacatcctcttccccatacctttcttttcacctttccaagacagccagacccaagggtccaaaatagtgatatgagagaattagaagcaatactaaagacgtagagcacctctatgaaaataaaatatgcaatttagaaaatgttaggaatactacacagatgtttgtccttgagcttcttaaggttcacaaaataaacttatatgaagtatgctactacactattatagcaatgataatctcaagataaatctatttattatgaaggttgaattatctggtagattgcacttaaaacaccataggtactggccaaccgggtgactgattgttgactcactaatttgttcattcaaaaaatatttattttgaacctattaggtacaaagttaggaaagatatagagacttaatctttgtcattaaggagccaatagtttggttgagtaggtatatttgtggtgtatacttttatattatgaatgtttcatccatgcaaattgagatacagataagttagggtttacctaaggccatcagttaattacacactttgaatctaaatcttgcaattctaaagtgaagctgaaagtgagtgataacaaaacataaaatctccctgacttagaataatttggaagccacataagtggaaaatcctaatggccatggaagaaatcagaaacttaaaaaattcctgaaagtaatagagaagaaccaagttattgattattattatttttatttatttatttatttatttttgagacggagtctcgctctgtcacccagtctggagtgcagtggcacgatctcggcttactgcaacctctgcctcctgggttcaagtgattctcctgcctcagcctcctgagtagatgggactacaggcacgcgccaccacaccctgctaattttttgtatttttagtagagacggggtttcactatgttgggcaagctggtctcaaactcctgacctcaggtgatccgtttgcctcggcctcgcaaagtgctgggattacaagtgtgagccaccacacctggccactgattatttttttctgtccctcttgcttcctgcttatattataaaaatatctaaataatgccataaatagaagtagctcagaaccacgtatggaggggatgaaaggtgagatattgatttgcttcatgagaggaacaagaggagaactctgggcataggtaatgacatgacagggagaaaagctatcttgctttctcctggggacagtggatttaggatcatattactatggatgtgagtaaaagcccgtgcttttcaaaacacagatgtctttcaatcatgtacagcttgcctggcgctgaattttacctgtattcatattgaaatggtaaatttgtgtttttcagaataaaatctgatggaatgactagaaatactacccatatttgtaagcagaacttcctagaatcatcctgggaggcaggctgaagtggtgaaaagagcactgttctgagtggcagaagccttgggcttcaagcctgggctgggccagaacctggctgcagtgatccagaaaaggtgataaactcttcctgctcctctgtgtcctcatttgtaaaatgtgggcatttgctaaaaccttatctaagttctaacatccagttctcatatactataatcaatttgttaagatcattaatcggccacaggcctgctctatggtggcagtttgagagtctctgctaagcatcgttattatcgatgcttaaaaaccatagccatagcttggcatatagtaaatgctcagtaaacattgttgactaagatacagaacacccagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaactgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttctttatttaaagagccaccatatttattgagtctcaaacacataagaatattttaccaaatgctcacttcgggacaagcaatgctcagttaacttaaaagcgaggtcttggaaaagggcaagcaatccaggatgtacatggcagggtggcaagaatattgcccccagtaatctaaagcaaattcataggggttcatggaagaaaaaaatttgaagaaagaggcaatggagcaaacaacagaaagagaggtttcccttaatagtcatttgagacagctagtattacagaagttatgaacatgggtatctgggctataaagaaaaggccataatcatcttttcttattgagataagaacacttaatatgaactttaccctgttaacacatttttttttttttttgagacggagtctcgctctgtcactcaggctggagtgcagtggtgcgcgatctcggctcactgcaagctccgtctcccaggttcacgccattctcctgcctcagcctcccgagtagctgggactacaggtgcctgctaccatgcccggctaattttttctttttttgtatttttagtagagatggggtttcaccgtgttagccaggatggtcttgatctccggacctcggttaacacatttttaagtgcacaaatcggtattgttaactataggcacaatgttatgcagcagacctctagaactttttcatcttgcataactgaaactttatatccattgagcaacaactcgcccttacaatgtatggcaaccatttttctactctctgcttctatgagtttgactaaataatcatctaaataagatgacaaaaagctccgccttattttcactccacttctgaataaaagtgaagataagggattgaagtatcagatacatccattcattgtttcagatagtcaacaacatgaacaacaatattaatttataaatgagattgaataaatttgatgtaaaattgaaaagtaaatgaacatatttcaggcctgaaattatgttttttttttaaaaatctaattatagtcaatgaaaaaacatttttgagtgtataaggggaaaatgtgtttaacaaactctgtgttgagatttatttttctggaagtctttgaaaacaaagattgtattctctgagatcaagggcacgggctagaatagtccagcctgcttgcaggtctgtgatactatggaggaatagtttactgcgcacacagcatcttgaacagctgtttgactcttaattctaaggctgggctgcttccaacaatcactggggaagttacttcctactgacaataatgttgttaagttctgagctgaccttgagagatcactggtgaaaactcaatctagttcccgtggccatttagggaattaggtcttaggtcattaagcctaaactttaagatttggaaattacttctgaaatgttagtagaaatgaatggattattagaaaaccctgtgacaaattaatttgtgtatgttctcaagatactgagccaaaatttgagattgtcaagtataagtggtaaataatatctgaatcataccctttgtgtctgtctatcaacataatccaaaaatggaaccctggttcattctaagcacatacactcaaacgtgatcattcccaagtctttctcagatggcaacatcattattttatttgttcaagccattgacctcagaattttccttgactctttgcttcctctcaaactccacattctatctatcttaagttctatcaattctaccctccaaatatatcttcgatcaaataattattcaccatacctatcatttccactctagtccaagtaatcatttccttctgagatgactccaccaccctccttttctgtgtcttcagtttcgctctttttatagtcaattctccatagcagcaagagtcaacttctaaacacataaatcagatcacatcatccctgctgagagccttccagtgatgtttccttacttccagtgatgtctctttactcacagaataaaatccacctccaaactatggcctgcaagaccattcattatctggcctttccctctttctagaacctatcactgtctactgatcttatttcccttgagatacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctagtttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccataggggcagagactcattttgttccctaacatatgcttaacatagagtaggctcttcataaaaaaagttcttgaaagaaccaataaattctaggaatctgagttatggtataatttttcctaaaataatgtttttgggggacaaaaggaagagcacagaaaaaaatcaaggggatcatttgtaattaaatgaataatgtgtgtaaaagtgctttgtcaaggcaaaacactatgcagatactgttttaaagagtatttgtcaggacatcaaaatattttgacaaagtgagagagaagactggtagagaagtcagtttgtaaattattcacatctcatcttgttacagtcattaaagcaaagcagcaattcctagatgactcagttcttcagttttgatgataaagctagttttcagaagacttagacttagttttcagaagactcaaatgcctagaaatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaagtaaaacaaaggaagtcagtttttaaaatatatctggaccagaataacacccactaattgaaaacgagtcagtctagtgaggcaagtaatgaggaactgtaaaagccaggataatgtattcaaaagacataaaaattggtcagtttatatttgctaaggcatatttgagctttaattatttataacacttcaccgcatctggagcattattttattaattagtcttgagagccattcagttgcagttgttatgctgcccagctggtttggggagcacagatctactcccatgggtgtgaaaattgctttgaggagtgagactatggtccccaaatatgtctgtggagtatcttggaattttacctacagaagaaccatatatctctccatgacagcaattgatattgactgtatattttctctacaagaaaagagtacaagatatgtaatattttgctacaaaatattatcactaatctgaaatggtatacaaagaaaaacacaaattacctgttttgtaaacatcctgatttatagaaaatgaaagtgaaaatgaacaacatttgattttagtttcaactattgacattttaatgggatttgtatccccataaaaagcatcagcaaaggatattaataatttagaatagagagtaagcagatgactttttaaaaaagtggcactctaaatacttgcggaataagtttacaattacagtgacccatcttgataccaaggattctatacaaacaacaattaaatcaagaaacccataaagagcaatacaatgtacaattctggaaacatggcaaagtaaaacaaaagtccacaaatataagatctgtcaactattagatcttgatggaattttgtactgattctgttctttttctctttttctaactgagttcaggagatctgatacgcagatccagtttcaaggattttccattgttcttttgcccataggcttcaagagcatcactaactagacagtccatatatgaaagggctaccacatacatgtgacaaaactttgagtcaaacaggctactaaactgttctctcatcagcactcaggagcgatgatgttgtttgaggaaggagagtgttttgtgtcaagaatttttcttaaagataccaagagaagcttgaaaaagcattgcgccaaactacaagtaaaagctgtatgtcgtatgtttattgaagcaccattcacaatagcaaaggcgtggaaccaacccaaatgcccatcaatgatatactggattaagaaaatgtggcacatgtacaccatggaatactgtgaagccataaaaaaggatgagatcatgtcctttgcagggacatggatgaagctggaaaccatcattctcagcaaactaacagaggaaccgaaaaccaaacactgcatggtctcactcataagtgggagataaacaatgaaaacatatggacacagggaggggaacatcacacactggggcctgtcagggggtggggggctaggggagggatagcattaggagaaatacctaatgtagatgacgggttgatgggtgtggcaaaccaccatggcacatgtatacctatgtaacaaacctgcactttctgcacatgtatcccagaatgtaaagtataataataaaaaaaaacctgtgcatcaaagtagctctacacactttacaaaaagatgcttaattagaaataaacagaaaactcctgtaaataagaagggaataccactctattctttctttccctgctcttggtctcaatagccttcctttatctaaccagtgtctactgtatactaggcactttggaatgtgctgagtagaaaaatgacagctttccccctcccaaaaatcttcttgaaggacatggtttagcaagagtagtcgatatttatcaaatagtaacacatgtacgtgatgacaaacaacgctatgttatagaaaagtagacaattttagaagtgtgtaaagaaagatctggtcaaatgtagacaacagggaaaagtttgcacaatgtccgagccaagatgtaaaggattattagatgataaccaggatattatgagtgggtgggtataggtaaaagggtttgagacagaggaccaacatatttaaagccccacataagagggacacgcagaattggaaaaagtaaatggaggcagtatggctggcatccaaacagcaagggaagagcatctaggaaagaggaggctgaggccagacaagccagatagtgccttgtcacccttgttgaggattttggtctttttccaagagcactgagaagactactatagtgttaagataaggactgatataattggatttatgttttttacacagattattctgactgaaatgtagagattgcattgtagggtggcaagagtagatgcagaaaggttaggagaaatggtcttctataattatgatgataacaatagtagacagtcaaaaacaattttgaaggtaaattggccaggtgcggtggctcacgcctgtaatcccagcactttgggaggccaagacaggcagatcacgaggtcaagagatcgagaccatctggccaacacggtgaaaccctgtctctactaaaaatacaaacattaggtgggcatggtggcgcgtgcctgtagtcccagctactcgggaggctgaggcgggagaattgcttgaaccaggaggcggaggttgcagtgagccaagattgtgccattgcaactccagcctggtgacagagcaagacccagtctcaaaaaaaaaaaaaaaaaaaaattgacccagtgatgtcttggtagtggaaggctgaaggctggtcatccggaaaaggtactgtaccagacaactacattgttgtctggtatgagaaaatatttagttagagtctcggaatatttagctagagttttggagttttgtagattgcagcaacaaaaagataaagaagcaaagggtttcagacttttgaaaacaagttattaaaatttagatgattgaatctaagttgtatttggaaggaggtaaatatggaagggcagaggaactaatgtataaaacacagagtaatcaatgggctggaagtcctgtgaaattcacgaaaggttaacaggtagctatctgagcaagcacactaaccaagtggggacggattaacttcattctggtgagtatcactcataactctagcatcaccatctccccaagtcatgttctttgtcatgagattcctgagtaaggactgcgttaagtacagacattttaccactcttaacaagcaaccaaaactaataaccaggaatagtgaagcagtatttataacaaaatactggctggaagaaaccacagcaattatttggaccaatttcctcatattacagttgaagaacaaaatagcaatcagaatccatcttatgaagaaatatgactagaatctcagtctcctgactcctagtgcacatgtccagtgattcattttctttggtttctggaactagcataaaattcatcttttgtagaaattctgtctcatttcactatatcgcataatgcattttttaaaaaaggcccatccttctcaatgagtgcttttctatatgtacaccagagtgttttggctgtttattcaaagtcagaacatttaaaacacatagcaccattacatttcaccctaccacaaaagctaatttaatattcagaaatatatgaaggcaaatggctaaaggagaaactggcagtttccctggcatttttttttttttttgcaaagatccctgggtcttctttcatgttctcttccctttttataatttcctatatcctcttctccagaataatataaacccttgacctttcctcaagatgccacctttggctgtatctccacagagatctttcctttacatgctcaacatacaaaagtggtaccattttatcaagtttttattatttggtagtaatttgtttggtttgctattcatttctgttcttgtatcttttattctcatttccaaaacacttatcagtatccactctacaccagacactttactagactctagggtcttggaggtgaacaagacaaaatctctgcctttttcactcagagcttagtagagaagatagaaatgtaaataaaaataaaacaaacaaacaaagaaataattggtcatcgttggaggatgctagtgaacaagttgttattataaaaattggtaaaattgaaacgtattttgcttgttcggtatgaaaggtatactgagtaccaaaataggagacaagtgcaaaacatttttttcatagacctaccccagtgaataaatgaagaaggaatggtagagataggcaattatcacactgcaacccctagccactgatcgtgaacagctattaaacatcacacaaaaagagaaaacaaggcattatataccacctcctgatgatggaagaatacacgaacacctgtgaagcagtcttgccaaaaaaagccaaacccaaatacaatcaaactatagaactgcactgttcaatcggtagctactggcaacatctggctactgagtacttggaatgtaatgagcctgaattgagatgtgctgtaaatgtacattttttctattgattgcatgttgaaatgacaataagaattgtactacagttgcatgacatataatgatgaaaagaaacagggtgaaagatacagggaaactattctattttagaaacttactgtgaatctgtaattacttccaaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttccaaatgggacctgaaaaagaacagcagcgtaccatgtcagaatatctagaagtgtaattgatgattctaacaattccattgaaaaagtacaataaacctattgtgaactacaaagcagtcttgaataaaaatctggctacttacttttgagagccacaaaacagaggatagtttgatggcaattttgagaaaaggcagtgtttagccatatgtttatttccacatgcagaatgctgagacttttggcatgaaatacacactggaatctattgcttttccatactgttgtagtcaacaattcttaatatttctggtagaaaaaattggatgcagtgactaatgaaaaacacttcgttttcatgtgactcatgctagtactggaattctttttgccttgagaaatggaaaggtctctccccacattttgacttttccatttctacaccctaggcagccttttccattgagttcttccatctggcgtctgttcctttctgctcctcttcccaaatgcgtctcctttccccctacccttctttatttgtgtgcacctgggatttgtcttcaccaagtttcaacattttctgctttgtttcctttgtgtaaaaagtactaagacaacaactcacatggaagagtaaaatcagacatttatctgaaagcttcccccgaacatgaataatttaggcaggagactgagtgctttaccgtcaactgtatttagaacacgttaatccttagaagccatttaagaatacacaaatgaatgatctgtgctataaaatccacatttcacttgaagatgagaagctaaattaataaaataaatcatcatccagaaaacaaagaggaaacgcagtgttagcaaagctttatcttcaggtaaattagaaattatgctcaatcactcagctattatcagcaattactaattaattcataataacgctacctataacataaatataataaagactttaacgctgcaaagattgaaatgtaaagcaaagcaaccaggtggagcaacatttcccttagccatttggtaacttagcttgacattacaaatacaattctccttttggccttagtcaaacagaatcaccaaagaatacttatctactgaaattaaattgttccaaactttctgaaggataatttgacaatacataaaagtctttaaaatgtgcaaagacaatgacccacaggcttaaattcaaggaaattatactaacaaagaaattggaaaaagatacaaagatataggtggaaaaatgttatatatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagttactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaagaactgaatcgtgaaataccataaatgtcatgaattgaatataatagtgcatgcagattgcatacaattagaggtcagttcttttatgtttctgtaccatcctttcagttaccacttttccatgataagcctaagcgacaattccccatgcaagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggtagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcactgcacctccacctcccgggttcaagcaattctcctgcatcagcctcccaagtggctgggattacaggcgcccaccaccacacccagctaatttttggtatttttagtagagatggggtttcgccatgctggccaggctggtcttgaactcttgacctcaggtgatccacctgcctcagcctcccaaagtgttgggagtagaggcgtaagctaccacacccagccgggaattcagttctaaaggatctaagagaaacttaatagcatgaaatagggaagttgttagaagccagggacagaggacagtcaagagagctaatacagcagcagaagacggacctggaacctcaaaagacgaaaagctctcacatatctgggtaaggggacttcctttaatttttttctaagctgtggagttagataaaatttcagaatgtttgatcatcctaactacatatcaaattgcttcatttttttcctctcctaaagctcaagagtgaaaggaaaaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtataaatgtgaacattttatataacatttacaaatttttctgccaaatataaaaatctcacataatgtaaattctgctgaaattatgttgataacatattatgtgattttcatagttaatagtatatacaatgatctggaaaaataatctagtagtagactaaattgaaatcttcatatatatttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaagtgtaaattagaatagtattgggaagacctagtgaggaaacagccagaaaagaaaagatttgttatggaatatgaatcaaaatttggagaataagaggaaagagaatgttgcaagtgtgagaaccagcaagggtacatactcatatgggagagtgaggaaattgttggagagtaggaatggggttagaaaatagaatttattgattctcttggctcagagaatctatgttggggagtaacagaatgatgcttggtgagaaaggaactggaggcagaaaaagaaaagagaagggaaggagttagcaaggacttattaggcacagttggcagagagagaaggttctactagattctaatgattaaatataacttcattagagcagtgattttttttggtatgttttattcatggttgcatcctccgtgcccagaagagtgcctagtacatagtaggcattcattaaatatttgttgaatgaacaaataaatgaatgagggagatatggagacctacaagattgaagctttgaacaaaagagtaatatgatataaacagcgtccaaggtagagtattcttgcaaatgtatcaatatggcataacatgatgacttaaataagaatcttaatcacaggaagagaaaagatgtatggcagaagaaaaataaatggaaggaaaacgatacaatatggacttgtatttggaagcacaaggatatctcttatgagccaatggaatacaaagggaaacttcgaaatcatttggatttaaattcaattttgtttctttaaaaatggacacattaatggttttatttttttgaaatataagagcagtttcagaatcgctcaccaaacaatgggccaactgtaattttttataatatgttataacttgggcaaacacaggcctatttttccagtatatcattgaaactattttttaattgtggcaacttttcattttaaaataacccccatggaagaagtgacaagattcataatgcaggtttatcagtgccactaatggttctatatctaactcttccagtgttattctattctatttcataatcatccctaattactgcctatactgtacttctctcaattgaaccctgccatttgctgtagattgatcaataccctaatttcaatcaagtgtcaggaaataagctaaattgctttgatgtggagaattacttctttgctttttatgagtgcttataacatatcctgtattattacataggcctatataaaagccaaaaccattgatctgaatatttaaattctagaattggcagcaccttagataagctaactgttttctacctgattaatgacagcaagaatcaaactgcggtagctgacatgggaaactgctgagaatgaagagtccatattttggctgacatgctatttgccactttcaattctccttttattttatcaagttcacatgaggcagagaaaaggcactaagtgatactcggaacaattatagcatctttctttttcttttgtgcagaaaagaataacttaacttgacctgccaatattttttccatctcacattttcattcttttttaatgacgaaggttatcaaagtggcctacgtcatcacacatactgacctctcttaagagtttaagctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcctgttattatgtagatttaaaatgggcatcttattagttgtaatagatttattccttgccattatgagttggaaagtaatgtatttataactttataaagttcacaagttatatcttctagtctatggacaaaatgtattattttatggaagtgataggcaataaaattctatgataaagtgtaccccagtgccaataatttcattactatatggatcaagtcatattttctatttacgtagtaatctgtagagttaactctgaccataaaagcgtggagagactaataaacaagattgcacttggcccacagcaccagcacattcctgggagtctgtcatgggagagaaaatcttcttgacaacacaaattaagttcaccttggtattatagcatcatacatatagtacagcatcatacatttattagttttgatttcccatttaatacacatttttaggcttgacaggtggaaagtacataggaccttggtaagagttatgataagaggttatgcattcaacttcacttgtatacacacagatcaagaaaattattatagtagaagaatctgacctttacatggtatgtcttcctgtgtaacattttcagcttgaaccgggcactacagcactgatcctgttgcatagcaatcctgagaaaacccagaaactgaaagagccctgctttaaaatgccaactttgcttacattctgttgacagaatgaattttggagcacaggcctcaccagtcaataataataaacggccactttgtactccgcactaaacagtagccaggcgtgtggatgtgggaggaacctcaaagagaggaggcctggaatatgcaactgacagtttatattaaacagccaacttttcttatcattctgccattacaagccagagacattataaattcattttatatatgtgtttccttccttgttcccagcagaatagtcaaagccaagggaacattcctcagagagctgccgggtaccagcattcctttctgcctacacaatgaatggaggctttgtatattatctgacttgctcttagagatttgtatgcttctgttcaacaagtttaaaaattcattctgaagctccaaacaattggattgatctgtgtaactagaaaagttttttttttctctctctctctcaaattgaattaaattactctgctaaagtaagggagaaaaagtggcagaaataacatgttagaaattctgaagaactggctcaagttttcagccacagcctcttaagatgcagaattctgaatgttgaacaagtaaggtagacagacaatgaatgtctattgtcactatttttggcagctaaagcatcactgatggactctaaagagagttgtgtcccattctctttgactgggagacaggcaggggaatatggatagaatcacatcagaagttgaaagaagggaaatactgaaagtatttctgagtagtatctctgagtagtacaaaccaggtttgtactggaaggatatagcctgattttgaaagtagtttatatggtagaaggttagtattgggattcttgcagaacgaagtttggtcaaatatatagccattttatgtttttctttcttttttccttttgcctacgtggaataacatgcctgcctaatttgcacttcttcagcaaaagagaaaagtgagttaatttatctaagtacttcaggagaaaaagccaaccagatctaagttccagataattccttcacttgtcttttactttacttcttctgttgtacttgatttgtacagtactttccttttgtgtatgcacttaggggattaaagacaaacttttagttgttcaagtaaaagtattctcactagtagcatcagttttctatgtttactacattaacatacatataaaggatagtacatttgaaatttatatcctacattgatagcagagacccaggctcaatcacgagctccttaaggttatgtataccatgaagtcaccaacactttctttgtcttctcaagcataaataggatgttgattcatgaatttgctacttttcatctttgccatatatattatactgcatataaacatctttgttgtattatcaacaaataaatgaatataaaattgataaacaagcatttattgaggactgatttattgtctagttttagcactttgggaaatgtaagaggagtacaaatgatagttctgtctttaattttcctaaaacctagtgtgcatttttgtttaattcgtttatattaccaactaaatattgacggcaattcctgccaagtcttcatagatactgggataaagactccttcctttagaaatgcagaaatggctaaagttatcttagcattggcaagaagataagtcttctgtcagtactgcttttctaggtcatgatggtgatacagagctgtaaatgacacgtgtacagtaaagggctttacaggttacaaagcacgtacaaatgtaccaccttagttattcctccccctggctctgtgaagtacatcacattttctgttttgcagatgagagcactgagactcggatgtttaactgacttgcctaaaagccatatagctgataagtgttagaactgggaaatggatccaattctcttgattctagaagatcttgggctgcctccaccaacccacttgccagaagcattggatataatacacagtagtcactgaacctgaacgaagatactacttgcaagaggaaataagtgactgttgagggaaaagcaccctgaaagacagcattcttgagtttgataaaatgtttacccacgtggattgatttgttctgaatgaaaaattgaattctgactgctctttttttttttttttttttgagacagagtctcgctctgtcacccaggctggagcacagtggcgcgatcttggctcactgcaagctccgcctcccaggttcacgccattctcctgcctcagcctcccaagtagctgggactataggcgcccgccaccacgcctggctaattttttttgtatttttagtagaaacagggtttcaccatgttagccaggatggtctcgatctcctgacctcgtgatccgcccaccttggcctcccaaagtgcttggattacaggcgtgagccaccacacctggccctgattgctcttttcacttctcatttagcattgggcatcctggaccacctgtgagcaaaaaatgttcacactgaaaaggtctcctttctgcaaatttccctgttgccagaacagaaattctgccatcagtaattcatctctttgtctacaagagccatgtggactactatgaaccataccaagaaatgacttgacacatcagcataaacatagttcatccatgttcctttgggatggcaggctggtaggaaatctttcaagctacaggactcagataggttgccctaaaaggaaggtaagtattgggaaagaacccaaggctctctttcaaaagctggcatgctgtagtggagatttttcagtatcaataaggcagcatgagtcatagattgggaatgcagggcaggctgcaaggaatatacattatacataatataatataatataatataacataacataatataatactaccataatgatatttgtctaaactcatcattttttatttatttatttatttatttattattattattatactttaaattttagggtacatgtgcacaacgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttctgttcttgtgatagtttactgagaataatgatttccaatttcatccatgtccctacaaaggatgtgaactcatcctttttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgacttttaaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcacccactttttgatggggttgtttgtttttttcttgtacatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgttaaagatcagatagttgtagatatgcggcattatttctgagggctctgttctgttccactgatctatatctctgttttggtaccagtaccatgttgttttggttactgtagccttgtagtatagtttgaagtcagctagtgtgatgcctccagctttgttcttttggctcaggattgacttggcgatgtgggctcttttttggttccatatgaactttaaagtagttttttccaattctgtgaagaaaggcattggtagcttgatggggatggcattgaatctgtaaatcaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttgcattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaataaactcatcatttaaagactacacctcagactcaggtagcacaaaagagcaaaagattgatatggagaatcaagtggagttctcagtgggtagccaatctggacaaaggataattttcatagaaatttttggatagttttatttcacttctgacttaactagaaaagatcattcaagccttcattactgcattcactgtatgctctctaatttttttcttcttttttgtgattgtagtctttaggaaaagcaataacgaatgaacaaaggggaaaaggtagttgttacataacaaaaaccatagcagcagcagcagcagcaagaacaacaacatacatgaaccttactgtacatcaggtgctgtccaaagcactgtatatacatgagctcattttctcctctcaacaaccctctagggtaggggctactattatcttcattttccatataagataatgaaactactgtaaggttaactaaaaatgcccaggttcacacagctaataaatgcagcaagatttagaacctcgtcagtcagacttcagggattgtgctcttagccactaggctatattacctttcaagtttagttgttggtggtagtttttcctattaataatgctactacctaaattttagcaaatctagcactgccattagaaaataaaggataactatgtcagcacacaaagagcaatttcatggtcttattaatataaagactattaaacagatttgtagcagtggatagagatgcatccaatacaacaagagaaaacacaaagtaattgagaaaatgggtgcaaacgaaacaaataatgtgtgtccccataaaagaaacatttggcctaaagttctgtacaattatagagcaaatttcagctgagagtaccaaaaaagttcagttatgagacaagcaatatgttcacagtatagcagttttaggagtaggggagatcctgttttctgaagggctttttcaaattccacacttccttcttatctgagtctcatctactcttgttgtgaatctcctttctcagcttccagagaaaactcatggcaaagtgcagttaaatagacataggtttgacccttctcttctctttcccttattagccacataatgatgaaaactctttcattactttggtttcactaaacatgaaataataatacatacctgctgaattttttgaatattacatggaatttttgtaaaatactttgaatagcgtctagaacacaagagatctttaataaataatagcaaatgcagggcttactattacaagataatccatgtggaaatcagatgttagaaatagatttcatgaagttacaggacttggcttgagccttgagggatgtatacgattgggaaattggaacaaaagaaaatattccaggtaaaaagaatagcatgggaatggagtaaaggtgaaatgaatttggtttatgagcagggacaatgaattgcacaacctgattggaatggacaatgagagttgagagaaataggtagaatgcagaccaactgcttaaaccaagtagaataaagtcttcctttaggaagccaccgagaataaaagtttagaaagaaaagtacaaagacaagattatcgaatattaaatttgtactatttcattcaaaaagtagaatgatccatggtgttcataagtaataatacaactggggaagaataggaaaagttatggatgttttactagaagaaaaataaagaagggagatgtcaagaattagtgctgtacccttctttttattattaaccattttattaaccattaagcagatggttgtgatactattctagaacatcatgaataatcgtatccacatatttcctttcctatgtaaatggaattattggtctctaaaataggactcagcaaatgaaaacttccccattttaatatagctgagaagtaaggaaacaaacacaatggtgtagaaagaataacaataagtgaccaaatctccttaagaattttattatagacagattatctctaagcttttctgaaagcagttagtatatgaataattataaggccattagttcctccttactgataatttttatctaatttaaattagcttgatgggaaaaaaagtggtctgatttctaagaacttagaaggtcaggaacatacaattcaaaatagtaaagaaattatcctaagtggctaaattgagagtaggaagaagtgacaccttacagagaatcagaaaggtgtaaaaggagccatgggcatgcataattgaccagggtcacacagtgtggaaactaacagctctccatgcatcagtagcccttgaaggcatcacctcgttttatagcgaagcaaaatagttaatgctcaggatgatgatgctgaattagccagggaaagcagatttacattcagtaaaatctgtttaagaagaaagcagtgtatgtaaatgcttcaaatgaccaaatgactgttatttgatacagttgttttgaaaaggtgttaatgatttaaataaaaataaaacaaaaacaattatatgaaagtagaactcccttagactggttatccaacatgactcattaaacatgagctctaaatagtagagcttttggagcacacttgcatacactcatacgtatacacacacagaaacagatattctattatgaagacataagaacagaaattgaaagcaaatctttagaaacgtgtacagcaatctaaaaataaaaagcatcggcttaaattttgtatgtctggtatttgtaatttttaaaataattcatttttattgcatgttacaaaagtatcagtctattatggattgggaattaaaacaagcgcaaaaaaaaaaaaaaaaaaacccgaagtggatctttcctaacaagtttttcgagaagaatccataggaagaaattggacccacagtcttggccttatcaggattctaatctaaccaccggaggttcctaaccagatcagaaaatgcagttggatacagactcacaagagggtgtgactgttttttcccttcttattctatatgtggccacgcaacacctttaaaagcagcagagttgtcgtcccaagagaaacaagagttaatttgaggactgctgtttggcttggagcctggttgctctaggtagataaggagtatgttttcaggtccactgcattgcgttgcatcttaaacgagcagctatggatttaggagtccacaggctttgctttaaaaacggctgttattaaagtcctcagagactattatcctgcagggtttgttgtctttgctttcatatctcattcgaaaattctcacacttaagcactgcaacagcagagagaagggatatgctctctcagcagggagaagggatatgctttcttgcctcagtatattcccaagtgcaaagcttcatttcaaaatctaatctttaaaaatgcctggcctagggtggattacccccggaggaaactgtcaaaccgccttaagcaatcccgaactctggtaatacgtgatgctttctctccttgtgtgaccctctgactccattcttaagattaccttttaaaactgatgagttcatttaagatctcctaggttggaagtaagatgagaggtatctttctcatctacgtcttgtttttcctagtttcttctcatccagtcacaatgcaaaaattcccgaatatttattcatcacaaaaatgtgcattaagtacctattgtatgtctataagtagggccgataatacctaccttttaaggttttggcaaagattagatgagatgatgtgagtagatcaaccaagtacctaacccaatgcctaacctattgtgaggtttcattaatgttgcatccttctagtccccctctcactttctgccatgactccaatcctgctagcagagaagatatgaggccgttcaaaagaaaacgaatacctactgcatgaagatgggagccagagctacaggcaggagctaagaggtagttctcaggaagttcaggttcaaagggtacagtgtagccaatgagagcttagaatgccgcctggagatttttatctgattctgtaaggataatattccactgtagcttcttgtgtaaaggtgtaacattgtgaaaatagcatctggtaatgattattgggaggatggtgttcagggtaaatgtagcagggtcagagtgaaggcaggaagtctagtggacaggcagtcccagccatacaggaaccaaaacagcagtggcttcagaatcagagagaaggtaaagaagagggatgctaccatcattgagtgctcataagttataaaaatagctgcatgtgtgatttaattccatccttctcttgtcctacctttggaaggtagaattcaggaaagtgataactattcacaagtacattttaaagatagaaatgttatttaaagttctatttctcaaggagtaagaaaaaaatacatatgctgtgtttcaaacacacacacacacacacacacacacacacacacacacacacacaccttggggccaaataaattagaatgacaaaaccattgacaccaaatgacaagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatactgcatctaaaatccatagaaaatactgtgctgcaatattatttctgatattgctatacagcctcagtgctcataattgggtgagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggtctttccaactctgagacatatttgtttttgcagagccatgatgaggggtgggggtagggtagggggatgaaacagggcaggaactaatacttacagcccttataaatcctttacaccaactctatgaaataggccttctttatcccctatcgaggaaaccacgagtttgagaggtaaagtaacttatacaaatcatagagttgttgttatgtggcagaagcagggttagagcatagatcttcctgaaactaggttatttttattctcttccctccaagctccagtgtcttccccatccattaaatacaaagcaagtgacttctgacttgggctacatgtatcacagcaacataattataataactcattaaggcatctgtgagatatttagtttcagagcactgataggaatggtcaacaactgaataattttccaattaggtattgcttttaaaaatttatccttagtcaactcagaactaatatcattgatgtttctgaatggttctaaatgaacacaatacactcctattcttcaaataggtaactctcttcccatggaccaatacatatttggttatattaatctgtgcaatttgtctatattacatagagagttaaaagctcgaaaagctcttatttctggaatctctttgtcactaagctattttttgtcctccagagaatcactgtggttcaaggttgtatattagaaaaaagcaattagttgatgtcaagtctcatcttttcccaataacacatatctaagaagaaagcaagaacatatggcaaagtgccataattatttttgatcatacactagaaatcacaacagccatgtaggtaattccctctggcttgttttaattattagggttgtaaatgcaaacaacaacttcattctatcccccactttaccccctaaaaacctcaaaatactcccacgcaaccacaaaacaaccctacactgatgtaattgtttacaataggttaatgataggaaaatctaagacatttctatttttttcattttaaatagcaggacaatttccaaaataatcacagacactcatcagacacaactgtattcatttgtgggtactctttagcccacagcatagagatattaaccttaaaactatttctaggtattcataagttttgaatgttaaagaaggttctagtaccatgatgtaaactaaagtcctgctgatataattggatctgattctctggtgatcttcagtgagttaatttctgtctactaccaagtagagcaaattctttcttctggagagtgtgacttttgtgtgtgtgcctagatagttctttcatcctattttgcttttcttctcttatacaatagggtgaacagtgatggggagaaaacaaagttactcttttgttaatgtatgaggaaaaggaggaagacaggggatatgcatgtggacactgatgtaaaggtaggtaatatttggcatatttgccgggaaaaaaatgtcataaaggaaaagtaggcaaaatgctaaggtacatttcctcattcttagaacccattcatgagctttccattgtgatatggtttggctttgtgtcctcacccaaatctcatctagaactgtaatccgggggaacctggtgggaggtgattggatcatgggggtggcttcccccatgctgttttcccatgtgatagtgagtgagttctcatgagatttgatggttttataaggggctcttcccattcactctttctctctctctcctgctgccttgtgaaggtgcttccttcccctttgctttccaccatgattataagtttcctgaggcctccccagccacacagaactgtgagtcaactaaacctctttttctttaaataaattaccccagtctcagggaagttctttatagcagtgtgaaacgaactaatatacatcgtgtatctattaattcttcccaaagcattcagttcagttcagaagatgctagagacccttagaccatctcactgaagcaggtccagggtattttttgtgtccttgtgccatgatgcaatgttcttttcttcttctttttttttgagacggagtcttgctctgttgcccaggctggagtgcagtggcgcgatctcggctcactgcaagctccacctcccgggttcacgccattctcctgcctcagcctcccaagtagctgggactacaggcgcccgccaccacgcccggctaattttttgtattttaagtagatacggggtgtcaccatgttagccaggatggtctcgatctcctgacctcgtgatctgcccacctcagcctcccaaagtgctgggattacaggcgttgagccaccgcgcccggccgcaatgctcttttcaactgagaacaagtacatttggaaaatcatccccaaaagagcaaggtttgggaaggcttaggcctttccatgcccatatgacatgttatataagtcttatgaagaactagaacagataagaggatgactttacagattattttacaagaatttttacatgagaatgacttttttttttttttgagacagagttttgctcttgtcgcccaggctggagtgcaatggtgtgatctcggctcactgcaacctctgtccccctcctgggttcaagcgattctcctgcctcagcctcctgagtagctgggattacaggcacctgccaccatgcccggccagtttttttatttttagtagagacagggtttcaccatgttggccaggctggtgtcgaactcctaaccttatgtgacccacctgcctcagcttcccaaagtgctgggattataggcgtgagccactgcacctggactacattttaataacgattaaagaacagtggaaatctgcttcataacaccctgagtaagaaatgagaaattgtagctgcatatcagcattgtcgctgaccctgagtataaacgaagaagcctcatggtgacccaaacagagaattgttaactaagtcatgtccatagtgctttaccatggacaaatgtttttgatccacccttctaaggcaggggtagaaaagctgttgaaatgttgtaaatctctgcttgagtttgtgatacggttttaaatttagcagaaaaatattcaccaacaggagaatgagaaaccaacgtggataattattaatgttatcctgaacagaaaataaaaagacttgctgaaaaacctttctgcctggttttgtcagagttctcttccttttacacattcactttttgatgttttccttttgtgggctggcagaaagatgggggtcactctaaacttttactaaaaatactcttaaaactacaagatgtaagttctctattttaaagagcccatagccttctgaaaaagtcttaagcaaataaatgaaccaaaataacatgtgatcatgttaaactggaacacagccctgtgggaacaaagaacaattagccttgccccccaagatttgcagatgccatcatacaagtgatgatatttgatcagggtcttgagggatgagtagcagctggccaggggagaagtgggagagtgaaatttgaagcagtgggaaaaacatgaatgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattagaggcaagagaatatggagatctaaactgaggtaatagacacaggatgagaaaaagggagatatttttgagagatcatgaatacaacttagagactgactgaatgcaaggataacatatagggaggcaagttgggtttctggcttagagaagaagatgggggtgataatgctacctattattaaagtgttgaatttccaaggagatgtgagcagtttaacataggcttagcctgtcacttagtgatagggtgtggaagggagagtggtgttgacctttgtcggggggtacgtgtcatccactcatgggcatggtagcctgaaataggggcggtaaagaagggcccagcagggagtcagacagtctatgttgtctttcttgctctctcaggcgtctgtgttctttgtgtcattcacacgtgcctgtgagcgtgaacttgcatcatgcatcagtagttcccttagtacagtggttctcaaacttgagtgggcttgagaatcacccagagggctcattaaaacacaggctgctgggctccactctgagagatcatgattctgtatgtctggggtagaactcaagaatttgcatttcttagaagttcccaagtgatgccgatactgctagtccagagaccccattttaagaatgaaacactgttctagcataacagcccttaatcttctggaggtcatgaatgcctttataagaatgatggatcttctcctcaaaaacctgcagaaatatttataaacacaaaatacgacctattacttcacgggcttctgctactgccacctccacctccacccccgggacatacaatggattaatgaagacaacgtatccttccagtaccattttaaaggagaacccccaagaagaagaatacattggaaaatggcaccaaaatgtgattttacttatttagttgtcttagaattactcccagtgagcctacgtacaaaatgacccgatttggggaaggagacctgtcaaaggacagttcttgggtgcaatgaggaaattcatttcactctaaccacattcagataacctgaccttttcccattttaacctgccattcacttgggaagtaacaaataacagagaggtgggtgggtaaccatggagaaaagggtgcattcagccaggggcctgcctgtggaaggacggagcagtttgcacctcggggaaagcggaggtagggctctaggctctctgtctggtagcccagggaaacagttcaagatcaaaggaaaagataattaagaatgtgcttaaaagaaaacttcaaatcagctgtgctacacaaagatatgagacaatgcctgttgtagagaaaagagcattttgactttaccctaagaatctttcttatgtgctttccatagcccagcggtatagttatttttaaatgaccctggaaaggaagcagaggtgttctttattgcatgaatagaaggcaatctttcatttaaagaaccttaaccccgctctgcatgcatgcatgaagtcaggaacacaagggcaatactgtattattcattttggcaactataaattcaaatgatggctctgaggttggggagaaaaaggcccgctgagctggagagcagaacgcttccttcagcttatcaaagaagtgatagtgctacaggcaggagtgccccataataatctagggaaaatacgcctctgagtcaatgaagattttctgttattgcatgggctgttttgcctacagccaagaaaattctgtctgatggtaatgttttagctgctgattcatctcctctgtcttcaattcttctcagcaaacttttattgggtctcatcctgggcacatttacagagcaatttccataatgataacatctcttcaaatgagatttaaagtgtaattaaaaggcacatgtgttgtggcaaaggcgttgttgtgcagtgaccatacatcatcgtgccatggagctctcactcagccagcctatggaatgaccccggtttcactctgataagattccatggctttgtttgaggctaatggcttcattagaaaaaataaataaataaaagaagataaaacaagctctttattggagagataagtccatgaacatgcgttagacttctgcacccttctcccttcgttctgtctcttagaactcagaggcaacaagaaactccttgagcacggaagtgaacactaacaaacggacaggtgaaagctgaaaggatgtgcttgccctgagaagctgagctccttatgtcctatggcctactctcatggttttaagtgtgattgctagaaaagtggaaactacaggttacaattccctgaatggatgaatgcttgctcctgaaaaactgcctggtgcctgagaaagcaaggaaatactccttgagtagtcaatgtttgaaacctccaaagtagctaagactatttcttcttcactgtaaaatcaatataagatttttaagctttggaactactcaaacccgaaaatagcttgcctacccagatcctgactcatagtattcattaaatgatatgaactgattttttacttggctgctggttttaagtattgatagataatcatatcatatgacagggaaatcatattaacacatggggcgaataaaatctttcaaaagatcagttttgagatccaagatgatcattaaataatagattctgaagcatttaaaagaggacttggaacttttaaatgccatatgttcgatcacctttttaaaacataacatgacaatattcatggagactcaatatgccatgtaatgtctacgttacttacagcagagagttccactaattttctgtgctcctttctttgcctaaatgaactatttcatttagcacaatattttgtttgtagaataaaatttatccttgtgatgttgggagttatgaaataactcatgtgttttaaaatatcattaaatgtacggaattaaactataattagtagaaatcatttgagggtctttaatttactgatgctgacaaattctcatcaaatagttactgtgctttcaagtaaaataacatctttgtaggcagatgtaagacactagaaaaataatgtacactttcaaagagaaagtgaacctcccatacctctgaaataaaagcaatttagaaatctgatatattttaaaagaggcacataagttaatctgtaaatttcactttactcgttgacggtgaaatgctacgttcaatctgttgttacagcaaaaagttaatggaaagtttgacttcactgtaacaatatcctcttttaaccaaataaccttccttaaaccttggataaaattcccctgtttcacactatcaccatcacagataaacggattgaaaagacaacaccattctcagtagaactgtttgcttacactcagttagccaagcttctactacctgatttcattgccatggaaaatcctccaggataacttgggtagcagctacctctattacttctcccaacatcccactgcttccagttgctactgtttgctgttacaatcagtggtagcctagaaacttgaaccacccaagtgttttaaatgcggaagagaaaatctgagggaaaattgggaaggaaaaagtgtttccatgtttccgaagagcggcattgtgcttgtatgactgtttttcatcagctttgactttttggagaggcagttttacttttcatagctagtctaatatttcttctcactaaatagtgaattaacacagtgcaaatttagcagtcatccttttgacatctttactcataaaataagtaaaagcaatccccaacttacaaagagttctctaaccaaaaatcacttgcaaataaatggtccagaaccccaaactcaaatttccatggacacaatagtcatatacatgtctcagaccagcatatacatatatagctatttaacctataccatggatgatttatatcattttgatagcatgactttgggttatatgatttgggaaatatgcatcttttgggatatgaaagattcaagaagtacggaaaagaaatacttcctattttaagacctggatttgtccaacacccaacaaaggagatatataaatgggcatctgctctctccttccaccttctggtgcccatattttctactcccaaacttccttatgttttaatcctcattctcttctatctgttgaaaatcttattcccaaagtatagactgacaactttcacattctgggagatttttatattttaaaaagaggggctgggcatggtggctcacatctgtaattccagcacgttgtcaggccaaggtgggtggatcacttcagcccaggaatctgagaccagcttaggcaatgtggcgaaactctgtttctacagaaaatacaaaaagtagcggggtgtggtggcacgtgcctgtagtcccagccacttgggaggctgaggtgggagggaggatcacctgagcccagggatgtcgaagttgcagtgagccatgattgtgccactgcactccagcctgggtgacagggtatgaccctgtctccaaaaaaaaggggaagctgagttaaaccaaaccaatctgaatcacagattgataggatttccaagaatataagaatgcaaagtaaaaatattcagatggtagcataagcgtctgggggcagaaaggctttagctattcttggtaggcaatctactttggttaatactgtgaactggctcacctaaatctacttaccatccttccagttggacaggttggaaattaaaaactgtatttgccagacttccatgcagctagtgttctgattatgaattaggatataataagttagggttgtcagataaaatacaaggcacccagttaaatttaaattttctacacaatctttttttatttagtgttaagtatgttgcatgcattatttttatttgctaaatctggcaacgttttgccaaatgtgtatacttgtgagagatctggaaagtggaagtgaggcataggtcacctttctgccccttttggctatttctgttggcgagcttagtcaaagaaacatgagatttcctacatcagagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactccgttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaacactttactattatttttctcatctcttttgtccctcatatctagatgtcaaatttccactgacaagtaatttgatgcctagggaaaatattcgattcaacagtttcataacatgatgtcctattaattaaaacatgatacactgacattaaatttccaaatgaaaagaagcccagaagtgaaatatcacaaacttgatacatacgtatagtcacatggaggggtggagggatactaaggaaagacagtgtgttttcaaacctggcttgcacgtgtgaggtgaacactggagaacagaacttacctctctgctgtcagcacttggaacagcactgagcgcactcgaggcgctcaataaatcgagcttaattttttaaatcttttcgctcccttcgcccattctgcatatatctcatgtacaatttcatttcccaaaagtaccaggttctaacatcaggaagaaaatatatggtgagtattgaccatttctggtggtcaaggtctctactcttaatctcatgtaattagggtgatcctatagttcattgtccaaacctgaacacttttgagagtgtccaggatgctaataataatcacacagggtcaggcacactggctcatgcctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaactctgtctctactaaaaatacaaaaattagcagggcatggtggtgggcacctgtaatcccagctactcaggaggctgaggcaggagaatcgcttgaacccgggaggtggaggttgcagtgagccgagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagacaaattaggatagatgaacctatagcagtcaataaaatgggcaaaagggtctcagtagcagcagaggcagcctttcttcccgctcattctctccaagtaacaaaaggtctgtgacacgacgttctctttctgcctggggttcactgcacgcagtgaattgatcactgcacctgtttcttacattcagggaacggaaagcagagaaaggccagtggttcacaccactgtttgtgcacccaggtgccctctcaccgtggggagtaaacaccttcggttctgtttgctacggaaaagaaaaatgaaaagagggccaataacaaaatgcccttcaaagaaaacactttgtgagcctgtgtgtagcaaagataagaactaggacactgtcatgagaaagatcctagaatagcttcttgaaagaaagatttctttaaaaaaaaaaaaaaagaatgcgagtgaatgttgctacgacatctattgtgtattatctgccatatccctcttagcaaatgacgattaaagtttctgcatctgtcggtaatgcaaacgggaaagaattcactttcctgaaatttactttaaattttcctttacggagaaatgattcattccccctgtatttcatacctgatatgtaatacagattttatgtttaaaaaaatggctttgtggggctcccatactaaccaaaaatttcttcctagacatttctaactgtatctagagaaaacagggacatcaaaacaaaacaagaacacaacaacacagcaaaatcctggattttcaatttataaagtcatggatgaagaactggtttaaacctaaaatccataatcagagaacttcaaagagatatggtatattatacacatcagccttttccttttgaagaaaagcagagagaagacactggaaggggaaacctcctgctactctgggagctcctaagggctgggaccatatctgccttgtctgcggctgtatctcccacttccagcttgatagctggtatgcaactgcttttgctttcaataaagttatcgagtaaatgattggatacattaatacattgattagttatgaaagacatcaagtaccagagaacatcaaagaaggctaataatgagagtcaagcagtgggtaaccttggtatatacctagataatagagcactggtttctcttttttttttttttttttttttaattttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaacggacatgaactcatcattttttatggctgcatagtattccatggtggatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcggaaattttctcccatgttgtaggttgcctgttcactctgatggtagtttcttttgctgtgcagaagctcttgagtttaattagatcccatttgtcaattttggcttttgttgccattgcttttgaaaaactttgaaaaaaatttagaagaatgtataactagaataacgaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagtaaggcaggccaacgttcagattcaggaaatacagagaacgccacaaagatactcctcgagaagagcaactccaagacacataattgtcagattcaccaagttgaaatgaaggaaaaaatgttaagggcagccagagagaaaggtcgagttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaggagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatattttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtactaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtttctcttgatagcagcccagtttactgtatgattgttttagccaccttttccccctccaatcttccaagttacagcagttctcctcactaccaaaagtgtgatggtaggactatagtttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccctgatgttgtaatagaagctgtactttccttcctatctgaagctaatttctaaatttcatctttctgccttctcaagtacctgtgctattgattatctctaatttctcctgcatcctcaacctctccctctctaccatcttcttctcattgccatttaaacatgtgtaagtcactacccttttaagagtgtgttcttcctgcccctacatccatcttctgctactatggccctttctctcttcccatcgcagccaaaagtcttaaaataattgttttacacttgctcccccactttctcaattctcaatcatgcctgaacgtactgcaatcttggttctttagttaccaccaagtaattactgagttctccataatcaacactgaaatcacttgcataaaggttgtcaataccttccttgttgctaaattaataggatatattttggtcttatctttcatgatgcttttgtagtatttgacacctctaaatgttactttttcttgaaaacctctcttcccttggattctgtgacatcacacgaacctagtctgtctcctatctactgaactgcaaatttccctgtctccactgaaagcttatttttctttatttacccctgaaactttgccattttcctgggttcactcctaggccctcttctcatctacgaactttactctgaaccatttcaaacccttgcaaggttttaattacgtatatactgataattaaatatccaattaaagattctctagcctagaacatttctccataggttcagctcacatacctaggtatcacaacttagttacactatcatcattactcacctggacaatttcaatagtgtgctgaagctatcttcttgcctccagtttgctaagcttcctctagtcccttgaaataacatgacatgactttctcacttccaggcctttatgcatagtattccatctgctgggactccacctcctccaaatccccaacttgacctgtctaactcctgcttctcttcaggtctcagctgaggtaaggcttccttgggaaagccttctgcatcctgccaagccagggtcaattaccttgatgtacacccgtagcactatcatagtaatacccttaccatctataggttgaatatctcatatccaaaatacttgcgactgaaagtatttcaaatttcaggttttggaatatttgcattaccctatggatatcatgcaggcctttagggcattttcaacaatatcttgacaccaccagagaatataccagcaaacacagtgattaatgcacgtaggttttggccccatgctggacattgtagggtacctgccgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacaccgagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattgccttgagaagtgctctgatacagagctgactgactagccatgtctttcaggggtaaacgagacagaaacggaagccattcacgtattttccttccttgttccagttaatctattcattttccagaagagaaaattaaggtccagaaaagcaatgcaacttgctcttaacatcagtgctggagcagaacccaggtttctgtacttctagcctacgtcccttccttcacacctggtttcaagattccttaaagataaattataaattctagccctaagatttgctgcctttcaaattttaacctattttcaaggttaactacctgcctttggtcaccagcataaataaatctggatatgccatgtgagaacacagcatcatcacagcaaatagtctttagcatcataaaactatcacataaaatgtagtgccaagtgcactacctaaaaggcacatgttataagtagtaggggtcattgtcaatcaagttaagcaatgcaggggggaaagaaattgtcagaggaacaacgaagagatcatctgtaatatcgttttgagacatatttggcttgaatctatacaaatggcagcagaatacttgcaaggacttttgtcccagtgtgaagaggtaacaactggaattgattcaacgtctattaacattggtcatggtgctagatactgagaatccaccagtaaacaggaaagacatagtccctatctttgtggttggttacattttagtagagaagtgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaaggaaaccaaggagttcttataataccagaaaacttagaagcccttaatgcacaatattacactgacctacaaaatgaccttcgcacaaagttaacttattaagaagcaaggaaaataggtagaaaggcattgttggtacaaatagaaacgctgctaaaatgccgagtctggaaaatttgaaaaagatcttaatttccaaaactgtttctgctcagaaagaagtaagaggaatatcatttggtgatataaaacttggcccttttgagagtgtgggagaaaatgggtggagaactattgattctgacataatcactgcaaattttctacactgtcattgattaatttcttcaataaacatcgatttaggatctactgtgttctagggctgtgctgctctgtctaacacaggagccactggctgtaggtagctaccgagcaattgaaatcaggctagtgagacggagagactgaagtttaacaaatttttattccattttattaaatttaaatataaatttaaaaattgactcttggttcagttattgaaaaacttttgtgtatgtttggaacaacttaggaatgtgaatcttcttttttcaactataaagtttatgaaatgtaaatagagaccaaatattttcttttttttttattatactttaagttctagggcacatgtgcacaacgtgcgggtttgttacatatgtatacatgtgccatgttggtgtgctgcacccattaactcgtcatttacattaggtatatctcctaacgctatccctcccccctccccccaccccacgacaggccctggtgtgtgatgttccccaccctgtgtccaagtgttctcattgctcaattcccgcctgtgagtaagaacatgtggtgtttggttttctgtccttgtgatagtttgctcagaatgatggtttccagcttcatccacgtccctacaaaggacttgaactcatcctctttatggctgcatagtattccatgatatatatgtgccacattttcttaatccggtctatcattgatggacatttgggttggttccaagtctttgctactgtaaatagtgccgcaataaacatacgtgtgcaggtgagaccaaatattttcaatgaaaatacggtgtccaaattgagatgggatgcaattgaaagacacatgccagatttcaaagacttagaatggaaaaagcaaattttattaatactttttattgattacatattgaaataataatatgttggatatatcagggtcaataaaatattagtttcacttctacttttaaagaacgtggctactagaatacttaagattacataggtggctctcatttctatgggacaacactgttctggacattgtgctggcattgggaacataaaactaaacattcccttaaggattttacggaatggtggtacatttactgctatagcagagagatatagaggaatgcaaaggacgctatggggacatagatgagtagcaattaaattaggctgatgtcaaccatggctacctaaaataaggcatgcttaaattgatccttaaagtttgagtggaagttagatgaagaaagacgaagggtattccaggaagacggaatggcatgtacgataacattgggagaagtagtacaatacagtgattaagaatctagaacctctaccctttgagtcatatgcactcaagctgtaccacttactatctgtgagatcatatgtaaattacttatctgtatctctttccttctctgtgaaatagggatactactactgtcaaccttataaagttatcgtaagaaatgcatgagttaatatactgctcagaactgtgtctggtccacattgtatttcctgctattattgtgaattagaaaatactcccacaggttggagtaaagggaatactgtctgtgaaagtgtcagggaagatggggctacagaggtgaccaggcatcatgcattcaccagagcagtttgaccttttatccttcaagctgtgagaggattagtcacatcttgaaaacatattccaggcataagagtagcagagcatttagatggatctaaggcaatagataagagataagaggccaatgcagcaagctagttgagcagtgctgcggggccactgcgaatagagggcagggcatgaataaggtggatatggttgctaaatgctcttgaaacctttctctgcttctttttaggtatctagctagacttcattttccagcccctctgctgttacatgtggccacagggcagagttctagccagtagaaggttgagtcaaaggacatgggacgcctccgtgtgcagtcctctagctcattcccctttgggctggctgaatatcttcaggagggcaacctcggcaattggctattgcagatggaagacccttgctggcctgttttttttttaatttattttttattttttatttttattttattttattttttttagatagagtcttgctctgtcgccaggctggagtgcagtggcatgatcttgtctcactgcaacctccgcctcccggcttcaagtgattctcctgcttcagcctcccaagtagctgggattacaggtgcccaccaccactcctagctattttttgtatttttagtagagatggggtttcatcatgttggccaggatggtctcgagctcctgacctcaggtgatccgcccaccttggcctcccaaagtgctgggattacaggtgtgagccactgcacctggcctggcctgtattcttgaataattatgtgggtgtcacccctcccttcccacacacacatccaacaccaactaacatgaattcaccttagactgtttacatgagaaagaaatacatttctattttgtttaagtcattttaatagtccatttggtggatgtttaatatattatagctgttagcctatcttagctattatagatatgaaacatacttaaagagctaaaagcatttttacgaggaaaaaaagacttgatgacagataagatatgagagtgatgaagaaagttgtcactaaattctttgagtagcagggcctcaagtgttatcttgagtgcaaatataaacagtgaaccgataagtatgttcttggtgaactcgccaaagtaaattttcagccagcaatgaacaacagtaagaagtaggaatttggtgaggttaaagaaatcaggtatcttcctcaattcagcagaaaagaggtcaagtttcaaaagacattgggaagtgtgggtgaccctcaagaatttagataagaagaggaaaactgtcagagtcatttggttaaggtattgataagattcaagctatgcggctgggtgcggtggctcagcactttgggaggccgaagtgggcggaccacgaggtcaggagttcaagaccagtccggctaacatggtgaaaccccatctctactaaagatacaaaaaatttgccaggcatggtggcatgtgcctgtaatcccagttactcgggaggctgaggcaggagaatcacttgaacttgggaggtggaggttgtagtgagccgagattgtgccattgcactccagcctgggttacagggtgagactccgtctcaaaaaaaaaaaaaaaaaaggattcaagttacgctactccaaaatccacaatatggcagcttggtatttgagaagacagcagaagcaggatggtcactctcaccttccccttcccccttctcccctgaagcaggtcatgagactatcataccagaggtgcccttactatactggaaggaaaggaaaatttttacctctgaaaacacagggacacaggaggttctgcagaaacaggccttgctgtggtcaccccagtttattaccattcccctttgtccagtcatactggacatctacttttcctcaaatcagagcataaaaatacacacttttccctgattctttgggtcatttctgaaggctcctgtgtcatgtgaaacttatattaaataaattcgcatgcttttatgttgttgatttgtccttcattataggtgcctcagccatgaacctagcgatgggtgagaaaagagatcttttctcccctgtaagagtcaagtagattctaaaattctaaacaagcaggtttcgggttctcagaaaacagggggttgacaagaatggttctgacatagcccaaactgtgaaaactgaattatgattccaaggcaatagcatttaatactcatgcttgttgaataggcaagggcttccagaaggaagatcagagcctggtcttttcatctctggaaacctagatgtggtttactcttagaatgaaaaagggctaagtcttcctggggctctaaggactctccctgtgttgaatagaaaaagggataaaccttcaactgggtttgtaaaatatcgttgttccatggaatcaaattcaagaccaaggtcaaaagtgatggtcacatcttgctttctctgaccctacccaggatcagaaccagagccttcagctggcagcccattccttctgctgctgaaaccaatcctcaccagccaggcaattcagcagaagctcactcagggacagcatggaagaggcgtgagatgaatatcgctgctgccattctgttaaccggtgtgagctctagacttcatcatgattactatatttccttctgccttctgggattccttctgacacttgtttcagtttaagaaccatgtttctttctcaaatcattttccttatgctgtttcttcacaggaatgatacacttttctcatcataatttttgaaaatatgttgcaaaaaaatactgtgtgctatctgcagtgattattctttcctttgccttaaaaagaaagtattctagggaaaggatggaaaacaccacagaagttgtgagaatgggcatttgtgatttctaacaaggatttgtcagcctttgactgctctggactttaccagccacagttgctgaagacatgcagggtgaaagatcagcccttacagctctaaatcaatgaactccttaaacctgcccccaaatgtatcaggagctggaccctccactagcaggcagggtctgagatttccttgagcactcactatgtgcgagttactgtcctaaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacagcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaactgaaacctagctggtacctaagaattgcttctttctaaataaagcctactatggccacaccaccttcccaaactaaggtgctgaccgatgctctcctctccttctaccagattccaacctttagttattcatattttagtcatttcacttaactttacaacttcctcttgcccactgattttggaatagctggtttcctttcttgaagacttgaataccaattaccagggcagccctctagcctcctgtctccagcagttagctgctacagacattatgcttcttgtcagaggcaatgtgggtcatgctttacctctaaacagaatagccccctatctatgacatagaataggaaatgcctgcaggcagggatctggtcttattaatcttcatatctctaacactctttctgttcttagcacatagactattcttaatacgtgaatgaatgaaggaatgaagaatgaatgaacggctattgaaagatatcaatcttcattttcctttcccactgttaaaaatcaaagcgataactcaaatttccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttataatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacactagggacctcctagtgcatggggttaaatttcacatttgtgagcagtaagcatgtgtttgctggcactcttgcagcatactgggcatgctgtggaaggatcagagaatttttggaattgtgcactaaatgtctttgttctatacagttttaaataaatgagtcattttcagacttggagtttttctttaaatctgttggtataaaatcctattttctaaatgaaaccatactcaaaagtggaatatatgaaagagataaaagatgaaagtattcaagtgggttagggaaccttggaaagagcccattcaatccctcttcccatctctccctttggcctctgaggcaccttgcagaactttctagaatgacttgaatggtttgcatggtttgaattcgatttgcatggtctgaaagcctccagatctggagcaacactcatacttttcaggtgaggtaactgggatttaagaagttcagggatttttgcaaaatcacaccgacaagtaaatcagttgagagggaaggaaccagagtattttcgtagcaccaggtcttggggcttttgacttcaatttctcattgccctgccccctggaacagtgccactcaatggttcataggttgccagcatgagtgtcatcacctgggagctggttagcaatgcagaatcgcaggccttgccacagacctgctaaatcagaatctctgtggtgggatccagacaactgcattttcataagcttgccaggtcattcttaagcatcctcacccttgaacatctttcccgtctttccttttcttctggtcatgattcctcaactcccaagctcaaaagtagtgaaaatgttgttataaaggaacagaaaaaaaattaggagaggaatagagagtgaaattactccagagcctttattccctcacctcaggtcccactgaagtcattttggaaattatgtagctttttctttttcttttttttttttttttgagacagggtttcaccatattggcaaagctggtctcgaactcctgacctcaagtgatctgccctcctcagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgattttttttaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattattatctgactcttctaaaagtttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactacagaggactcttaagtattgtccttcatttagaatcttaaacaatatcattacatatgtccttttgattttcaatgaatacatatttacataaaatgtagtcatttctcccacttcttcattgttgaaattgccttcgccaacagctatgcagtgtcaagatgggatcagaatgtgtgggagcagatatttttttcagtcatgctttgctgacatatgcactgttaacgaattaccactgaaacaatatatgtgtctaagaaacatgtagaagagctggctgttaattcttatctatgcgagaagaagagaatatgagagtaagaagaacttggtttgttgagactcaactttggctaaattggaatcattaaagattaaaaacaatgatatctgggttccccacaaaagtctgatatcattggcttggggtacagctggggcatttttttaagcttccaagatgatgctaatgatcattagcgtcatttccttataggtcacctctaacctaaccacttcacagtagttaaatctggctatgatctgtactagctggtatctggttgggagaatcactagtactgggtttttgtatttctgcccagccaggcgttgatcatattttacattaggatttgcataaaagaagcaggccaggcagtggccctatgttcctttccccacacaaggtcatacataaaatatattattattttttattttttccccctctggccttttccctgtaagtatatgttatcactttgatacaaatgaatcataattgaatactcattcactcactccattcacttacttattcattaatgctttcattaaatatttattatgtggtaggtatacggaagtacaaaaaagtacaaaaagacctcacaaagcttaagatctaaacaggaatacaaattcatgggcaattgaaataccatatggcaaagggtaagacaaatgtactgaagtagcacattgaaggtgcaggagatccggtttgggatgttcaggaatctatttatgaggtgctgtctgaaaagggattattaactagctaaacaaaggtgatagaggagagacagattgttcctaggagagggagccatttgatggagggccagaagcaagaaacaaagatattttatttgattgtagagttcagtaaagagggataaggcttgagtggtcacacggagtgagagcatgaagggccatgtaagtagtggaatgctagtaaatgtcaaataactggctctaggggagggcagtggcgctaattgtagcatttgccaatttctgtggtgtaagtgctctcacaatagctgatttcaagcaactaacttgatgtcattgaatgaagaactcagtggaaagagatacacataattggctcttggaatgtgttaattagaagataagtagttagcaagcagagcatgtgtgtactaaacatagatagtgagggatagaaggaccaaaagatacccaatattcatgaggcacctgggtactaaatattcataatatgctaaatacacatgagaccaaatatacaagaggcactaaatattcaagatcaaataaatacacatgagcacttaatgttcacaaggtcttaattcaggcatccataggtgatacctattccagcaccgtaagtcttctgcctgagaattacatggctagtcatcaggctattttggcaagttacagctgtggccatgcattcttgtctctgtgtctctgataaaccacatgccactgaatcaggcaccacccattttggactcccttgttgggaagtcaactttggtccttgtaagcacaccataattgggaaggctgatgcaatacagagacagacaagacatataatgttgtgtactgcagaattcaagtactctaatcttcacagtctgcttacactctattctaagcgtgttaacttagcacatatctttcccgtttgcttctcactgtgattttaataaactctgtgattcaagtattttaatttggtctatgagcctttctgtttcatgatttggataggctgcctggtagtatacttgaaggccatcattgcatttaagtaattccccagatgacagaggaagtttatcataggtgaaattttaaaagatttatgataggtgaagtttaaaaaaaataataataattggccgggcgcagtggctcacgcctgtaatcccagcactttgggaggccgaggtgggtggatcacgaggtcaggagatcgagaccatcctggctaacaaggagaaaccccatctctactaaaaatgcacaaaattagccagacatggtggcaggcgcctgtggtaccagctgctcgggaggctgaggcaggagaatggcgtgaacccaggaggtggagcttgcagtgagccgagatcacaccactgcactctagcctgggtaacagagtgagactctgtatcaaaaaaaaaaaaaaagaaaaaaaaataatagtaacttaaatttttcaagggggaaaaacacctcggagttgatgaagatcattcgttgaatttgcttaatcatttgctacattttaaagaatgaacttgacttcctgtgaagtgaaaaaagcaaaaaaaaaaaaaaaaatcttgaaatggattgacttctgaaatgatttgtgaggccacatccagaaaggaattgagaaaaagtctttaaatatatgatcaaagaaatgttgaattaaaaaaacccaagcatcatattctgatgacacttgctcattttcacacgttcgttccaaaaatattaaaaaacacaagagatgaatcatttgatgacatttaaaacaatgcaaaaataaatttagatctaaagtgtcattgaaagacctaattggattagaaagttaatatttaaataaataatattcagaaacagagaggattatgctctggcctttatttcaatgtatgttatcagtaaatgccactataaaattaaatatgcaatttggagaaatttaatttaagtttgttgggatttatttactgcccatttgtttaaaggcattctgctagatactgcagggggctacgaagatgaaaaatacattctcaggactttacagtctaattacaactatgaagaatgttctccaaagctctaaatacaatttagtacaaataaagtacaaataaaaagctaaagaggtttgaagaaaggagaaacatagctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacattggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaaggaggggaaagagaaagggtagagtgtagtagaagagggggaaataagattctaactagcacaatgaacagatttgagttacatatgtacacataaaatcggcatagacgtgatactcacatacaaatacagattggaaaaaaaaaaaaccccactgggctacgaggagtggagttgccaccattccctgctatatatcccctctagctggccttaggtgacttctcctctctttcaaggctcctttagacattctagaatgaaaatattgcagaattggaatgagagaggcatactgtttgatttactctcttagataaagcctgaataatttcgcttataacaatgacagaaattattggaagataacaaagtgtcatgtgaattatctaagaaagataacattagggtggaatgaagagctctgaagagtgccaatatatgaataatacacattatatggagaaagccttttcttttttggtgaatacatgattgagtagaattttacgttgctggaaggtagagtttgttcttctctctatgcatatatacatggaactagtctccacctgagagcttatgacctctttctctctctttggtgttgaatatgtgtgtatatgtgtgatactgcagtgcttctcaagctgcaacgtgcgtgcagatcccttggggattgtcttacaatggcggattctgattcaacagttctgaagtggggcctgggatttcaaaattctaaaaaaactcccaagagatgttgaggcttcaatcacactttgcacagcaaggtgatgctcttttaagaaactgaagcaattactaacaaataggtcacataagtatgtaattataacagaagtgaatctgtgcacaaaagaaagaactatgaaagaattatgtctgagttatatgtgtatatatatatactatatatatgtgtgcgtatatatatatatggacatataattggcattattattactgtgatagaaagacctctcttctgcaagccaaattatctttcactttgttgcttcttgaattcttttcttcttttttcccctacaattgcatctccagatctccttgaaagggtcaagtagaatgcctatgggctatctaactatgttggtaaggagtttgaattcaatgacattcaatgcatatctaagccaagctgtcacaacacactcaagcctgccaaaggagttcgtacaaatctttaaaataatttacaggagagacaaaattaccacatcattcccattatcagaagaaataattcaaattaagaaaaattagaaataaaaatgaagagatgacactgaagaatatctcaccactggaagatgactttcatctacagtgatctctctataaagcaaagatacttttcagctattattcagtaagtgagtccaacagtttcctctgatattgtgaatttaattagtaggcaatttgctcatgaaatcagaatctagcccttcccttgctgggttgctggatctgtgtattcctatattcttctctagctattgcctcatttctcaaattcctttcatgtcttcatctccattccttatttccacctccctacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtagtccctgacactgccagccacttccttgtctttgagactttctccttgctcaggttcctagtcattcttctcctttgtagcctgccattttctggccacctgcttagctcctacaggaaacacttcataagtgttgttttctgttagatatcctgcctgagaaatcacacccctactcttgcataagtgggaaattcttcaaatcttaggtgaggaatgttagatggcttctcttctctttcaaggcttgtgcatgcagatcttttggggatcttcttacaatgcagattctgattcaacagttttgaagtggggcctgggatttcaaaatgccaacaaacccccaagttatgtcaaggcttcaatcacactgtatagcaaggttgacactgtctttaaagaatgatgcaattactaataggacacataaatctctaattattacagaactgaatctatgatcactaaaaaaggaaccatgaaagaaaagacattatgtctgagttatcataccttggctaaggtagtaccaagataagctcttcacaaagctgaatgggcttcacaatgatcagggtggtagaattcagtgggcccacaaactcctttgcaacttatattacggatagggacatttcaaaatagacactcgaacagacagtgccgtgatctgtaagggttcaccaatatgtgcacacttaaaacttatacccattggctgggcccagcatttagattggcagcaagaccaacccctcctctccctccacctcctcagcctacttaacgtgaagataatgagaatgaagacctatatgatgatccacttccacttaattaatagtaaatatatttttctcttccttatgattttcttagtaacatcgtattttctctaacttactttattgcaagaatacagtatatattacatataacaatgcaaagtatacgctaatcactctttatgttatcagtatggcttctgtcaacagtagcctattagtagttacgttttgggggagtgaaaagttctacttagatttttcaatgtgttgggctcagcgcccctaaccctcacattgtttgagggtcaactgtataacactttccaaaggctccctttgccctgttcttagacacggcccagcatgaatttgtggcaatcttgtaatgagccacatactgtctaacaagttggatgctaattatacaaaacttttgaaaaaagggatcaaagttcctacttcacaagcttgaacagctgtagcctcaggaactttctccagattgagggcaaaaatcctatctccaggaagccaaatttgcagctgccacactctcccaaaatcccagttcacctcagggactgatggggagtcagtcatcatacttccttcccctttgggctgaaactgaaaaagcaaaaaacggggtgggagggtagaaagaacaggaagggaggtatcctgttcattggagaggtcctaaggaaacctggctggagtgaaaatctgctgtgccttaagcaccacccttccatccccaggccaatacacatcatattactctgttgtcctccttcaacagtgctagttacagactcaagtttaccattagtatataatagctataacacttgtccttaaaatgcgggttaactcaatgctgctgggcatcaatctaaatatattaaggtaggcactactgtactacaactctaataataataatcaataactatcatttattgaatggccacatggcaggtactatgcttatcagggcttccctgtctgctcagcccatgtttctttgtaaaacacaacatattaaaacaacagtatttggagacaaaaatatcttcaatccaaccacctcataataaaaccaacatattcagttttctatattatcttatcgtccttgtccatatacatattcaatggttatatatttgcagtaatatttatattccaccttttcactttttgtgaaacttgatacattatttgttcctctttcattctcctttgaaaatccaaggtaacaaatactgataacctagtatatatctctccattcctccttcatggttatgtaatcccataagattaattttatcttttttattttaaaaatggaatatgttaattgaaacttgttttgatttttgaaagatatcatcaccattctttcaggacagtagacacagctctaactagactaaataataattcattctgggatgcccaaataattccataacatattcaataatttccacactgaagggtatttgcttgatttctactttttgaccatcatagacaatgccaaaatacacatcctctacatacagcctttcatactggtacttttatttctgtagtattgattctcagaaatggagtgactgatcaaaaggtaagtgcatttaaaatttttgtagatcataccacatttctttcctcaaagaccacagcaatttgcgtttcatctgcaatatctgagagtgctctcttccattaaaaattatcattcttaatttctgtctatttgttagatagacatggtgtcttatttctttattttcctatcccttactactatgaggaagcatattatcatagttttatttttccagctatctggatatcctcttctgggaattgcatattcctatacttcggccagttttgtactgggttgtttgaattttaaaaaatattaatttaattaacaaatttgtaggagaaatttgtatattaggtatatgcatctctttatgtcacatgttgcgaatacatctactctatttgctgtttttcttttgactttgtcttctgttattttaagcagtaacaaggtatattttttccttatagcttttgagttttgtgtcttgtttagaaaacgtcttcctcattccaagaatttttgtttttacatttaaaactttaatgcatttgaaatgtattcttacattgcataagctaggaggcaatctgtgttttctaagaggaattgcaaagagtgctggcaccatttattgaataaaacacctttattccttgaattaaaataacacatttgccatataatgtttccaaaaacaatttgtatctatttatttatttatttatttattttttgagatggagtttcgctcttgttgcccaggctggagtacaatggtgcgatcttggctcactgcaacctccgcctcctgggttcaagcgattctcctgcctcagcctcccaagtagctgggactacaggcgcccaccaccacgcccagctaatttttgtatttttagtagagacggggtttcaccaagttggctaggctggtcttgaactcctcaggtaatccacccacctcagactcccaaagtgctgggattacaggcgtaagccaccatgcccggcctccaaaaacaatctgatctgcttctggactctcaattttgcttcagtgatctacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaatgtccaagagtgcaattgctgggttgtatggtagctgcatgtttagttttacagaaaattgataaacagtttgctacagtggctgtaccattttacatttccaccagcaatatgtgaatgatccattttctccacatccttgctagcatctggtgttgtaactactttgttttagccattctgatagatgtgtaggaatatataataattttaatttgcatttctctaatggctaatgtttttgataatcttttcatgcacctatttgctatctgtatatcctttttggtgaaacgtttcttgatgtgtcttgcccatttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccatgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactttatttacctttttaaaagactgttttagttattctgtggcctgtgacttttcttatagattttagagtatgcttgtctatgtgtacagaaatccttgataagattttgatagaaactaaattaaacctttagattgatttgagaagaactgacatatttgctatgctgactcttccagtctataaacatgccatataatccacttatttaggttgtttttaatgcctttcatcagcattttataattttctacataccgatcctgtacatgtatgatagatttatacctacgtatttcatttttggataagcaattataaatggtgttgtgtttttaatttcacttttcacatcttcatttccaacatagataatccgtaagttgtgatggcttgccttatgattttttgactttatgatgggtttatctaaatgtaagcccatcataagatgaggagcatctgtatataaaaatgtgactagctttggtgtgttgatcttgtatttttggatcttgttaacctctcttctcagctccatgagcatttttggttatttttgcttttgtttttgtagaatatttgatattttctacgtacacagtcatgccatccacaaatagaaataattttattttatacttttcaatatgcatgctttattgtttttccttgctttattgtagtgtctggaacttccagaactatgttaaaaaagagtagtgaaattgggcatccttccctaattagcaatcatgggtggaaacattaagccttccattattaaaattatgctattaactgtagttttctgtagataccctttattaagatgtggaagttatcctctattcccagttttctcatagtttttatcatgaatggatgctgggtgttgtcagatgcttctgcatcaatcaatataatcatatgattttttcttctttagtttgttgatatggtagattacactaattaactttcaaatgttgagccagccttcaatactaaatcccagttagttatggtatgacactctttttttaaactttgacgcatgttatttaatattttgttgatggtttttgtctctaggctcatttatttattttagacctttcctgtcttctaactaaataatctaatgctatacattttattctcaatactgcttttatgacatctcactttatttttttttgccagagaaaaagactagattactcacagcaaagcagtagtcaaagaaccaacattttattgagccagttcccacagagtaatcccaaagaagttcaggagacacctgtacacacagtggattgcatcacaggagagaaaccctgagcttaaggaagcttaatctttaaaaatagacagtagatatgcttgccctttgcttcagaatctcactcatgttgatgttttattttcattttatttagttctttgtgtttaaaaaatttttctttgcaacctcctccttgacctggggaaaatgatttaaaggtgtgctgcttcatttccaagtgttttgaggtttttcttttgtctttctcttattgatttctagcttggtttcattatgttctgggaacatataagttgaattctctaaatttgctgaagttgcttggagtccagaatatggcttatatcagtgaatgtttcatgagagctttaaagtaatgtgtattctgctactgttgggaggagtgcttcaattagatcctattggttgatggtgttgttcagttctctttacccttgcttattttccatttagtagttctatcaactgaagagagaggagtgttgaagtccctaactagaaatatggatttgtctgtttcttttttcagctctattcatttttgcttcatgtatttggaagctctgttgttaggtgcaaacacatttaggattattatgtcttcccagtgaattaacacttaatctttatgtaatgtccctgtttgtcactagtaattttctttgcaatgaagcctactttatctgatattaacattactgctgctgctttcttttgattaattgttgcataatgtaactttttcgattcttttaattttaacctacctaggttgtatttgaaataaacttcttttagacggcatattgtgtgctcagcttttatcaatccactcagctaaatctcttttaattggtatatttagaccatttgcatttaaggtaattatggatatattagggcttcaatctgccaccttatttggtttctgtttgttttctttatttctcattcttctctttcttttttcttaccttcttgtgggttatttgaacatttcttaagattccatcaaaatttatttgttgtattttcttaacgtatcactttgtatagttttttagtggtctttccaggcattacgatacgcattaacattgcaatctactggaattgacttcaggtgacgtgtagaaggactcttacttccacttaggtatgtcttcttttaaaatataactcttaagtattttctctacatacattgagaaccacatcaggtggtgttaaagttttcacttcaaacttatggtaaataggatagtctattattttactctcatttttacccattctactattttctttctgaaatgtcaagacttcgttataatttcctttctgtttagagaatgtctttttgtcattctttaagagcagatttgctagcaagaaattctttgttttccttaatctgagaatgtctctttccctttaattccttaggaaaaccttaggagttatctgattatctaagagtctgtaccttagactttggttatgctattttgcaattctgtacgtttaaaagtcaatttgtggagggctgatggtgacacaaatgattcttgttcactagatgccagtaaaattttctcatggaacgcaatagattcctgccctacagttagtgatcagtattgtatctgttataaaattcctatcagcattctagagtgttttttatatatatatgtgtatatatataaaatatatatatacacatatatgtatatacgtatatatacgtatatacgtatatatatgtatatacgtatatatacgtatatatacgtatatatatatgccaattcttcagactctcctttgaaccaactgtaactaacatcttactaattccttcatcagttaatgatctaataaaatgttttacacatattcattttatatttttatgggactcacaattttgtctctttagaaatgtagccttatataaaatacagacataaaatgacccattaattcattattttacttacaaaaggtacctatgtatctgaaagttttctaagtgcctgacacacagcttcccctaatgataactcttctgtacgcatgagagatttatctaaacatttaaacaaacactgatacaacactattaacaaaactacagactttattcagatttcaccagtttttccactcatgtcatttttctgtttcaggatccaatccagaatctcctactgcatttggtccttgggtctttttggtctcctctagtctgtgacagtctctcagtttcttcttgttcttcatgaccttgaaacttttgaataggactagtcaggtatattctagaagtctcttaagatttgactgaagtattttccctattagaagaagttacaggttttggggaagaataccagagagataacatgtccttttcatgacatcatatcacaggagacatgatatcaatattattatcactggcgatgttatacttgactacttagttaacttggtgcctgcctggtttcttctccattgttattcctacttttccatattctattatctggaagtaagttaccaagttcatggaggggcttaggggaggattaaactctacatcccaggaaaggagtatctatgtatattattaagaattgttctataagggaaaattttctctcaaatatgcttttttactaaacagagaaaacacattattatctgagtggttgctatatggctaatctcatttaccttcttttgtcaattcataaactggtcttttttcccttttcgggccagtataacttaataggattgtttatcttatgttattaatttatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaactactgacttagataaatactccctgaactagagtcctggaaacctttaggtggccaagacttattctaaagaattgctaaaaattattttcttttaaaagagatgccgggaggagagagaggagcagaaaagataactactgagtagttggcttaatacctcggtggtgaaataaaatgtaaaacggacccctgtgacaccggtttgcctatgtaataaaccttcacatgtaccccacaaacctaaaataaaagttaaaaaaatgaaaagaataggaatagattaaaaaataaaaataaaagtgatttcacatataacaaatgtttcctatcattgcataaggcaatgctgcttaataaaagaaaaatttagtatagtagaatcgtgccgcagtcatgagaagcaacccttccccatttctcttaaccaacacaccttgaatccatcaaattaaattcttgcataagaggtaaccaccttcagatttctttcttagacctgtatctctaaaagaaaacatccttaccactttagtgcagactggcctggctttcaactatgaggatccacattttttttccctaatggctttagacatactctggacacaaaataatttttcttgccaaggtggtatgccagaaatgctaggaaaataattcccccgttggaagcagtcctaaaccaatgactagcaggattttgtgtataaataccccagctcccttgcccctttgaaagaataactaactcttaaacacatgtcttcaatccatttagaatttccccagtgggattaaactccactagaccagtggcagttggcttgataatgcattttttactgaatgatttctcttcacagtctcactatcttacctcacattcatctctgccttctgcagtagctggtgcttcacatttctaggacttcccaagttctaagtacttggaattcaggtttccaagatatgctaactcctccattctctgcatattcctaaattttttatcttttttattttattgtttttcctcccagatttttttctctttgtggtaaatatcattttaattcccctattctcattttagtgaaggttaaagagacatcatttttaaccagaactccctataagtgatctatggaaagaaaaaattagcaagaaaaagacatttgactagttgcatgagtcaagggttaagtaaaggagaggatgaaatttgtgataatttaaatttagctagtgggaggttgcaaacaaagactcctctctctgtaagctagaattctttatagccttaaatttcccaggtctagtttagtatttatatttattttcctcactacttttttactgcaaaatattcggaaaccatttgtaactttaagtcacacaattctaatttaatgattaggttaaagcaacaaaatttcctactaattttgtagctctataacactcagatattggcaatcctatatggctcaaactaatactttaacatattgtttatggacatactagaaattgtactgtgtatgctaacttctacactgggatctagattttgtacctctggatcttttctaagctgaataaatatgttcatacaaggttgtactctggttaacattctgtttatcaaaagacatgataatcatgtatatgaaacatgagaaaatttgaatcagttaaactgaaagatctacttagaaaaacatctacttcttctccgagtcacattcttgtgaattctggctttttaaaattatttttgaaattttagtaagattacataaaacagcgccatgtaaactataaaggatcatatacaaatgaagcacattactattagtaattataatgcaccaccagaaataagagatagaaggccctttaacctattttgactatgagacaggaggatagaaccaattcccccaacagccagggttcagtattattaataatgataataaaatgaatctactaacaacataccaagccttcacaatatgcagggcaccgtactaagtgctttatataagttttctcatttaatcttcacaatattaatctctactcctattcctctatttagaaaccagacctggagtgattgagaaacttgaaggaaaatcacacagtttgaaagtgacatagctagtgttcagaaacagagtctacactttcattactatcctccactgcaggataattccagtgcaaaggatgatctgtttgtttttttttttgtttttttttttttttgaggcagagtctggctctgttgcccgggctggagtgcagtgactcgatctcggctcaccgcaagctccacctcccggattcatgccatcctcctgcctcagcctcctgagtagctgggaccacaggcgcccaccacaacacccggctgattttttgtattttcagtagagatggggtttcaccatgttagccaggatggtctcgatctcctgacctcgtgatccgcctgcctcggcctcccaaagtgctgggattacaggtgtgagccactgtgcccggctgcaaaggattatctttaagttaaacatagaaataaggatgtaaaatggaatttagaattctgaagtctatcaacaaggaaactagtgctatgaaaagctaggtaatttgtccacaaatacccagtgctacctgcggacagagctagaaaagtgcccatatggtcatttacttcaccaccaaagtgaaatgcaccaaaccaaggggaaatgacttctctgggagtttaacaactctacttttttttccctcatttaattataacatggtctgttaacttgcaaccctctatttgatgtctcttcttttttcagtctttagcaaattccacatcgtatttggccaaatcagacataaaattaacatcaattcattctcaagagacaaaataaaactacgattttctaatcgtagttacttttctcctaatcttttgcaaatgtcaccttctctatgaaaatgctatgttcaaatgacctgtgtaatatttcatggctctaatgcaatcacaaaatatatattcggtatcaagatatataagatacatgttaataagtccctctaaagttgtcaaatttacactatcagaatgaaagattcctgagggctaaataaattttgtctctacctttcctcctcttttacaatgcctggtcttgttgtataaacacggtgtttcagtatcttcttgatgataatgaggtggatttggccaatctagctatttaaaaagtctgctctgttcttttaacttagttttgtagatgtataacaaaactagttatggaaattctctgagatttagataaatcattttttcacataaaattggtgctacagaaataatatgtggactataagctttcactattattgaacatttggccatatctatgaactattgagacagttgaaaaaaaagccacagctggaactatatcgagctcaactctgcaacttaattgtgaaataaatacaataataataattgtaacagcaggacctaaatcatgctggtgtaactgctgggtttgtcctcagatattaactctaaaggttatattcattgtggtgccacctgtttggaaagaagggcacatcaggattttgagtacatattttagagttttcctttggtactgtaccatataatatggaacactaaaatcacaataaaatgtgtctgctttgtgtgaaggtaagtaagtgccaagcttattgtaaggcatttcaaatcttggacacaacgccttttatatttcaactaatatactgggctgttgggctgtgctcatttttataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaatggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagtgtagtaaaattataagaatgatattctgatcacttaattcaaaactctttgctttctgctatgggactgttgccacagaaaatttcaaaaattacttttttttttttttaaagacagaaagcatcttgaatgagagggcctgactttgtatccctgttaatatgtacgttctcaattactccatagaaaccatatatgaaaagtttagttctgcttctttgctcccaagtctcatttcttactagcatttttcttaacatctggttcaatgttcacagcagatcagctttcaaatacttttttttaaaacccagaaattagtcaattttacatttacaattataggtcctttaggatattctaacaagtaaaaatcctaaaggcaaaatgtatgttttcaagtaaaaatatatgaggttgtttttttttgacagagtctcactctgtcacccaggctggagtgcagtggtgcaatcttggctcactgcaagctctgcctcctgagtagtgggactacaggcgcccaccaccacgcccggctaattttttgtgtttttagtagagacagggtttcaccgtgttagccaggatggtgtcgatctcctgacctcgtgatccgcccgcctcggcctcccaaagtgctgggattacaggcgtgagccaccgcgcccggccgatgagttattatatatagtgcttcatattatccatcactgttcctatgctagaagtcactcacaaaagctaaagagttggcatagctatttagcaaatataaacaaatatctgcttcctaaatattttaaagggttagtcattattaatttttacaaaatgtattgcaatcacattaatcgcaaccatataatatctttgtaatgtggatataagttattcaataggcattcgttgtgatattactttaattaatacttgttttttgtaaagtattacccgccttttgatggcatgtccttaatgactacccctcttttggtgagtgccagatcactattaattccttttgtattcattataacaacatcaatcagggaaagctcatttgctattaatgtgaatataacaggtaattccattctaatctagtagtgattaatgttcacttggtagtaattacaatatcacatttcagagtgttagcactggacaatacttattttgtgtggccttttaaagaaccacagcagcttgtctggacttagaattgaaaaggttaaagaaaggcaattaatctaaggacaaagagaaaggattcttatgtggctgggaaaggtgaataatggttaagtgaagggtttacaaaatttgttactattttttggtcaatcagtatgcttcatatgtacccagtaatatcactacttgacttgtaaaacaaagaaaactgaaatcgacatgtttaaaaagccactgttttagctccatgatgccaatgaattttcaaactacatggattccctgtcctaaatgacagattactatcaatgtgagagttacaacttatctttaaaagaaggggcccttttgatgttatcattttatttgtaaattagtaaaaattaaatgttctacctaattttgaaccaaaattgcctttatattgaaaaaaatcacctaaaacacatcgatgatatatattaatattatagctttattctattttaggtaaactatacaaacttccattaacatcaaccagagagactcccacacatattgacacaatatgttatgttagatcagagcagtgctagtcattgagttttaaaatcctggaaatattaaacttactggagaacattataggttatctgtaggcatcagagatttataggctatatggggtggaaaatgcatgtgaacctcaaaacaaccttgaagtataggcaagacaggtgtcattaatcttatttcacagatgcggagattgatgctgagagaagttaagagacttgccctaaatcccactacagagcatttactggaacccagggcttttaacttattttcttggtctttccactgcagcccatgccatcctgcctccactcacttgtgacagcctgtagagaacagatgtaagaaaaattgccaagagtttaggagtatccaaataacaaaaactatcagactattagggtggccaggggagaaagagaagagaggaaatcaggaaggctgggatttttcaaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaccacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaacagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttcttgcacaatcacttgctcctttgaaccacctaaatcgctgtttcccaaaatgtggtttgctgaacagtagtggtagggagccaatttaccatgttacacagataaacagcttatagtttaaattttaatattcatttagttttatctgtattaaggaaaaaaacactgcaacatcagactacagttttgtgggaattatcacttaaggctaaaagcagaaaacaaaatgagctgattttaagaaaaacattaagtaaataatagtatatgtgttattcaaaagattgaacaatggagcgtatatttgtttcctattgcttctgtgacaattttccataaacttactggcctaaaacaacacaaattgattatcttatagttttggaagtcagaagtttgaaatgggtttcatggattaaaatgaaagtgttggcagggctatactccttctgaagaagcttagaggacaatctatttccctgccttttccagcattagatgctaccaacattgtttggctaatggcccctttctctatcttcaaagccagcaggggctatcttcatctctctgactcccactctcctgcttccattttcacttatatgaaccctgtggttagattaggcccatctgaatagtccataaaatctccccatctcaaagtcacctgcttagcaaccttaattccgtctggaatattaattccctactgccagggagcacagcatattcacaggttctggggattaacatcttcgaggggcccatgattctgcctaccacagggggaaataaaacttgctttagccaatcggatattgcaggcttaatggaagcaggggctcaacaaattgtttacatgtttgcacttccactcttcacctcagccttcacaaaaaggacttgctcgggctggttagcctgctggagggatgttcaagatgtgagcgatagagctgtgttgacccagccactttcagacacttaagctctcagctaccctccagattcccaagggagcccagtcagagcagataaactacccaatgtaaaccatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctttctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaatactattgcagcatataaaatcaagctgggactttatgggaagctgcgccttgctaatttaaaaggacacactgactacatgctgattggcttggggggaaggattgcttaccatgttgttttgtttctattttaattttcacctgcctgtctgcgaattttccttaccatggtaatggatttaaattaatcaataaggtgttatgaagatttaatgtcaaatacactttaaaaacctagtttgaaaacttccaggtctatttagcacatgtcgtagtgtggcttaacccatggtgcattaacaaaataaaggtcaaagttaaattttagaaaaaggggaacaatattcctcacaagacattccagtgggataaaaaacacaggtttttttctatattgacaaacctagattcttaattataataactcttcctaatggtctatatctaatcaggtacagtggaatattaataaacatgttttatattctctggttatattgttaatggatacttcaatgcactgaattagaaggcactacagtgcatattgttttatcaagggcaagtttattttgcttcatctatgtaaaaacacattattttttgaaaagataacttattatttaagggtaagagtattagaatattaaaaattgatcacagaaagagggatggatagatgaatatgtaataaatcaagtatagtaaaatttcaatggcaaagtataggtgctgggtatacagatgttgaccgtaaatttctttcgactttgctgtatgattagccattttaatattaaaacatcgacaacaataatcctaaattgtaagcactgtatctttacatacttgtataccagtgccaccattttgtagctaattccttttctgtaaatgtgattattaaacctttaacactgaaatatctggcacatgtatacatatgtaactaacctgcacattgtgcacatgtaccctaaaacttaaagtataataataataaaataaaataaaaattgaaatatctgaaacaaagttttagggggcgtgttcatcctgtacaacttactgagagatttgtaatgccctatggaccagaggtctagtctgaagtttgaggttatttttaaagaaagaataagaattcgttgaggatgggaagttgggtagaaggtctttgcggcagatggaagtattgggacgtaaggtggataatatccaggcagccttaaattttctgccacatatatcactcaaggagagtggaagaaatggggccttggagagattatgtcatgtgtgaccttgcatgctacaccaaggaggtgggaatttatcttaaaggtattgaagaatttcaaacatgagtatgggggtgacggcatcagccttcatgtcagaagataactctggctgaggaagtgatgctagatgcagaaagaccagtgaacaagttaccggagttttctaggatacgaatagtaatagcatcatcatcagcagttatagtgactattctttattaattgcattttatgtaccttactctctgtatggtaatctcatttaagccctttagtcaccctaagaaacagaaaactttatgaggaaactgaggctagaagagatttaaaaatttgccaacggtgacaagattcgaatcaggtatgcttgacttcacagtgataagggcctgaaaccatagagaatcatagagaaaaatctgctttaagacagacttaggaggtaaaatttgcagtcttttgtgtcagtgtagacatatgcataaaagagagaagtctcaccagaatcagaagtttctagcttaaataattgggtagatggtggtgccatcttctgaaatagagaatagaggcagtaggggatttcagtttgggacatgctaatgttaaaatgtctgtggccatgagtaagactcaaaatatttgacaactgctttagcaaaagcccaaccaaatagagaaaacactactcagtacaccctacctgtgcttatcagcaggtaccagtcctgtggtctaaatatagaagttcactggggagttgcagatgtcaatgtagaatggccaagaggggtacataggcagcatatgctttgagagtcatctgcttatagatactaattagagccgtggatgaagatgagatcacagaagagatgtggcatggaaagtgaagaagtgctgagggtaggatctggggagcagccatacttattatggaagaggctgaggatgaatcatcaggaaagagactcaaatgtcctatggagacaggtcaggtgaaaacctggggaagagggtgttagagaactaaaggagaaaattacaaggagaagctgagtcaggcaatttggcagggggtaggctattgattttcttagtgagagcagtttgcctggcacggtaggagtaatagccagataaatggactgaaaagtgagctgtgggtaaagaaggtgagctaggcagctctgctacattttcttttctttttttaaagttctatgattaatttttattttaagttccgtggtacatgtgcaggatgtgcaggtttgttacataggtaaacatgtgccatggtggtttgctgcacctattaacccatcacctagagatatatatatatatattttattattatactttaagttttagggtccatatgcacaacgtgaaggttagttacatatgtatacatgtgccatgttggtgtgctgcacccagtaactcgtcagttaacattaggtgtatctccaaatgctatccctcccccctcccccgaccccacaacaggccctggtgtgtgatgttccccttcctgtgtccatgtgttctcattgttcaattcccacctgtgagtgagaacatgtggtgtttggttttttgtccttgccatagtttgctgagaatgatggtttccagcttcatccatgtccctacaaaggacatgaactcatccttttttatggctgcatagtattccatggtgtatatgtgccacattttctcaatccagtctatcattgttggacatttgggttggttccaagtctttgctattgcccatcacctagatattaagcccagcatgcattagctatttttcccaatgctctccctcccctcgccccaccccccgacaggcctcagtgtgtgttgttcccctccatgagtccatgtgttctcattgttcagctcccacttttaagtgagaacatgtgatatttgcttttctgttcctgtgttagtttgctgaggataatggcttccagctcctcaaagatctagaaccagaaataccatttgacccagcaatcccattattggttatatacccaaaggaatataaaccattctattttaaagatacatgcacacgtatgttcactgcagcactattcacaatagcaaagacatggaatcaacccaaatgcccatcagtgatagactggataaagaaaatgtggtacatatacactgtggaatactctgcagccataaaaaggaatgagatcatgtcctttgcaggaacacatatggagctgtgctacagtttcacaaagtttggccatcagaagagggagagaattgacactaggtacaggtggaggggtgaaggagcagcaccggtaagcttggacaattgtttgtttgttaaaatgaagggtaccagagtggtaagctgacagcaaaggatcagtaggaaggtgacttaaaaagtatagaaggaggagattcttgacagaacaaggctcagaggagacggaatttagaacagggtgttagcctcatactcttgcaccttccatatcctatagtcacacaatagccagaataagttttttttttaaaggaaaataagtcacaaatttattggctattttcccaactagaatgcaaactccaatgaggcgcggtggctcacacctgtaatcccagcactttgggaggctgaggtgggcagatcacttgagcctaggagattgagaccagcctaggcaactggtgaaaccccatctctgcaaaaaaatacaaaaaattagctggacatggtggcacttgcctgtagtctctgctacttgggaggctgaggttggggggatcacccgagcccaggaggtggaggttgcagtgagctgtgatcataccattgcactccagcctaggcaacagagtgagaccctgtctcaaaaaaaaaaaaaaaaaaaaaaagaatgtaaacatataaactccagagggtgggaccactgttagctgcgagggacccgacttgccgaaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaaattgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtgagcaatgtgaattctcaggtcctaccctatctgtaactgaatgtaaaactctaggcatgggaccattcaatctgtatttctacaagtcctctagtagctttgatgcatgttcaagtcggccctaaagtgttggatttataacctataactgtttctttctagaaaacaactatgtcgggggaaaaataaaaagaaagttttctattaattaaaaacgtagaattcaagagctaaaggaatctcaggacaatgattagcaaagataaatatacaaaggaatataaagtaaaaatgcaactgaaaatggctgaagagaacgtggactaacacataatgtttgaaacagagtatactatttaaaagctacatatgtgctaaatctcagaattcttctttccatgtgctagtttgagaggcaatttatttctggcacaactgccatatgcatttatactaatgtgaaagacttcttgtaatgagaaggtaatacactgcatttagtaaactagttttcaatgtgagaaaaatgcctacatgaaaatgttgccctttaaaaagcttcccttgactattcctgtttatattcttgatagcagaatagctttgggaaatgttctgaatagaatccaaagctactctaaagataggctgacaaggttgtcaccatacagttcctatgtaccatgaatcttagaatcaagaacgtttgaatcaagacatttctcagagccaatctgagatatgtgtatatttatatgtatctatttgagacaactctcagggaacaagacatcaaaaacaaattgatcaaaaggttatacgctcaaatgaatgttgcattttaacgcagtgagtaatggtacaatttaggaactaaactctttttgaaactgcctttcaagacagtttgcaattacaaaagaaatgttcatgggtatctactttttttatttgaaaaattgattgcatctaggtttaccattcatgcattttgttcaacataaaaatattttagactgacaaaaaataaattctactttcaaaatataaaaatttgatacctttaaagatgttaaaaaagaaaaagacacagaatagtaacaacaacgtaggaataattgtataggctcctaaggtgaccattaagaattctaacttacaggtattaagttttttatttaaaaaaatcagttgttcgaaggaaacacaatttcaattagacaggaggagtatgttcaagagacctattgtacaacatggatactatagttaacagcaatgtattatatacttgatacttgctaagagtatactctaagtgttctcaccacaaataaagtgtatgtgaggtaatgcatacgataattggcttgatttagccattccacaatgtatgggtatatcaaaacatcatgttgtacaccatgaatatatacaacctttatcaatttaaacaagataattaaaaatcagttgtattacttaagttgcttgttaaaatatgtatctgttactgtaatcaatacaaataattatgaagcagttcatgcatgctggcaaagccagtcaagccattcgtaagtgcctctcgttggcagtgaatgtattttttttccttggcctcctaaggcccttatgactttttctgggtcagctttgttaactcctctcacttagctccattctcaatggtcagcgaggcttgggattagtcattttcacttttcttggtacatggacctctctccccccgtactctcagtatttcaattatcatttgactgtagataagctcccaaatctttatttcagcttaatattctatcctgaatttcagactcacacagccaactgcccaagaatattccctgaacttgtccgccttttggatattccctaaacaggacacgtcctaaatcagtgttctcaaagcctggtccctcaccagcggcatcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaataacttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggctgtgctttccttttctgcctgctgaccgactctggaacttttttcctgcatggctttgcatggcgtagtatgtactcttcccttgagaactgtgagtaatcaaacttcttttaatggaattgatctctctatattgtcattcagtcatttctgtaaagcaaatccctgtgcaactaaaataccctgcccctcccaacataatctaagtcttgggttccctacttcggtgaaggtttctagctgtccaaaaagtagaaactttactttttccttttgtatattaatccattactagatagcaaagtctatgtttttttttttttttttcaacttggaatctattaacctctttcccccacttataccaatactccagtttaagccaccagtgtgttcaactgggcttcaataacttaacgaaggatatttttgcctcagtttatgcccttcatttcaatccaatttacctttttaaatgaagtcactcctctgcttaacacagaacctttagtggtttttaccattgtcatgcaagtaaaaaaaaaaaaaatctgacccttactaactttctagcttcatctctcccaattcaaactctaggtttaccaagcagcaatcctctcaaaatcactttcccatgacttcagacttgtgcacagtatgttgcctggcttagagaatactcctcatgtttccttccccctacctgaccaacccatctcttaggtctccatttagatgtcaggaggagcctttcttcatgccttcaggctcagctattctatcattccgggttctatcctatcccatttcctgctatctccctgacttattgggggtcctatttctgtcaaaatcagcaaaggaaagcgggtaggggttaggggaagaaggaactgggggtgagaaggaagacaatatgcatcaggataaaggaatgagctgttggcattcttagttgaaactctgaaggcattttccatgagtgtaaacgctataatcactttcacagatcaccttcaaaaatactgccatgtttgacctcttatttagttgacattgttatctagattgacatttattgacccattttgttttacttagtctcaatgtaagcaatgatatcttaaaatcaactgtttatagtaccggctatatttgcctaaaacacattaaatagattaaattaaattcacataattagaattttatgagagtgagaaattacttaatgggtacaatgcatcttattaaggtgatggataccctaaaaggcctgacgtgaccattacacaatctatgcatgtaacaaaattatacttgtacctcataaatttatataaataaaacaaataaactcaatgcctcccaaaataaatacataattgtcagagtttgtaaaagtatcaagccatgtgccatgtaataatattccattttcattcttccagtgggaagtaaacaataagggaaaaattatagatgacagataatgtatataggtatgtcataaattgaattagcctaggaaattaattataatttatatttctccctgtggcaaatgtatttcaaataccacacatcttaattgtaaactaagtaaaaaaaaaagactacttataatctagaaggcccttgataattgaaatacacttagcaatgaacaatcgagtttattttgctgattcacaattcacaagtaatcttaaggtcaggtttctgattgctcattcgtagttgttttccaaagtgttgataatctaattttgtttgtgctccaaatgattcttccaatgcaaaaaggtcccagctgctttgcaaaggtaggtaggtttgcctaaaaatcaagaacgacatcacccacaagacattttcttgttaagttgcgaagtaacttttagtatattttcagactagtgttttcctagactagtgtaccccatgcatgatctgaatcagacttgctcttaatcttccattaaaaacaagactttcattctagatatgaattttagtctgatatcttattcttaaagactactttcttatcacaaagttctcacatcaccaatatccaaaccaagacatttaagacaacattctcaggggtgataaatgactacagtttttgcgcttttaaaataggcttgggaaatgacctgtattttgcattacgtgcatcataaacttctaattgctcttacagagtgttctgtaaaaaagaatatccaccattctttaaaaatactatggcattaagactgaagccctgagagatgttaagatagactatttaaactctgtagactacatttgggaatgcttccaaggttagcagtgaagagtgactcatcagtgaagggccggaagttcttttccttttggtttaatgtggatctctcaaactactttctaatatggtaaccactagacacatatggctactgagcacttgaaatgtggctgatctgaactgagttgcgctgtaagagtaaaacttaccagattttaaatacttaacggaaaaaatctaattaataacttttgtaacaattacatgttaaaatgacaatgttttgggtatattgggttatatacaacatactgttgaaattaatttcacttctttatttttattttttcagtgtgcctactagagaaatttaaattacatatgtggctcacattttatttctactgggcagagctgctgtagtaaaatgaagagaacaagaatagccccacagatatcttagttttcattgttacaagccaacaatttattagacaattttctctgacttgaaatgacacaaaaatctcagagagatcctgtggtgtgagcgtttggagtcagaggcctatttttcatggaccattgttctggtttagtttaacaaatctactatagtgtaatatagtataaactatttttgcatttttgttcatttagaagtttatgaaagtcagcaagatgagcatttttgtgattgatgtatgatgcaataaattgcattgccaatttagaaatgtaataatctgaatttttgatcatcaagtttatgcataatgtatttttgagagaaaataaacacaagcaaagaatcaatagcatttccccagcccccaatcctcgggggagattctctctcattatatttaatttcctctttgaattaactcattttaaaagacagtaaaataggctcaaatgttttaattgtatttctgatttttttctgaagttaagagcaaagtagactgagtgaattgacagatggtaatgattttgcacaccatttatttcaggactaacggcaagttctattaaagtagttcctcctaaggagtttatctcaaccagtgaatttccattcagcctttaacacttgactcaaatgccacctcctcctctaaaaagccttgcctggtcctattgggcagttatccactgcatattctcctagagcattatgccttatatatatttctcttattgaatttctcctcgctgtcccaaactagagtgtgtgcttcctgacaacatggctgaagtcaacctgagtcttactaatctctgtattatcaatgactagtccagtgcccaacatataatagacatccaaaatgtgcatatattccaggtttctcaatgagatggtattaatattgccaaatattaggtatagtgtacttaacagtatgtctagttaaaacatacatatattctacatatatgtagtttaaatttctctagtaggcacagtaaaaaaaaagtaaaaataaatgtatacatatattctacatatatattctatatatatatatatatatatatggcacatagaaatattttaatgaggaatttgatgatggccaattttcaatgatttaataaccaagtcaatttttaattagagacaatttataagtaaaaattgaccttgaaaagtgtctcacacacacacacacacaaagacataatggaataataaaagaccttctagtcaccaaattaaatatttgtcttctaaatgcaatcacttcgattacgtttgctgaaaggattacccaaggctctttttttgctacaattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggtttaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaattgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgttaaagtgaaaaaaataaaacgtttgtctatataatgaatattattgtaaagcatattaaatgttaaataaaatcctaattaatatactaatataagctcttataaagttcaaataattaaacaatatttatattatcaacatttcataagataaaacacactaaataattaaaagctcttccaccatgcaaaaatgactaaacgattttttaatttctaaagctttttgagattactgtgaaaggggacatagtttcaggaaaggtgagtaaacactatattagactagcatttctcaatttttatactactgacattttggcctaaataattccttgtggagggctatcctatgcattgtaggatattttataccatatctggcctctacccactagacttcagttgtatctccaatccagtaataataattaaaaatgcctccagatattgctaaatgtccacttggtggaggtaaaaatatcccccgccccccattttgagaaccattgcaatagacaaattagctcagagttatgtcatctctaaacaacttagcataaacaaactagagaagccctttcgacttctggtctgaagaattctgcgtgtctataatacaagtttaattgatatgtacctaagttattatcagctgatataacaatttgtgatgctttctgaatcatcaaaaaaatgttgtttgaatgcttaagatgcttaatgtgttttgtaatacagtatactaaaaaccttggaaatcattaattaactgaagccatataattttgatagtttggttactgggcactttaatctaatctgtaaatcttccaatagatttccaaactcagaattttcatcctgctctgattggttaatctttggtgggatttaccatttatccattgcattataattatttgctgtgccttatcatataaagacaaaattgggtgtggagtagttgcccatactttccagggcatatcattgagacccacactcagtaggttattatgttctttaatggtttacacattgaagggaagtttcacctttcctgaaactataccccctttcacagtaatctcaaaaagccttagaaattaacaatttatttagtcatttttgcacggtggaagagtttttaattatttaatgtgtttatcgtattataaaacattgatcatataaatattgtttaattatttgtactttataatagcttacattagtatattaggatttttataacatttaatatgctttatagtagtatttgttatgtagacaaatgattcaaatatttgcctcattgttaaaagctcacttaaatgttttgacataagctcacataatttgaaaatattaagaatttgaagctatagaatttgaaaacattaatgcattgaattccatatggaagaaagtctgtttagttgagggacttcaatatgcttccattttccacttctgaagatctgtttcggctcatggtaaatattacatctttaccctcgctccccaaatgcttcagatggattaagcaccattctttttgtgtgggggagctggagagagaaatagatgaatatcttccacacccttgattccatcctaacaagtaccaataaatagcaacttctcacctcctctatagaggttgtcttcaattaaaaatacactagagagattataaccatagaaaggacattgagtagtgctttcggctaattggcagtacattccttccaaaatttcagaggtacctcaatttaatgactcccctgaataaagtaattggttgaaatttactttgcagttcttaatataactttgggcccatcattagcaagaactctaaaaaggaaaaacaaaaacaaaactggggtcagtatatatttaaatgaagcacaaggaaaaaaggtatttcactttcaaaggacctatgctgttttttttttttgaagattgcaactcatctattttataatataatgacaataatattgcctctgagttaactgtgtaataattcactttgggtactgcaataattgagcaaacagaagctggtaccagaggcattcctttcttttatttagtgtaatattttttcataatttaatgagaaacatttcaaaagcaacgtttttatcctttcatgttaaattaatttacaatgctataagctataataaaatgagagaaaccatcagcaaaaagcaaaagttaataaagacagatattcttaaagtttcaaggactgaaaaaagctcaaatcacaaaagtatttggtttctcctttttttgtggcttggttcaatttgtcataatttgttctcaattattttgtacttacagctagcataacataatattgatgaaggagaaaagatgcattactgaaagtaaacatacataattaaaatcacctaagaaacaacaaaactttgcgatgtacttcagtaaactactctaagatttatacaaagaaggctatgatgtaatttaacatgtactggtataaacttctttgggcaaaattcaaaatttcaagcgatgatgaataaagcataaggaaagttcatgttattggaatggagttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataatcagttggaaagataagatttaatcaccaactataatcagtatggtgtccgcagtagaccactttagaatggccctttgttgaaactctctcctctctgcttcttacttaataagcttttctggttttccaattcctggttttctaattcactgtgcaagacaaattttaaaaagagaaatcaatgttggctgaaattaatgcagaatgttctgtggaagaagaattcaagatgggtcttgaagcagtagtagaatgtataaaggtgaagataaataaggaagtcattttaagaataccactattgttagtattaataataactccaatcattttatttctaataactggtactgtcatgaaagatgatctgttaataccacatatcagaagggttttagttcagccccagacatgatacattgtgtttataagttttctttcattactttggcaaacaacgtcttttgattttaaccttcctttcaatgactaagggggactctaataagtatctaggtagaattgtcaaagaagatgagtcagtatttacatattgactgttacaagcactacacaaatggttgttacataacatacttgaaatgaaattagagttacctacgcaaatatatgtgtgtgtatcttgtttttttttttttaattgagagagagagggtctcattctgtcacctagactggagtacagtagcatagtcacagctccctgcagccttgcagccttgacctcccaggctcaagcaatcctcctgcctcagcgtcctgagtagctgggattacagaggtgttccaccacatccaactattttttaaaaaatttttttggtagagacggagtcttgctatggttcccagactggtctcgaactcctgggctcaagcgattctcctgccttagcctcccaaattgctgggattacagtcgtgagccaccttgcctggctgtgtgtatatcttttaatgttaaacttttacagtagaaatactcactatttgcttttcaattgcttgctctgaagagcacaatgctttactgaacagagatcaaaaacccacctagttaaacaggaaataagactaataaaaatatttaatggtcttatttaacaactatagaataaaactgaaaacagtacagtgaaataaagaaaattcctttgtaccaatgtcactgcatgatatcggtactaaacaaattgttctcaggagctacaagtcatattcaggtggtcagaaactttaccttacacaatgagaaatgtagtatctgaaatatctgcaactagttaggtttaagaaaagaaaactcttaccattgggggaaaataaatccttttagaaataggattgaactgtcaataaagctgtttataataaattcttataaagtttaacatgaaaggactgtaaaaacagatgttattcaaaagaaaatcacatctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgagaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaaattatttcttccctattcatggagaggatatgattagaaagacaattgtatatagttttaataaaatctatttattttggttttgtttaatgcaattccacaagcttttactgagtttgcactatcttgacactgaaatgctgaagacattttaaaaattacagaatcactcaagaagcttaaagtttagtggtgtgttaatttgcagatgatttgattctgcttttaacttgtttaaggacagtgatctctgtttaatgccacactgaaagtactatgtgttcataataaacaatttctgaatgatcttatgagctcattagtatgtctcatgtggtttattgctttaaaatctcataatcaactatggtcatttttttctgcactagaatgtaggtcactgagctcaaatttatttcttatttttttttgatagggtctcactctgtcatccaggctggagtgcagttgtgccattatggctcactgcagcctcgacttcctgggttcacgtgatccttctacctcaggctcccgagtagctgggactacaggcacatgccaccatgcgcaggtactctttttgcattttttgtagagatggggtttcaccatgttgcccaggctgatctcaaactcctggactcaagtgatctgcctgcctcagcttcccaaatccttgggattacaggcatgagccatcgcaccccaagtgtatttctataccttacaaagtaccttacacagtaactaaccagcaaatggcagatactccagtcatagatgaatggatatgaatctactgttgaatactaatagaaattgtaacggcacagttacatttctgaaccaattctagaggttatacattcaaagaaggagtattattattaggtgcctaaaattgttagtaaaatagacctcttactatatttatctggattcttatatcatgcaagaaaatatcaataaacaagcatgccaactatggttttttttttttttttttttttttggtatccctccagatccagatccattttcccttctttttccaccttccagggggctgacttggattacatcattagactcctatgccctatggttttctgtttgggtttgaccaaggagaggactagcaaaccactgcagagaagggagagtcttgggtcagagtattgattcccttcatctctttttccctgagtatcatttcgaggcaaattctgtccttaagagaaagccactgctcctcccaaggcattaaaatctgcatgatgttttttttttttttctttttttctgggctctgagaaacctctctccccaacaacggcttcaggtctaggagaggtgacagctctgctgctgctagtcctagagtcttgtgctatcttgtgagatttccctacaccctgcccaatcctgagtatgtagtgccttgtaaataaagactcctcaacttaccctaatctgaatgtgccatctgtttcttgttgggactctgactgactgagatatcaacacaaatacaatcatgaaacaggacacaaattcagcacttcacagagttattgcggtactatgttaatgggcatgaaagttatcagtaaactgtaagtgccataccgatgttgattgctatcatttagcacaaactatgaaaagttcagactatgtccatacacaggtgtctcaacacaaaaccagttgacatggtctaacttgatataggattgatgtggctgtactgtaacagttgtccaataatcatgttgtaaataagtttttaatatattaacagcatactatattgatacatatgtaatcacagtgttatcagacttatccagtgttaatatggctgaccatagacaaggtctcaatattccattatccgccagtctgttccagatcgtgggccacttgtacatgttcctagttcggaatcaattaagagactagctctgtgaagagacgggaagcataacctttttctgagttataagtataaagtcagccctgcattcttttaccctgattggggctgagctacattacaaatctcctttgtctcttcaagcttaggggagcttgcaggaaattttctgttaagaatttatgtttttatgaaaaacaatgatactgagacacagagtgtatgctacgaaaaaaataaatacttttagggtaaaaaaggaaaaaggtggtattaaaataaattttcccaaatactgctctttatatatttcgttagtgacatctacacaataaccatattttgggaagcaattaaacacctcacatggacaaaaatcatatcggtttcttactatttgggctggcagtaccttataaaaagaaaaaagcatcaaggcactgtagtatgatatttttgaggatgtttttcctataaaaatcttcaaatgagctgcaaatggacccaaacagacttattttaatatactctaggaccatatataataaaaggtcctatactattttatagaaatggcttctgttgccttagatgaggtttacacataaatcttttaacttttagtgctgcttgtttcacttctggtggattctttttacaacaatgccctgccaagcagttaatactacttcataaaggaagacgccaccccttgaccttcacgtttgtgacccataatgcaaggtgcttccatcatctctatcttttctagatatcacccttccttggaagtgcagacaagtgttttgtttatttgttcttgttttgtttgaggtcaattcactggctcctttctccagtttttttttttttttttaaacaccttgaaagcttctaatacatctgctagccaaaacagtcattttcattacatgcttgtggctggtcaaaaagaacagttgtataatttttattttcttacccagaccacaaacaggttataaaaagtacatggcccttaaattttggcggttcctttaaaatttagttcaaaagccaacatgaagagtcagatggaatgactgtcacatggaagagctaccaagcagataataagtttagaactcttaattgaaaattaacacacctacattgtattcccaaattgaagaaaacggctgttttggctactgctataataagatgctgcatacttcacatgctgaatctggaagggggagcaattcagtcctatctgacggttgttcctaagctttagtataacttcaaagatgagggtatgaaattccgtcatcgtcagagagatcctgctttctcttccttgggttgcaaagttagtaaatattagccttccattttaactaactcgttgagcttgtctccaatagaagattgaattattggcctcaatcctttcacatccctagtagtatcatacattcacgctccagccatggcctcacataggtggaaagtattttcctaccccttgactttgggcttggccacaagacatgttttgtctaatgggctataaacaaatgtgacaagaggagagattttgaaaagtgttgtttgtgcttctgtcattgccttgtgctactctgtcataccccgagtagctgatgtcccttcagcttgagtctcagaagaaaatatgtggtatagacccgaacagaaccgacggcctagagataagcatagctaaaccatttccagccatgattggccaaaccctaccaaactgcagctccatgaataaatcaatattgttgttattagccactgaattaaatttttttggttgtttattgtgcagcaaaatggactgatatgaactgaaatgtggtttataatcaatacaatccagtaaagttctactaaatgtatgtctatcaagcaaaagaaaaaaaacagatgattagaaagttgtcaaattcttctaacaaagtccatatacataccaggtaccagaatgagttatcaataattgcctaggggtaagggttagaaataaaaaaagtcaagttgaacccactaggtcgtatttccaggttttcaagcagactgttctggtttgcaatatttgaaaagagtctgctgtggtatgctaatgactgtgaattctgtggtctttggaatagttccaaaatgctaagctcaagtttaaaacaaaattggattctcaaatatctttcttgctcagaaaggatttaagtccttttgtacagaaaggaacaaacaagtgataaggtaccttttgggctttctattacctatgtttccagagtggtaaaactggatctctcttgttttcagtcatatctacaggttccctcctaaggatgatccttcctggtggcttctgtttacaacaatgccacgccaagcagttaacactacttcgtaaaggaagactccactccttgaccttcgcattcttgacccataatgcaatgtgcttccacaatctctatcatttccagacatcacccttcctgggaaatgctgacaagtacggactgtgctaaagggtggaggctgtctttcacctcctgccaccaacagcttatttgaggagagtttaagaaagaagattttaccagaaaagttccaatttcatgtgcctctttatatgctttttctgcttcttatgtagtctccaaatttgaatgacagtcttcctaactagtaaccttggaggaatataggagaccaagtgaggaagctatcaaataatttcttaacatcaacattattgaaacatagtaactcattgttttacattggaggctaaatagaatgatatgttttaaaatggctatctccatgggcttattttttttttctcatctgataagtggattcaatgatttccaagattttgttttcaactctgtgattctatggtctctggatactgtagttccaaccttcaagagaagagcacatctaattaaagttcgagacagcgccaaaagattagcagctacggtcacatttaatgagcaagtcgagtgaaggcatttttcccattgtctaggagtcacctcaataggatggaagatgcacgttctatacagtcttatgaccagcctgttcctcagcatatttttcctttaagtaccaaacaggtatatgaatttagaatataaaaagagggttgtgataagttgatattttcttctccaaagtttaaatatttgaatagttcaccagctgtagctttaaatagtgggaaataatgcagctagaagaaccatacagggaaaaagagtgagttgaaaattctcagctcagtggttatcatcaagtttggttcctgtcagcctccagcgactgtaggtggtgcttataggtattcatcaataaaaggtgcatttgaggggatttccagcattttgcttcggaggaaatcatttatgtcaaaagattaaaactgctgttttcaattgcttaattgagtatatattgaggttaaggttagtgaaagtggtaaagcagaatgaatacattgcttattacagtcaagaaatgttatacagaaatgagaaaatgtacaaaccccaccagccataaataaggaagtggttagaatgtcgctctcagccaagggccctaagtccctttgtgtaggtttggaaaaatttatgcctgtctagcagcttgtagctgtggagcagagttggctgaccaaactttgattccttctctgaccatgttctgctagccttatgtccttcagtaaatgacagttgccataaaaaacaatgaggttgttgtatactccatcattcccactactttgagatcttaacaagatcacataaccatctgaacttgaagacacagactgaattcaaataattcaggctaagacatgtgctgataacctaagaaaaattattgctagactcctaaaataaatactatgagaaagaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcatatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaaaaggcatgcaaaaactattatttaaaaaatctcttttcacagtgtttttgttttgagtactatagctttgtaaacatttaattatctagctttatgggtttcgttttaatgattgtgccaacaaatgataacaataaatccatgccaattttggaagtatttctaatattatataacaaattggaaaggaattttgtacatgattatctctaggaagacaaaccacaagagtaattaacagagctatgattccattatcatcacaagggttaaaccagaagttcatgttcactattttcatatatctcacaaacccaagtatcagttcagttctcctggaaattcatgaaggattaaaacaaaacacattattaggcaatattttgatataaggagtgggtagctaatatgttttccaaaatttagtacagaagtgtgtgtatcatctcaagattggcggtaacacatgttacttacaaaaaaatgagcagaaataaacagtgtgtttatgatgtataaataaaatataatgacatcactagacaagggaacatctactttttggaaatttatttagggcagtgaaccattaaaaaataaaacataggctttatatttttatcatacagatggctaatattattaattttcaatatgcatttaggaaaaaccaaagtatatttactatttcaattagctattgtcacagtaatgtagaataaagctcaatggctttatgcaacaatcatttcttttcctggatgtgaatggctagtgcagccctgctgttcatgtcttttatcgttttcctgagaccagcagcctagatggacgtgttctcagaatgatagcagaagcacaaacaggaatgtatagatctcttaaggcctaggctgaaaactgtcacctctcactcctgctcatttaccatttgctaaagcaaatcacatggccaacccctaagactaggggttgggaagtacattccactcataaggaggcattgttaaggttgtgattgcagaaggtggagaagaaatgggattaatgattaaatctactacagctacataacagtttctttaaagcagatgatatattgtggaacatgacaatgatgtgtacttacttatatctttgactgaattcttcagggtgtaatttttgccacaatatttacccgtgctagatgattgttatgtatttttattgttatcagtgattaacctgctgctaaatttaagaaatagagaatcttactttttttttccagattcttgtataaggaattaaaagacatattttactggaggcaatcctttaacagcggatgtgagtataggcagactgatgcaatgtctagtctagggagcagagcatgccatctgagtcacgagtcttgtcttactcaactctggagttacttacttgaagagcatatactatatgggaattataagacaacactgcccctaaggagtttgggaaaattattttcttttccaatacaatatgcaagaaaatatttcacatcatgagatttagtcacttcctgtaagacaaccagagcaaaaagtcttcttagtcagatacaccatgtaggcaaactactctctcatcacctgtgcatgcacgtgtgtgtgcgtgtgtgtgtgtgtttgtgtacacattctgtctgtttccaattacaacttacttttctcatctcgtctttcaaattcttgtttttctggtggtgttccatttttgtaaatagaaaagtaaaagaagagtgtgcttaaaaacctgctcagagggtgaatttcaaattggcgtctctattagaggactaatttgctttctatgtgcaatcctggtgtgatcactgttgcatatgttactggatttcaactcctctgcccctacctaaactcattttgagactctcacatggtaggtcgatagcctgagttttatggagctcaaatgctgacatgacttctgtcagacttctggtgtcacatttggtgaagcaccaggagaatattctaccatatttctctttcctttgtttcactaggccagagtagtcctctctcccttgggttatcagactttacacactagcaaagcatatgattggcatttttctcttgcttattacccactccattcctctctctctgtctctctctctccctctccttcccattctccctctgtccttcctgttctccctctctcctttctatcctccctctctccttcacacttctcttctcctctctctgtctctctaaaatcaactaattattttccattttaatcacattcataagtcaatatattttatgtgcaaagaaatacatattcaagaaaaaagttcaaataagtaaaacgacaacaaaaacctgtttcagaataaaataatcttctttgctagaactaaccaagttctagctggtgtctttaagacacaaatttggctagaaagttactaattaatttgtaaaatatacctgaaggagttgtgccttttacgggatacttagataatctattcaccatcagtcaggggtgggtaataactctctgactactcttctgtactttttatcttatatacagtctttcagacagaatctatttcaatacagtaaacacacatacacattccaaatcaaatcaaaacaaaaccttttttccttctcttgattaactttacttttgagaaattgattataatgaaacatgtttaacaaaatgcatttttatgataaagagaagattccctaaatcaagactgagacataattgtgaaaaattcagccagtattataattggattaagttatgggattcaacctgaaaaaagaaatttttattctgatattgtaatttggtcatattaggctaagatataatttaatgtcatgagtcattagagtgtaacattgtactagtgatcatggctctgatggaggcatggacagtttttatgcaaagggaaaaacatgaaaatggtaatggaagcctttaggtgtcatctggcttagcttttccttttgtatcttcaaaacagtgggaagaataaacaatactattcttgattggctagccactggagatggggataccaaatgaaaaaaatgctccaacacaagcaggaagtattattttcttcatttctttatcctgcaaaagcacagagactctgtcttgcagaatcatttttttttttttcaaatttcagagctgaaagggccataagcaaaacatctggtctagtggttctcaaatttaagtgggcacaagaactacctaggggctctttacatatgcagattccacgacccatccccagagagcttctgacacaatgcatttttaataaagtttccaagtaaagatggtgtccgtggtatgtaaacctggagaaacatatcttttacctagatccatcatttttcagaagatcaacctgagatctccaacagcactgacttccccaggattacagaggctagtgtttaggaacaggaccctaacttcttgacttaaaataagatattttgcactctctaaataccttaatacttctattaaaaaaagttttagagtctgttagctgaagaagctgtgcctttttaaggatacttaaaagcgaataggcttttccccatttttgtattgtggcaaaatatacacaacataaaattgatcattttaatcatttctttttgatttgggatcttgaccatgctggggtacagtgtcattcactgcttcctccagttcctgggttcaaggaatcctcctgcctcagcctccagtgtgtctgggactacaagcatgagctcccacacccagttaatttttgaattctttgtagagatggggccttgccatgttgcccaggctggtcttgaactcctgagctcaagtgatcctcctgctttagcctcccacagttctgggattacagaagtgacccacaatgcctggccatttagcctttaaattttttttatgggtacatagtaggtgcatatatttacggggtacatgagatattttgatataggcctacaatgtgtaataatcacatcaggataacggggtaccattttcttgaccatttttaagtatacagttgagtactattaagtacattaatattatattattattatcgttgaaccatcaccactatccatctctagaatgttttcatcatcccaaactgaaactcaggtactcattaaacaataagccctcattctcttcttcctccagctcctggtaacatccttcaactttacgtctgtataaatttgactgttgtaggtagctcataccagtggaatcatacaatatttttcattttgtgtctggtttatttcacttagcataatgcctctaagattcacccatattagctcatcttttgatttgctgaattcttttaacttcttgttcaagatgatgttctggctctttaagaaatgaatttctatcatttgtccaacttcaatagatagctgctaaatgagagaaagcattcagaaagggcattcctgggtgaatgaaatagacagagcctggaggccggcatagtgatgtgaaatgcattttctacttagttgaaagtcacttgaaaagaaaaagaaataggaaataagagagacaggaggagaagagaagagagatgaactaaactgagaaaaactaagactttcttaaggctgcgctgtgctcagattagtagggctatgcaaatgaggttattaacaggtatattctaaatattaattggtacacactggtatacatggaacccgatattattaaaatacctttggggcaaactatagacaaagaaaagcaaataaagaagtgaaataaagaagtaagcatctatgttgctattcgagaggtatttatcgtgcttaagatttaattttaatttatatagttactgtcatgagcattttgcagcttttaagtcagaagggaagttatttaatttatgttttattgtagaaaaaagtttaaagttttaaaaacatcagtatactggtgtatctccaattgtacacttagaggcaaggcctggtaatgctttcgagaagaggtagggctttggccaagagttgaattttccaggtagacaaggagagaaagggtattctgagcaaagataacttctcttgactgggataatgactacttgctgtttagtattcattcagctcagtgtcatttataagaaactttgtatggcagctttaattaaatggcatcaaaactttttgatacttctccatggaaaggtggagtttatgttctcatccccttgaatcagagctctgtcactgattgacaaatagaatatgggagaagcaaaaccattcttgcttttagggcaggccttgagaagcttgcagctttaatttcttgtcccttaggataattgctcttgggacccaactcttacactgtgaaaaagcccaaactgctccatggagaggtccacatgaagaaaaactgacagtcagcacctattttccaggcatgtgagtgagccctcttggaagtgaatcctccagcatcaggcaatctaccccaactgatatcaactgaaacagggataagcaagccccattgaaccttgagcaaactgtagattcatgaacaaaacaagtaatttttactgaagccatgaagttttgggctggcttgttatgtagcaaaagttaactagaataccttctctgatcttactcataagggatgcagaaggtgccccttctcttggatgactaaaggactttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaatggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttattaacgttatctatcagtcattggtgtgatttcctgtgttactcaggatgtttgggaaaaagaaactccttttaccaaactgtgtttcaggcaatctcaactttggtgtctgattgaaagagaagggccaagtcaatgtattttcccaaggagggcattatgaaagataaaatatctctcttacaattttcagtataatatgtttgttatcatgaatgagggtattcagccttgtttatatcccaagactttaaagagcttttccaaaacgagtcaatatgaacgcttaagaactaaaatttatggaagattaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcagtacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaagattcgaaaatggctttccttgaaaagtaggtaatgtttgggtaagcttagatgaaaaaaaggaatctcaagacaaaaaacaagatcatcgaaagacacagaagtaagctggctagctgttcattttagtaggagttgaaggtgcattgagaggtaaaataagaaataagattggaaacgagactcaggggcaattgtggagagccaggtgaaggagtctgtagaatattctgaagggctttgaagtcaaaaaaggtgtttgaagaggggagtcatatattattttcgttcactgacaaatacttattgaacacttttcatgtgacacacacagtcttggacaatggatatatacaagtgaataaagcagatgaaatctttgctctcatggaatttgcattgtagttacaacctaagctatgttttaggaagcttaatttaaatggaaatctgcaagttggattggagccactggtgggcaggaatgagtggaggagggtaaaaaatagtaagagtgtgaatgagagtggaggtaaggggctagtgagaaaggaatggtcataaagaattagggaggcagaatctacagaccttaaaaatgaacttgaaagtgaggcaagtaagtgggagatttagaaatgactatatgatctgaactctctgactgaaaagatggtaccgggatgaacagcaggataggaaataagacttggtataaaaaatggcctatttgggtcatactgaatttatgtcatttgtgagacatttgagtaagaaatgtcctacatacagtaagaaatgtgggacagacattggaaaggaataaaaatgttcaaatcattggattaaaggagatggagaaaagactgtttctagtataataactaacacataactgacagtaactattgactaaatatcaaatgaagataatgagattaatgaaatcagaaaagaatgcatagaattgatactgtgggcttggtgtggtggctcacacctgtaatctcagcgttttgggaggccggggcgggcgcatcacctgaggtcaggagtttgcgaccagcctggccaacctggtgaaaccctgtctgtactaaaaataaaaaattagccaggcatggtggaaggcgcctctaatcccagctacttgggaggctgaggcaggagaatcacttgaacccgggaggtggaggttgcagtgagccaagattgcgccattgcactccagcctgggggacaagagcgagacttcgtctcaaaaaaaaaaaaaaaaaaaaaaaaaaagtcaaaaaataccagatgctggtgaggttgtgaagaaaggggaatgcttataccctgttggtgggaatgtaaattagttcagccactgtggaaagcagtttggaaatacctctaagaactcaaaactgaactaccgttcaacccagcaatgccattactgggtatatacccaaaggaatataaatcattctaccataaagacacatgcagctgtatgttcattgctgcactattcccaataccaaagacatggaatcaacctaaatgcccatcaatggtagatcagatatagaaaatgtggtacatatacaccagggaatactgtgcagccagaaaaaagaatgagattatgttctttgcagcaacatggatggagctggaggccattatcctaggtgaaataacataggaacagaaaaccaaataccatatattctcacttataagtggagctaaacactgagtacatatgaacacaaagaagggaacaacagaaaccaggatctactctagggtggagggtgggaggatggtgaagactgagaaactacctatcaggtaccatgcttattatctgggtgacaaaataatctgttcaccaaactcccatgacatgcaatttacccatgtaacaaacctgcacatgtgcccctagagcttaaaataaaagtgaaaaaaaaaaaaagaagaaagaaagaggaaggaatgagtgcttagagagacaaggagacaattagtataatatatcaccctggcaagtcaaaaggtgagacatttttcagtaggctgtagtgagcagtaataacaaaatatgagtagatttctagggcaatgaggacttgataaaaatatttgcatttggtagttatggtgatttcatagagaagtgtttcagttgggaggcagatgtagaaacttgactttaaaatgtaaaggaaagatggatgtttaggaagtagaaatatttccactaatttctattagatgagtgatttgaagcttgcttttggtgatcttgggtctttccctgtaatgctgagtcaatgtagagtaatgggtaggacagtagagttggtagaagatcagaaagtcaaacttaggttcaaatgctgacttttctatatattcgggttgagcatcccaaatctgaaaatccaaaatccaaaaaactctaaaagctgaaaatttttgagcgccgacatgattctcaaagtaaatgctcattggagtatttccaattttgaattttggggtttgggatgcttaacccataattataaagcaagtaatccaaaatctgaaaaaatctgaaatccaaaaaaagaatcagaaaaaaattgatatccataacacttgtggtcccaagtgttttggataagggatactcaaccagtacttgtgtgttaccttagtagaagttacccagcctctcagtttttcctctgtactaaatatacgatggtattacatcatgcaagcaaagcacttagtacacaccttggcacatagtaactattttaaaaaggtagctattattattattaccccccttaataattgaaaaatacatgatgactttaatcccagaaaagtaaacatttattgtgacaagcttttagtttatataattgccctcctaactgggagtaataaaatttagtagttattttaacaagtagcaatagataaattacttaacctctccaattttattcttctcaaatgaaaatggaaataataggagtaccaacatcacaggttttcactaaggatcaaattagaaaatgacagtaaagatactttgccaattatgaaacataaaatatttagttattattctttattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttaatttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttctaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatgtttatataagaaaaggaactaattatcttattgaaaagagtttttcatgatcttggatacattatgcaaagacttttactttttccatgacataattttttttttttttttttgagatggagtctcactgtgtcacccaggctggagtgcaatggcacgatctcagctcactgcatcctctgcctcctacgttcaagcgattctcctgcctctgcctcccgagtagttgggattacaggcgtgtgccaccacacctggctaatttttgtatttttagtagagacggggtttcgccatgttggtcaggctggtctcgaactcccgacctcaggtgatctgcccacctcagcctcccaaagtgctgggattatatgcatgagccaccacgcctggcccatgatatgaattttatgccaaagctttgctaattctttgcctttttcacaattagtttattaagagggtccctataactgtctttttgaataacatggacaatagtatcacttaataccaattctgtactacagtaagtaacattttggtgacatttagatatatttctgagtggaccatggagaaattcaaataacgacataaatttgtgtgtaatataatttatttctatggcttccatgttgatgtccttcaattttaaatctttaacccagatctttttccaaaccttagatttacattcacaactgcttcaagagaggtaaggttttcacctctgatttttcacttacagatacctcaaaatcaaacacgttcttgactttgctcctcacaactgtttgccatcttgaattctgcaactcatgattgagtgaagacactaccttcagtcaatcatgccaagtggtaagcaggcactgatttctcattttacctcacattttctgctcacctccacctcccacaaaacatatgacagtgttgattttatctccaaatagctcacgtatctgttttgtttgttcaacctcaccactttgatcatcaattcttgcttggcttattacagaaataatgtcctaactgttgtccctgcatgggtctcatatctttccaattcattctcctaaccactaccagaatgatcttttaaaaacatgtctgattagtccatttccttgcttagaactaggctatgacttaaagtgataaaagtccagagtctgaaaaataggtggcaaggggcagagagagccagcttacacttactgagcccttcgagtccaatagtctgcctctctggtatgcattttacatatatcttatcatttaaacctgataaaatcctgtgatgtactcattgtatagaagagtaaaattgggactcagaggtcagacaataagctagtaagtgctaaataaggggtcttcctgcttacaaggtccatactctagctgctacatcatgctgtctttccacataatttagccccagttgatctaatttcatttcttgtagcaaccataccccagccaagttccttcagattctcacactaccacactgactaagcctttggatatggtgtttcctctatcacgaatgctcttttcaaccccatgaacctaaataactcctaacaattcttctaaggtgactttctctaaacagaggttctcactggacaatagattcatgggtaggacatgctatgctcaattcagttggtatctattgtgggcagagatatttttaaaatctcccccagtgcataagcaaggttaaaatccaccgttctaggtgagtttcctggcctctttggaaggtttagcctagtcttctgtttttgctagaccctgtccagctctctactgtaattctcataatgctattataattttgtcttaggatgtatgtcttcacctctggaatgtgaacctctcaaaggcagaaataatgttaaaatacagaggcttttgaatatatgttacaaagtgatccagtatttccacaccgacagacacacacacacacacacacaaatacacacacacacaaaccaccgaaccaaagttttacgaacaatattgaaacttacttaaaagtgatggactccttatttctattctattttactaatttcattcatttctatcttaaaaatatggattgatactcattaaagtgattatacaacccagtacttttactgaactgtttttgaaaagcacctttcttggggcccttatgatggaattagttcccttataacaagaggaagtgtcatcagagctctgtctctctttgctatgttaggacacagagagaaggaagccatctgcaaaccaggaagaggggccctcaccaggccctgatcttggaatcccagcctccagaactgtgagaaataagattctgttgtataagccttctttcccttacccaccccccaaaaaagaaagaaaatcatctctctgaacatgtttgtatcaccagacctaacaccacgacacatggcaggtgtttagcaaagatacgctgaattaataaaagttctcagaaaaattttatatatatatatatatatatatatatatatacacacacacacacacacacacacacacatatatgtgtatataatttttaaatatccagagcagaaggcattcatcgccaggcaaaataaaaatatcaaaattcactttcacactctttagacaacaatcaaaatagaaagattaaaaaatacatataaaactcaattcaaactaaagcaacaggaaggaatacactaaaggtttcttctccttagaattagggatccttaaattgcctctgcattctcagatagtccaagaaatacgatactccaatttattcaaggtactaattgtgctactaagattgcattctttcttctttcttcagaattaatccgtgcgccaaaattttggtgagaaacttctccaattttattttattttattttaatttatttttttgagacagagtctgctctttcaccaggctggagtgcagtggcgccatctcggctcactgcaacctccacctcctgggttcaagcaattctcctgcctcagcctcctgagtagctgggactacaggcgtactccaccacacccggctaatttttgtatttttagtagagacgggggtttcaccttgtggccaggatggtctcgatctcttgacctcgtgatccgcccgcctctgcctcccaaagtgctgggattacaggcgtgagccaccacacccaattttaataacatattagaaatcaaagatatcttaattcataggtgtactcagatgtacaattcaaactttatgaaacttgtctctctggaaatgttttattcatcagaagacaatttttataatggggggattgagaggagacgtaggtaaaacacgagattagggaagggagtgatttgaaagatatggcctgagacatgacccagatcacagatgaaggtatctcatatatttattgctccttagtttgtcttgctgagaaaaatatgttaattacaccacctttatgaacatcataaaggtcaccacatacccacacccccacattgtctttacaagctaatattacaatgatctctcaggggtacttagagaaccacttaatatttgtgaaactcttgtgaaatattcagaaagacagagtctttccattttcagttagttacccagggttttatggtagtactttgaaccatgaacagctttgtcaactcttcttaggcccaaagcagaaaatgttttggatagagaaataatccgattcaattacgaatatagtttttttatttaaaggataaatctgcaatttaaaaatcctgaaactttcacccctaaaggctttgtatggcgttctataaaaatacatttgcttaaaaattccagttagcatatcagaaataacaatatttataagaaacacccccttatcctgaagtacaaggacgacggtaaagttcttgattttagtaaggaaagtgagttacacctttttataatacgggaggaaattctaatgtctttcagagaagaattaatcatgttaattccattcagaatgtatatgctttatattacatgtatgtttaaagaatctatgaattatgattattgctgagagaataaatatcttacgaagtggctgatagacgaaagtgataggtagtctagcaagagctggagtctccatatatagaaaaacggattgacagtcttagagaaaaacacattttgtgaaggttttcaccctctctcttcattcactagcatttgtatgaagtaaatcatcactacttttggggtagacagatatatcaaaatctgttggcagagctgttgctttggctaggcatttcaaatttcctttttttttaatatatgagaactatgattgctatacagcatgaatctatgaatacaatgctaccagcttcttcaaatgaagtgaaaaagcatgccatttcacttttctcctacctacatattatagaaaattccttttgttcaaaataaaaattcatagaggaaaaaaagcaaacacttccatttagctgaaatactgaaattgcatgtaatctcttaaggtatgctgctttatttattttcaagctcggcatttccatttgttgctcttcaacaccagtttcttgactcaattcaatcagctgaaatgtgccattaacaataatcaatagtttcagtagttcaccgttttaccatgacatctccgagtctttcatcaaaagatcattatccaaccatctaactaaaaatcaggagttggctataaatgtcatttcaatccataaaatgtagtttaaaccttgggcaagtggatttatagaaaatacaatattagctgccagggaagagggaaactgtctctgttttaaaataattttggaatcttagttaaccttattatagttaagacgcaaatgttgaggttttcagaggctctatgggagttttatctggattttgagaataaatgtagtttatcactttggggttgagacagtaaaaagcccctgccttattcccaagctctctctttttctacctcgggtacactgaaagttatgtgtaatatgtgccttagctcaaagatggaaaagagtagcctgatcgacactggactttatgtgagcaacaaataaactgtggtttggttaagccactggacaaaaacgaataaatacattttcttgagtaacatgggataagctaagacattttctcagcataatttccaactgcttttgaaagagagatcagaaatctaaacataaaatatttattttccatgcttccatagtaaatatagttaggacacatggtgaatcttccctttaatgattcagaagcttgcagtttcttgagattagaaatagagataaattttcattatataatacagcagatataaatacaaattgtatagtagaaaatagacgtatttttgccctcaactagatttaaagatatgttttattaaatccctgacataaaataattttttagtcattgggttattctttatttttcaaagtaatctgctaaaaatagactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaacaaattacctccaaatgatcaaactaactcaacacgcattttggaggagaaagtggggtcaaagcaggatgatgaagcaagaacgataaattcaggagccatacattgccactgttacgtactctatgcaacagagcagcaaagtagatcaactatcatatcaaaaaagaaaaacaggagaaggagaacgataggagggagaggagaagaacttctgcttattatgatttgattctggaattattcaaactagaatatacttttcataatagtttaaaaatatcataatagtttcataatagtttttcataatagtttaaaaatatcaaaaaataaagttagtctaaaaaatcaatcatcttattataatgatttatatccaaattgtatttgagagactagtaaagttattatatcaagtcagaaaaaccaactatacataacaaaactccataatagttcaggaaaattatatcaggtattgagaataaactttaagagcctccttgtactacagaatatgattctcaccaagacttcatttaaacaaaactaccccacgttctgttttcactgtttatgcatatggaactttatggaaataatttttgtttctaggaaaaacaattgtctgaaaattgtttgatcattaactacgacaaattcagccatctcattcttattttcacagatcatgttaggaagaaagctacaaaatgccagattaacatttcaaaacatatttgaaagtaatgaagggaaactgattcagttagcaacgctaaataaaacagacaattcatacagatgctttccctgtaaaatattaaataaacactcaaaaatgtcaacttttaaaatttaataaaccaatccctaagttatttctctgagcaaagtttctccttgaccgaagctctggttttatatgcaaatgttttcctggtcagagcatgtactttttctaagacgagggtgttaagtggaattataaatgatgtttccttctccctctgcctctctcctccttgtccaaataccgaaatacatcaggctgtataaaagcaactattttgttttgtccctggcttgtcagttacaagtacaaatgctgagaattgttcaattggatccacaagagtgctaaagcggaaatgcctgacttacttgccattgtttcatcagctcttttactcccttggagtcttctaggagcctttccttacgggtagcatcctgtaggacattggcagttgtttcagcttctgtaagccaggcaagaaacttttccaggtccagggggaactgttgcagtaatctatgagtttcttccaaagcagcctctcgctcactcaccctgcaaaggaccaaatgttcagatgcaattattaaatatcagaatggtgcacctagtgaactccataaaaagagaaagatggaggaactaaattgtaatataccaacaatggggtgagttgttgctacagctcttcctttaagcaacaactataatattgtgcagtctatttactttcatttttatttaacttaaaggcgtttgtatgggggaaggcatgcaagaatgacaattacagatttctataaacccctctccacagaggaggtttcatatatatatgtgaaatatatatacatatatttgaacatgtgaaagttcaaagtacctttttttcaattttgtagtttttgttggtcaattttgaaagcttatttttaatatactgccaaatttgagacaaacctttatagttaaaaccctaaaatccctgtaccatgcttgtctttgatgctgctctgaggcagaaaacaaggatttgatatgcaaggagaaaagtcaagaaaatacaaacctagaatcaaaaggaaaagactagaggaaaagacaaaaagaaggggattggagggcaaaggaagaaagacttaacaagtaaagaaataacatttcatagaaactatcattttgtgcaaactatcattttgcatgacatcagttataattattgtgttagtttcatatttaactacttgatcatacaactgagaacattttccaaaataaaaatgttatgtgtaatgaaaaagagtagagttttaaaaactaggcagatctgagttcaattcccagtgttctttaccacttacgtgatatggcaagttccctctctgattctcagtttctcatctgcaatatctattgctgtgatgagaattaaaataaaaaattcctgtgaagttgagtgccccacgttatacagttatacattacagttactcaaaaacattagttccttctacccatatcccatttccccattcctgtaatattttaaaaagatgaaacaaactctttcatgacaaaaactctaaaaatgtattcatatttttgatcatatatatatatatatatatatatataaaatgcatgtattgtggatacacacacatatgccctcagcaaatatctatataataatagcttagaaaggaaaattgccttaggcagtaacagtcctatggaaaaagattcaggtaaactttgtctgcaatgaggaaattagtactctatttaaatgtcttatttgccttctattactacacaaacactttctgggattaaacataagctaaaaatggattttaaaaaattgaacacttgaatatgatacacattgcttgttaagatgtgattgtcaataattatgcaaaactgcaatttatttcagcagcaactttatcatgggatgtgcaaaccaggcaataaacaactcctgccgagccagcggcagcaaagcccccggaagagctgtttattcatcatgggtgaggtttttgctgagcacacagtcttccacagtggagtttcagtgctcatactggataaaaatcttctgtctgcattaactggtggagggtagaataggtttatgaggatgtagctactggaaaaaaggaagcattgcactaagctatttatcaactcctaaataaactttaatactgcacagctgaaaggtagtgtagggttctggttgggcaaataaattaaacctcatgtagttcaagggctaacgtggactgccggctccctgcttatctagttttcaggcaaactatcaatgcaaggagaaatatcaaaagagtcatttatctttttatgtatcatgcttgaaaaattcagaaccactgcaacaactccacgaatctcaatgctacaattgggcatacaccttacagtttgaaccatgtgtaactgctgacaattgactgggtgtgacctataaaagtggcagtttcatgcagtttgcattaagacttactccatctccagtgcaaaatttggaacagaaataagctgtcacattccagaatataaatgcagggttagacatttgacatattttctaatgtagtccaatttcaaacaaaatttaaaaatatgaaattctcccatggcagagtgaaacttagagaatgtaatattgtgcattttatcagcatcagcttcatgatgagctgcgcttgatgcatcttagctcctctatccttaaactagaaatgccgcttaccctctgcttccagagaaagtaactagtaaataactttccaagagttatttgcaaaatgcaatgcacataaatcagatgaaagagttctaccgagacaatgtgattttcagccaaatcctaccagcaagtttgctgctttgtaaattaggcccttagggaagaacagtaactctttcaggacagtaagaaaccattttcctaaatgatacccttgtggtctgaaatattgacaacatcaggctgaatattttctaatttggaaaatacgttaaaaattcgatggcaataacagcagaaaatctcctcaaatgagctcctttacgtgcctcttgaataataggtaagactgttgtttcctgcttgtgtgggggttttacggcttcaacatttctctcggaatctatgtgtgtgtacgttgaatccctaaattttaattgtgccaggtctagtctagaatgagtcaagaatacttaatttccatatctgtgcattcaacatgctctaaatgtatcatatagttttaaattttccggaaccatatgggtttaagtggcttatatgataagtaaaatgtaaaaataagaatcataaagaaaaaaaagatatgttcagaaaaaaaaccaaaggtcttgaattagatttttttttaaattcctttgtccaagttatcaaactacaggccctggagaaaatttggctgaattttacaagtaacaatgaccagatattagaaactgtaataatgctttgcaaacagaatctactgtattggttaagtacttttttacataacaaagttttataatcagctattccagctttatggtgcacaaaaatagctgagaatttgatggagtaaggaataatgtgatttcaaaaggttttcattctattcataagagcactgtgtaccattctcagtatgtaaataagggcagcatgaaacagtgttctcatagtccatggaccagcagcaccagcaacgtctgagaagttattagaaatgcaaattcccaggcctcagcctagctctactgaatcagagactctgtgggtaaaatccggcaagctgtgttttaacaagccttccaatatatgctaaagcttgagaatcacagttgccaggaaccagatttgagaacgactggcatagtagatgctaagctgggctgcccggaccccttttcaggactgaaatacttctgaccccagctgctggtagtgctactggctgacagtcctcagctgttattcctgtctgagagctggactcagctaaagagaggtgcctagcccaaagttacccactatgtccccgagacgggctgcacgtattggttgatgggagagttgtggggtataaaatcctgggtcccttgctgcaactcaggacaattctgaagggctattctaccttcagacttcagagatcctcctggggaaggctaggaaggagaggcggagggttgattgtgttgtagttgtgactgtatggtagcccagcttctccttctgcccaatcctgctccctttcctttcctccgctcacaggtgttaatcctgagagcactctccaataaaattccttcatgctaatcactttctcagaatctgctttctgggagaacttgacctcctgaattgtcatgctgaacaaggattttaaaaatatacttgcctaagaaatatatgtggtctccaaagggaacaagatggaggattctcacatgcagtaattgtgcctgaattgctactgaacttttggttgccctttaaggagacctatagataatacaggtttgcattatcatcagttacaagcaagaatctactgaaggggcggagtgttggagctataaagcttagtgcaaccctatacgtgccaaagaaagtgtttatccagagacaactgcacatgaaggtaaagaatcacagaaggcatgttttcagcatacccattttctttttaagacctgattatcaatgaagaaatcaaataagtaagttctgacctgtcattagaaccctactcccgccacacacacacaccatggtatttctgaataaatctctaagactgcattgagttgaatatcatcaatttcttatggccaacataatacataaaaaggaaaaaggaagggaaacttgttgctttccggggtaagcctaaagagcttaattattgtatacacaccattctactattagatatatggatgaaaaatactttatcggtgcattatactgtggaattgtaagtgtgtaggtataattacagaaacatattgagtatttttagaaaaaggctcaatctgatatgaaaggttattttgcccaggttatttttaaaatgtgataaattaggaacattcaaagaactcagtcttctgctaaataacactttcactatggcctggcattgttatagagtaatcacataaaatactctgaatctttccttcctagtttatttgcaatttagccactatcatttcctatgatattttaggagaaagattaaaggatcattattttgttcctttttttggtgagatataggtcagagagaccttagtagcacctggatgtaagatcaaaatgattcttgccatatcaaccgctactcatagaaccagagttaatctgaaattcaaatttcctgtaaccataacagttcctactagtttgctagtaaattgcattttgattttaaaacataactttatattgtacttgtgaggggaagctagaattttgtcacctatggatatacagcactttgtagaaaggattccttttaatctctagcaattctattagtaacgtgcactaatgagaagcaaaagctgtcaacattgcctggattagtagtccattcctagcaaaaccaactctgtggttttatctgtttttgggcaacatctacctagaaatatgactggagaagggtggtggcaatgagagaatgtttctcttttctcctctgttatgaaactgtaaggcgaggaatatatgacatcattttaatttaacttctgatgcttgcttttcatccacagcatgaagaatggcagatctaatgtacagcatggaagataatttttaaagctaacatccacataactctttatatgttttcaaacatattcagagttattctatcatcacttcataagatattttccatttttctacctaccttctttttctatgtatactcagctggatatttcattctctgccaatggctttacactcgatacagattatctttaattctgaacctcattcttatttccacatgcctaccaacatctaattcaataattcatccatgcatccattccgtacctattgtgtaccaggatctgtgcctgatgatggtgacagaaaatccaataatacatggactttggtatttaacatattcaagtttaacagagggtacagataggtaaacatttaactagagttacaatgtaattaaggctataaaccatctggagtccttcccagtagctcaaatgtaacatatatcaatctgctttcataaacttctatctcaatttgccaaacaagtgataaatgtatcttaaacatgttttactctttccatcaaaagaggtggagatcatccagcaaggctttatctcaaaatagagtgatggatgcttaacaaaagtttgcctaactaattttcataaaaataaaaaaccttttagatatacagtacaggcttttgctggtttcattttagggctggagagattgattctgagagaattgtaatgatgttcccaaggttgtatacaagttaagtggcagagctgggggtatagcccaagtcttgcattctagaaaagaagtttttgtaactctgaagacagatattggaatacactcctctctgatatattcattgtactaaaagaaagaaaggcacaaggaagattatgtcactgaatcctggtcttcattttagagcacaaatttaattttctgttattgccatatgcagggtcgttgaaacatacaaatacctacacataagggaacacatacatacaaagatattctcctacccaaactattgcagaaaagatctggctgctctttgctttaaaataaaaatccatttttaatgcaaatttgctggtttgccgttcaccaacatatgaattaacgaggttttcatcccctctctcttgaggtctggtactaaattactcaaactctccagagttaattggaaaccatgacctaaatgttcccaaagtattgctgattagttctcagaaaactcattcccatcttttgtcaccccagacaccacaggatgactttttaacatgtgcagtagcaacacactggcatgagaaatagattaatcctccaaagataaaccacagctttgaagctatctgtgtaaacttccttcactgatacagacattttattttttaaaaaaaatatacatatcacctagactttagatagtaagagagtataggcattatcaatcacgtaaggaattttgaaagacacatttcatctctcatttttttaaccttatgaatgtttttaaaatagagatttgcgaatttatcattagggaaacaaccataattatacactttccctaaaaccattagtactttcctgaaaagacctgcattaggagacagcagtagaaaatgtgttttctactttactttgcattacccgtttcatttgatttgtatttcaactcataaatcactgaaaaaaattagttgataaagaaatgtacacagtgttatgagcagatgaaatacacgtctctatacacacatatttttttctttcttgaatttttaaagagattgatactctttaagatctgcattttatatttttctgctgatacaatacgaaaaggtactatttggagaggttgaaatataatgttgggagtaatgaattacatttggtttggttaatatacagagactcaaaatatccttttgggcatttatacaactgtaagggatctttagaaaaaaatgcagttaacactacttcccagataattacacacttaaaattggtgttgacctatagttggacacatttctgttctaaataaattctcaatgatttgtataatgcgaatttttaagttggctttggttacttgcagtgataaactctttaaagatatatttcctaatgttgatagactaagcagcttttcttctctcctaaaaggatttgtttaaaatagtataaaaaccaatttaaaagatgagcctaagatcatctcttacaaacctgataagactgtgcagttatatatatcctcatccacaataacttagagaaaaacagaacaaaacaactaactgtagcttgttagttgttgatacataatattcagaagacagcaaagcaggcaggttcagttttctaatatcaaatggcaaacacacaacagattcactttaaaagaaagaagtggctaaaaacatatcaacagatgaaataaacttatagtagagtcctgtcagtggaatttggaaatacgaacaatttcataaccgctgatctaaattctgaattatgatatcgaaatatttgtgacttttattacctagtctcttactcagtactctcttgtggttaataatacacatttgaaagggcccttttagcaaagcacatgaacagacactttttaaaagaaaacatacatgcgaccaacaagcatatgaaaaaaagctcaacatcactgatcattggagaaatgcaaatcaaaaccacaaggagataccatcacataccagtcagaatggctatcactaaatagtcaaaaataacaggttctggagaaaaagcattgcttataaactgttggttatagtgtatgttatttcagtcattgtgaaaaccagtgtggagattcttcagagatcatggatggagctgcaggccattgtccttagcaaactaatgcaggaacagaaaaccaaatactgcatgttctcacttattagtgggagctaaatgatgagaacacatggacacagagaggaacaacagacgtggaagcctactggagtggggagggtgggaggagggagaggatcaagaaaaatatctaatgtgtactacgcttaatacctgggtaacaaaataatcggtacaacaaacccccatgacatgagtttacctatataacaaacctgcacacgtgctcctgaacttaaaataaaagttaagaaaaagccattttatattcaacatgtattgttatagtattttacactaaaataatgttctgcagttttcaagctcctttgacaggatccacagatagcacctcctttcatattttaaatagcttgatgaggctaatgaggcaggttgtaattatcatgaacagtttatagatgaggaacttaactttcagggaagctgggtgagttgccaaaataaatgacaaatcttgaaacaatctagtccactgtactataagacattacctctcaaggtagacttgccagtctccctgtgaagtaaatataatggatattaatatgtcactattctcaaaagccctttgttttctgttattattatatgaattaggattatggggtatgtgtgtatatatgtgtgaaaagagaaaagaaattattattcctttgcttaccatcttcatccgtcatctatgagatgtgttacaataaatactgaactttgaactcgaggtaagcttgaggatttgatttagaaagaaggcattacaggcattaatcgaatattttaattcttatgaaattatacaaagttatagtacatacaattttggccttctctaaatgataagttagtaaatgttggttaatgatacagagagtatctgaatgtctatgtattttgggatatcttttacataaaatttctaacatgaaaataaaatacttcatacattgctttactagacattttacagtgaaataaatacattttaataaaaccaactgaacgatgaattaatttgtcgaagtgacttagtttaagtagattctaaaagaattgcccttctaattgtaaacctattttaatggctcagatatgatttacaagacaagatgtgggattacaagtagcttgagctaattaaaacttatcaaaataaagatttaaagtttcttgctttcgtacttttaattaccagggtgaaaaattgcatttaaaagacctagatactttgaaatgtattgatggccttttataagatcaattaaaatttataaagaacagtcataatttaggatttatttttttcaattagaagtacaacatgaaaggaatgaatctgagggtgcatctggttttaagaatcctctgacttatgaatataccacttactatagtctggatattcatcatcgtcatcaccattcatcaaccacaacttactgtaaattatttgagggcaaagattcacaccacagttcctggcaatttaatagatactcaataaatttaattaaagtcaataaacctactaccgataaggtatacagcttctaaaaacaaggccataggctcttgttcttaaaaaacttaaaattttcttgatgtgaatttattgaataataatttatatttatatagaattttagagtttagacattgctttcacataaattatttcagttgaacctcataataatttgaaaatattatctttgttataaaaaactattgttcagttataaccaagatgtttaaaaatgagaatgagcaattctgtgcccaaaattgtgttttgctttgcaaatgtacagatattcaatctttggaatttgtatctttcatcaaattttatattagccatgaaagtgaaggggtggactattttactgggcaacacattgtatttagctgtcaatgactgagtttctgttactcttccacgaaagttaacaattttttttctgaattttcaaaatgagtgtctgcaaaaaatgttatttcaatactttctaggtgtattaaagaaatagacagcatacaaataataacttctgtcaaaattaacctgttattttggcaaatgttcagattgcctataagtttgatcctggtcttcagacatcaagtaccaaaagtgccttaaaacgcatcctgtccagacacccatttggcttctgtcacccaaaatactcctgccctccctgctttttatcacccataagtttgatgggcctcctctctgtagttctactcatgttctgtcaaaaacatccagtgtgtcagggttgagaacagaagcttgtgacatagcaccagagatcttccatcaccacctgacactggtctattaatcgacatcctttgcgtaaaatcatgaagtggcttctaagccatccaatttatcttgcatctagccagtatttctccaacttattcacaagagtataacgaaagactttgtcaaatgcccagatgaaatgcaaatagactgctgcattttacttacctacttgtctaaaagtttttcattgtaaaacattattttatctcaataatttagacaatagggatttatccctgtatgcaggtatatctgtgttgttttactaaattagctaatctcttcaataaatgggttcatatttctcttatagcctccacgtaagttgcatttagcattttaaatgtcttggacagctacaataatatctcttataatttttacataaaattcaactgcatttatcaacaactggttagggggcgattgatatagctatgtgaggggaaggagaatagatgagtgttatcaccacccttttatagagatcatgccattcaagtggtgaaaatagattataattgcagtgataatcacagaattgtaaaagactgggctagacaatctggcaggtctgaaatggtaatttcatttagtcttgtaaaaatggcaactgtatcactcagaaataggttaggtgctccgaaaatactgctatttcattaattcacaaatcagtatttgtctggaaagatatttaaccaaattatacagaccacaaaaaaaagaggcatcctagaaattgagggaggacatttgactatcacagtgattgaagagtgttactataatagcattctgtggagagggaatgaagatggtagacttcttatacaacaaagaactctcccaagtctgacagcactttggaatatcccactggacatgcatgtatgtggaaaccctgtttataaacacctaaacctggaacgtaactcaattttacacgtaaacataagatattttcctcatgattttaagacattgaatttttcagccatgcaactaactgccataacgatccaagaaaaaatttatttcatggtgttaggaattttgccaagagttgttcagcattttggaaaattacgctatggatgaccaatgcccctcatggtatttgagtctccatacaacacaatggtgtcattctgcatttgtttatactgcattgatagtctcgtgatctaaaaacttcacttgtgttccagtgtgatcctgcctgaataactgcatactacaacacatattattttattataaatgactcttatttctctttaaaatagagttacggcatcatttaaactattgcctgtataagtagggtatgttgtctacatattttggcttataatcgtaaagaaggtattacaaagtatttgttatttaaaaaagaaaagaggggtggcattgggtctgagaagtttgaaaaccaccgatacagagccactggggaatctcaagagaaagtttattatactgaaaattaatagaatttttcaggagagaatgaggatgtgtcccctccctgtgcatccaatctctgatccctagagctccatagagaatgaaatagcattttaaaaattgctctcttctacaaccagctgtgactatcggtgaaccggaggtctacttcatatacgaacctgaattaaaaacagccagcccttgagtcagttcagagcccacgttcttgattacatttgacacaataatcatcatcatatcttaagactcaaatcagcctgacagtgctcaactcagggctgcttctcccaattagctgaaaattgcagcccagctcatctcctagggaatacgtttacatttacaattttgctgtggcaaaaaggcaacaaacacgctggaaggagcaaatcagctttttaacttttacactaactattttaagtttacctaagtctggtaaacctgttttgacaagaatgacaacgaggaagctttttttgttatgattttttataactgcgcaaagtttaagataactagagtttggactagaaggggaaaacagatacacaatgtgaatatttttacaagttacttgtcaaatgaaagctttcagaagaaacagcctttctttggtaaacggtgcattaaaataatttgcaactaatagatagggacatgtaatttgaaaacaaaaagtgagtaaatgtcaaggtcctaggaaatattttccaattatatgctaacccgataactccatgtccatgtgacatagcgttattctgtgtaattctgtaaattacttctctcctatatttctgaggggtggaataaccaaggacatttttgtgcattttgtttcctcaattatgatacctttctatgcagatcagggcagtttgcacacactatgggaaaaatggaaagtgacaaggtaaccatgcttcatggtggctgtgctgaagatttgctcagataacagtgtccttatgcgctgtcttctaagcggatgacagtgcagacatggaagagaaatatgcagatgggaaaacatgaatctagaaaagtgggaaaaatactgaggagcaggagacctggaaaagtaagacaattctagagtgggctgagatagaagacatgttgtaaccactggggacaggaaaacatgtgaacaggaacatgtatataagctgacagtgtgcaagagctcacagaaagcaaatgctaacagtaatagagaaataccattgaggcagaggtagagataaaaagaaataaggagggatcggccatggtggctcacgcctgtaatcccagcactttgggaggccaaggtgggtggatcacgaggtcaggagttcaagaccagcctggccaagatggtgaaaccctgtctctactaaaaatacaaaaaaaattagcagggcgtggtggtgggtgcctgtaatcccagccactcgggaggctgagacagagaattgcttgaacccaggagggagaggttgcagtgagccaagatcgcaccactgcactacagcctgggcaagagagcgagactccgtctcaaaaaaaaaaaaaaaaaaaaaggaataaggagagaggcaaagttgaggacaggcgcactggggaaatgacagaaataacaactcagagaaaagtgagtaagtgcaacatctctttgagtcttgttattcccaaacatccctattcacccaaagattaacatttcctacaagacaccatgttatgaatatccttaactaatggatatccctcaagaagaaatatttatttttcttatagtacagttacatacatttgggaattagaatggatttttaattggtttctgatccaagttttaatcattttgcaggaaagaagccaggactcttacaacatatgaatactcatctattatgtataatatcatttaagtggattttgccccaaatctttgtggatgtgcataattgaagaaaaagataatgttattacttctcggtaaattaattgacggtttctcctttaagattggtcaacaatctgagtactatgagcaacacttcttctatagattctgttctcctttagaaaacaaaattcacgtcttctgttgtagaattaaatctttgacagttcttaatgttgagaaaaataaaaatatcctcacgaaagtcaacattctttaatattattgagaaaagagtatacattcacattttattaaaactacggtccactgctataagtgtcatgaagttaacatatacctagtaaagtttgtaaaaaataatcagaaataagctttagtgaaaaaatccacatgttgaattttgctgtttctcacattaccttaaagtgtttttccaaattctagcttagccaaatcataaggaaactgaaatagaaatcctttgagtgactactacatactttaaattatggatatcatgttgtaaaacatctggctcattcttgtgctgtcatgattttccaaaataaaacatttgctgtttagatgttgtcatttaaaaagacccttaatgattagtcaactgatttgctttagttgatttcaaagtatatgctaattgacaacattgatgatgacacaatacttaaaaatcccatacaagttgtccactgaacaatttggtcatttccttattcatttccttattaatgctcacagaagcatagttatcattttttttttagtgagtcacagaatgggaattaatttattttaatccaatgttccgttttccttattttgctctatcagttttgtgagcccaaagaaataaagttgaccacagcaaaagcagtgctggggaagaggccagtttataggataactgcaataccttttacttggaaatatgtttgaagatcacctgaaagtttaattgacacaggatgggacagcacatctaggaaaaatggatgccattcagacaatcgttcttccgattttgatctgactatctgttcgctttgcggtgtatatcaaattgttgaattaaatttcaaaaacatcacaggtctacagggaatcattagttcccccaagtactttcgagagttgactgtagctcttttacttccctgctgtaatgacaggaaacgtggtctgaatttattgctatctcccacctctcttagagaccattgttcatttcactcatccattttccttcctgaataaatgtcaataggaaaaattggttttgataaactatattttatagtttgataaactatatatgctttctttttcaccttcttattgacaacatttgtccgattatattagcaggttccaggactaagtttaacaattattgttaagagtttttgtagggaaaaatggtatttcttgtagatatattagtagttgataatttatgtaaaaatttagtgtttgtgataggcacttttttaaaacttttcatttgaaaatatgaacatcatccatttccccatctaatcatgtctttcctgaagcatatatttttaaagtagctcttaaaacttgcaacatgtgatgtagctataattattttaatctgcatgaaaaataataggataaaaattaaagtatcagtgtaattttgatgttagaactaataacattgcacatttgttttgttagtgaaatatgtgctcaaatgatataagaataatattaggtaaatatggaaaagtagttctatgaagaatacattttttaaaaatcttagttcatcaatgcagtgaaagcaaatacagaattctctagattctcccattaaattataacagtattcagaattctttcaatatatggtggaagaagcaaaagctgatattaatagaatattatgccttttctcagaaaaacattatactttcatagaatgtggactcatatatatgtatatggagaattttgttcaatgtgctcaatatctattgcagtatctggcaaagagtgagtgcttaatttttactgaagcacttaattagaaaatggcaaatatatgtcagtatcagtattttcaccatagatactttcattatatagtaatcacagtagtgcatatataactgccactgtctgattctgacttgtactttcaaagttagaataataaagctctgccaggtaacccattttcaaaagcaaactttggcaaaactttggaatacaaaaaagaagatggagagaaacttgcctttccaggaagaatggcaaagatgtggtgagatgccctcttagagccagtatgttaatacgctaataaaagtagaaaagacttactagaactatttgaaatatcaaaaagtaacacatcactgtatgtgagaaaattctcaaaaagttacagaacctaacatcatataggtgatgctgcaatgtaaaaacacacacacacacagaaaaaggagactgatagcaaatacaagaatttctgtgtcagaattaacacaaactggtgttttgagcttaggaaagtcacagactctctgtgcctcagtatccttttctctgtcataaatattttgatattgaaattggtgacttcataggttaactcagacctatagaatgtcacgttcatttagaatatgggacagcaaattgtaaagatgtctgtccacctgctactcatttggcaaacagtgcatatcccagggagcagaacccagcgcaagcaagctgtcctaccattatcaattaagggcttgaagtcaagaatgagtcccaagccactggtttgccaaggagtctgcaaaatcttgctagaactttgactttcaattctggttcttgcaactgcactattaaagaaccttggcctcttcttagagtagaccaggtccgtccaccaggaatagttgctaagagttatgggttggccagggttactctacatgagaagtgtatgggggtttactcacacacaccaagtgcttggctgggcttctggaattgcctacctgtcaggataagttttactgttaccagcagcaacctagcaactaggctaaaagtaatcactagcgtggtgtggtttataggttttgtgtgggaaaaaaatcctcaaaattatgagttacttccattctattagaatgttgatgaagacagagtgtcaaggagggttaatggcatttgtttcagggaaaagaaaaacgttattagcagatcccagcaattttaatagactctattgtctattgcctctattgttgattgccatctgctaaaatagagactttattaagtatagcttcttttactgaagatatccctgattacttcggtggatttctaaaaaatttctcctccatcctccttgtgggaagtctcaggaaaaaaaaagattcaatatgattcaaataggctctgccagagaatcaatctctatcctctctctgtctctagctagctagctaattaatcaatattcccagaaaaaagtccttaaacttctaccagaatatgaggtaagaataacagccttggaggagtcatagaaaaaaatgtctgaatagagtcaaaattcacgtaacacaaattcccttggttagcatggcaaatgtataggcttatgcctacgtgaagaattgagctaatggcactagagaatactattcaggtaactcacggtgagatgatttcccttcagtggcctggcctatatgctatgctatctatcttacaaacacttactgagtgcatgttctatgcatagtattggaccagatactgtagtgttgtataagattcttgagaaattgttttcatggtcaaacttttagaagggatgcatactgtatagattatcccttccccccatactttcataaatacacatactttgttgattcaccaagcatgcactgtaataagggtctgattactcctatgggaaagaagtctgttcgctttgatttaacttgatattacctaatcattttttcatccatagaaccctttcttgagttattacttattaagatacagtggaactagttctgccaaaaccccatttggaaaaagaaaactcccactctagatgatgagtatgtgaagatcaggatgttataccatacaaccaccaaggtatcaccaacctgttcctgaatacttctacaactttacaaggcagcctgttccatctttggacagctttataacaatattcctctctctattaagctgaaatatacgttcttaggactaggttatatgcttaaatttattcggcctaagatcccctttggctttcctttcccactgttctatcacattgtgtgttgtgtgttgtgtgtgtgtgtgtgtgtgtgtgtgtgtaaagagagaagtgaaacagaaggagattattgttgctaaaaactctatgttatctccatatttggaatgtttttggttggtgtaggcagtggttctcaaattttaatatgcatagaaataacttggaggcctgaaagcttgttaaaagttccccaagtcccatccccagagattctgatttagttggatggggtaggacctacaaatttaaatttctagtgagctcataggtgataccaatgctgccagtcagaggaccatactttgggtaacactgcggtcttgggtacactgttgctctgccaagacctcatgccctagctggttggaatattgactactaacagctcacagctgcctccctccctggaaattgccttcagctgtaggtaacaatcttactccagtctgctctttcccatggggtgacccaggaccattaactctctagtattgggttcaaaggtccagatcccttgcttcaattcagcgtgtctctaaagggccatgcaatttccagaactcccctgaaaatctgatgaggccgcaacgcactgcaggcttcactgcacttcttcgtctgtgcaatcttgcctatcttacaaccttacacatgtatctcatgggaacactcctcaacaaaccttatgcacacaactctctatcttagtctatttccagggagcccagtctaagttagatgggttttttgtttcatgtttcttttgaacccacatgtagcaccttgcatttacattacatctttcagtattcagcctaccagtccaacttgttgaaaactttttggctcctgatactcttgtctgctatatttgctatttctccctgctttgtggcattgatttgataagaatgttatctatgtcttcatccaagccactgatgaaaatattgaaaaggacagagctgagattagattaccgggaatagctgcctgaaacctccttccaaattgataggtatccattagacagcagtgaagggagcataggcctcagagttgcagatttgggatggaacaacagttccgtttaagcagaggtcaaaagctagactcacagctaaagagaacaatgccattttagcatttctattttaataggaaacttaagtatcacttatataacacatttcaacaaaacatatctcactataaaaacataaaatcataaataatcattatgaatttatgattattattcatctaatttgtcccagcatgaaaactgtatttggtcatttcatggagggttttttcgtttacacattttaaaaaagaggttgtgataaagttgaagttcaacagctaccccaacttcactaggacatttaaaatactggcaatataaaagaaaaaggcaatccatcagtaattgtatgagcggccataagtttaagcaacgtaggttattatctacaaaggtgattgaatttggttcacctgatttgctttaattgctctgtggcataaacacactgactggacacagagtgatgtaatgagtatcataattaggaatttgataaagctaagtgtgaaactgactattagaagatatttgaaacacacaactactgctttgaatggggaattgatttcctagttaatttaaataattttcatctctttctatgaatactgatgacagacggaatgaccacagcataaaacattggctggaagaatgtcactatgtacttcaagaaattatttcccccatgttttttattgaaaagataaacacctgtccatttccttcctaataaaaatgtggtaagatttttttaaatgaaaaaataaaactatctgaaaatgcttttaactgttaataaacagggagtaagtaaaataaaaataggcaaaaatatatttgcaaaaatatgatagaaggaattgctaagaatgttgagaatgattctttatttgtaaatttttgatagtttctacaataagaatcacttgtactaaaggaaagaagttatttcaaaatatagaagaaacatccaaacacagaaaaatggtagataaaataccaaaatagaaaatcaaaaaggcacaatctgggcttagaaacaagttaagtagctctgtgtttcagaaatgccacaaaaacacacagtggtgcacggggctgcagacatagggcttttggggcctgggctgggaagtaggtagcagtagccaggagttcagattctgctgggctcaagaatctataaacactcggtataagacaaaggacctgagccaggctctttgctgcaattagtcaaggatgatatcaggtttccctacggggtgaaagggagctgcaaaaaaaaaaaaaaaaaaaaaaaaaaaaaaaaaaaaaaaaaaaaaaatctgctattgatcacaacctagaactgattaaatgacatccctttttagggggaaattggaaagattagatttcataaaactcattaatacctatatgtccaaacatttttaatataagaaatcatttgaattaatgatttagagaaaggaaacagatccctgttacatactgaataaagccaaaggatcccaaaactataagatttctagaattgtgcagaaaaaaattaagtcaagtgatgattatattcatttattaaaaaaactcaactttctaaaaataaatctacctaaattctatttttattgaatgttttaaagaagtctttctgagaatgatacagatagaaataaaatgaaaatataaatataattgaaaagtaacatgatgggtattgtagctaacattaatggttcaattaaaccaaataagaaaaactttctcccatttgctttaatatttgatactgtaatattaaatttatgaacaaaaaacagtctgttggtatcctataattttttattaggaaacaatggtaagttttcgataatactattgtttttcctgggaaaactgatacataggagcatttctaagcatatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctactgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccattcagtgcccaacatctgatgaattgtttcattcaattacaaacaattattgagtacaattactcagcaaataaaaggtatggctataaaataatataacagtctgctgaggatcataaaacagtccttaagtagttccagaaaaggaactctaaaattatattgccaagggacggtatttgtagatacagcatataagactcttatgaagttctaatgcttgtccctctcctaaataaacaaacaaatgaacaagcaaaaatgtataacactatttgcttttcttcccaggaaaatgttttactttttcatttgtttttactttcagaaaaatttgagaatgcttttggaaacatgtcatacatgtaaatatcatgcatcaagtctcaggagggtaaaaaaaaagcactggaatcaaagggaagcaagaagattcatttcaaggaagacagatccaaggctgttgtgaatgtcaaatgagcgtaaagacttgataactggcagaatagagaaaagttggttacaatctcccagaaatctacaaaggatgaagaggctttaggatgaggtgacaatagggataaagagagggaattgtttctagagcaatttttgaagtagaattcacagaatttggaagccagtttaatacatgtgtcagtagattgggaaagagagatcaagagaaaggtagaaggtaattcttaggtttccagttttagagacaattaagttagacaattacactacactgaaaacacagaaaatttaactttcttttaggggcaagataatgcattctacttgacacattttgcagcctgtagcatatccaggtggtaatgtaggttaggtggcagaaagtacagttctggagatcaggagaagagtgtaagatggaagttgacactgaggagtcttaatgttaactgaagccaacagacaaagctactcaaaatgtgcagagagaaagaagagagacaattaagaatggaacatcaacatttaaaattgcattgaagacagagaacttgcactgatcattgttacaactcccaactttgtatcttgagctactccccataacttaagattcatatatccagctatctactccacacatctcctagatgtataataggcatttcaaatgtaacatatccacatcttcctcccaaaatatgttactcctggagccttccccatctcagtaaatgatgaccccatctttccgttgctcaggctaaaaattcttgagtcttcttgactctttctctcacacctaaatttattccattataaaatctgttgtgctctgtacccaaaatatagtagaatccaaccactcctcaccacattcacctctcccattctgatcccagccacagtcatctcttgactgaattatgacaacagtttcctaatggtctcactacttctgtttagtctattgtaacagaggagccagataagacaaaacatgtcactcctccattcaaaaccctccaataactcccatctcattcagattaaaagctaaagtccacaggcctaaaaggccaatataatcagatgccagttacccctctaaatttattgtcaactaccttcctgctcgcttgatccttttctgcctaactgatctcccttttaaggttccttcaacatgccaagaatattcctgctttggggcattttaacttattaggactctcctggactactttttcccccccaattatacatatggcccacatcctcaggtcttttagaatttgcttaaatgccaccttttcagtaagaccttttttgattaccacattttcatggcagcactcctcttccacctccctctctctctccacttgttttcctctttgttcttccacactgtgtgtatgaccatctgacacatcatgtatttaatttttatttgtcaatgtctgtcttccaacttctgcttccaagaatataagctttatgagggtagggcttttcattgctctataccaagtaccaattactgggcctacctagcacaaacttcatacaaaagtatttgttgagtaagtaaattaatttttatggtgtcgatggcagatgatattttactgagttcttactacgcactaggcattgtgccaagcacctcacaattattatatgattagagaaatgagatattcaagataatattgttctgggaaccaaggaggataaagttttgattagcagagttgaccaacaggatcaatgttaaaatatagtcaagaagatggacgaattaaaatacactaattagctattacaaagtcactgatgatcttagtaagtccttgttttcataaagtggtggtgctggggaagtgagactggagtgggtcaaagtacaactagtagctaaagaacaggaaacagtaatgccaactactgcttaaaaatgatatagtaagcagaagcaagtacagctggatagaaaaaaaatgatatactaaaaaagttctcttaggatgagggagacttgagtatgttggcctgctaaaggggaggagcaaaaagaaagaagaaattgaatatcccaaaaaaaggaaagtagaataattactaaaacaacatgttggagaatgtaaaagagatctagtgtttaactagagtagctccttgctacacacaaaatagggctcaattgttttctcttttcttgttgcaatgaagatgagaaaggacctaggaatagagaagcaaagagtgacttacaagtgccttcaaggttgtcaaagacggagaaaacaggtcaaaatgttttcagatgatcaactattaattttgatcattaaaatacaaaacagtattataaagaacagagaatactgagatgttatggaagaaaatgtgtttgtatgtatatgcatgcatatgcatatacacgtatatgtatatatgtacacacatacatgtacacacatgtacatgctgaatctttcttagaacctagagggattttttagtatctgggagcttagctaaggaacttctaggcatgtttaaccctctgatgcaaggaccatctcctctgcttgatgagtttgtacctggctagttggcagttgtggaagccctcatacagctacaagcagacaattcagagttaatgcttatttcttgtttaaagagtgatcctggaacagaaataaggaaatgaaatctcatgacagtgtcatcataaagtcatcagccagatggcagtccttgaaatctaatccttagaggcttctcacaataatttgtaatatcacatctaatattatcttattcacaaactcatatctattcacagagattgaagacaaagaaatgaacttgcagaggctcacatttctggctttatatgttatcatggactctgtaaggactacgataaggaaaacaacatattttcctacataggtcacaacaataatctatgttcagatctgggtttctaaactgtacaatttagttgagaagcagccttctcttttttccatagatagattagttccttttaagcataaatgcctatttatatttattctatataaaatggcaagtaaaaatgatcatatcaaaagccactgtagaatttgaagactcatctgatgtattaataaacttaaacagcaaaatataaacattagtttacttttttattatgtcttgaaactgcaacatggcagtgtctgatatcaaagcaaatttctttcaagtacattttatatcttatttaacattcaacagtttaaaactaaagattttattactaatttaaatattcttccaagtgtacaaaaattttgcctaggtttctccatgtgactgaaagtctcagtgcaggcaatgcattagtgtttcatagtaaaatggtgtctaacctgaactgtgagaaatgatgtaatcagaaaactttccacagaatccctcctacctaaaaagctatagttacagaactttttcaaagatatgagatactttttctccataacccaaatattgacattattaatctttcctttttaagatgagtttaatataacaacaaaagtgaaaatgccatcctgtcatagttgtagtttttgagaccaacacaaataccatggaatactacgtagccataaaaaaagaatgagatcatgtcctttgcagggacatagatggatctggaggccattgtccttatcaaactaatacaggaacaaaaaaccaaataccccatgttctcatttataagtgggagctaaatgatgagaacacatggacacgtagaggggaacaacacatgctagggactattagagtgtggagggtgggaggagcgagaggatcaggaaagtcaactaacgggtaccaggattaatacctaggtgatgaaataatctgtacaacagacccccatgacacaagtttacctatgtaacaaacctgcacatgtacccctgaacttaaaagtgaaaaaataaaaataaaaataaaaaagaaaatgtataaatagaaaaaatcaggcagaaacaagtaaatgcattacaacaagccactgtgtagagacaacactttttatttataaatagaggcaataagatttttgaagtagcacagtaaataattattataaatgtaccctaaactgcttaacccatttatgcctaaggttgcaattttttgaatttttgcaatcagaccttggtgaggaccttgaacagtagaatataaataattcccacatgcttagtattccaataatggaacactaggataaatagctaaagtgaacatagacaaagatgatctagagcaggactatcagtaaaactttctgtgattggtggttacctgatgctgggaagggtagggggtgaggggatgaacttgattcgattttgcaggctcagagatggaagggaatttgcctcacgatgaattgtgccttgagtctcacccatatctaatttatattagattgcacttttgagtttatgctgaaataagatttttggggctttggggatgaaatgaatgtattttgtctttgagaagaacaagaattttggggaaaagggggcagaatgctatggtttaatgtttttcccttcccaaacttatggtaaaatttaattgccattgcaacagtagtaaatgtgaccttgaagaggtgattaggacatgaaggctctgccttcatgaacggattagcatcattattgtgggagtgagtttcatataaggacaagtttggccccattttttctctcttttggtcttccaccttccatcatggaatcatgacacaacaagaaggcccttaccagattccagccccttgatcttggacttcgcagcctccagaactatgagccaacaaatccctgttcattataaattacccagtctgtggtattttgttacggaagcacgaaaaggactaagacaaggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttagttcaaaatctgttttggccccagtggtgacttttacttcttgttaaaaatcaccgagcttattttttcagtaattgatgtcatattttggaactcaattatttttcaccgtggtcttcctcatattgtacaggtgctattttttcagcttgcacaaggtaattgtacattctgcaaagggagtcatcattcaaaaaacatttactagctccctattatatcacgtggttcaggacctggggatgtatcaaatgagaaagacaaaatctctgccctcatggcatttagattaatttaaaggacaaatatttaacaattagttacataatttatatttttatttatgattggaataaatgctagtgaaaaaagcactagagatcaagagaggtataataaggatacaaggcttagtttgaggagatactgtctataagcgctgttaatttccattcatatataatgggaaatgaagtgacgagtcatattgccctccacaaattttcccattgggtgtgtggagtgagatactaggatgagaccatgtacagctataactctatcatgaatcccaaagtgacttatttatcagataacaggtaaggcagtgtgcgccatgatgagatagaaagatattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatgtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaacctaccatatgatttagtcaatcatgacagtataaggtaacccacctttcaggacaaacttttcaaatgcagcatcttgagcaataaccagtatcaagtatttcaacttagtagcaattaattggcaataaagtgggcttaattgtttttatcacaagagaaaaaaactacaaaaataagctcatatataattgttgaatatgtgacatataacaacatttgaacgaaaaaaacctcatacatttctttccctcttcattaacttgttgaattgtttatgtaattagtgccatctactggcgttcaactaaacctgcatacagaaaatattgaacaacaaaagaatagtactgttattctagtcacgaattttttgaaggatcaaaatacttttagaataccttactttaaaattagaaaaaaagtcaaaatataagaatcttactaaaccaaatcacctacattttcttcgttgtttgtctttggcaattcagtgttttcaaacttgctatctcatcacttgaaacatatttcaaagaaagaagtcaattaatggtaggttttatctcgaagcatatcaacctgaaatttctattaaacatttctgcaagtgcagagaggaggcttctaagcattaagataatactaattgttaagatagttatatcaaattcaataggatgggttaagtcattgataaatggacacaggaataggaacaggtagttcaaacaagagaaagagtgggatgattttatttaaaaagaaaaaagttaactttcaagtaataaaaaatagagtattaaattgaaaaggtacaattggacaccaattaaattaacaaaaaataaaatccaaagctgaaaagaccagtaaaactagcacattcacgtattactgctggggaccgttatctattaggacaatttggcaatagataccaagtgacatacaaatgcttattcccattgactcaataatctcacttttggtactttatcctgataaaatcttcaaaagaagatcaatatactatatgacttaaaatcttcattaaccaaagcagtaaaaaaatgagaaacaggccgggtgcggtggctcatgcctgtaatcccagcacttagggaggccaaggcgggtggatcacgaggtcaggagttcaagaccagtctggccaagatggtgaaacaccgtctctactaaaaatataaaaattagccgggtgtgctggtaggctcctgtaatcccagctactcgggaggctgaggcagagaattgcttgaacccaggagatggaagttgcagtgagccaagatcacgccactgcactccagcctgggcgacagagtgagactccatctcggaaaaaaaaaaaaaaaaaaaaaaaaaaaaagagaaacaatgtcgatgtttaatgcagggacattaaaagaacataatacatcattccaatggtccaatatgtagcaaatgtgcacagtaatcactgtaaaaagagcacaattttcttgtgtaaaaaacagaacacaatttttaactacactgtgtttatctctaagaatacataatcatgagctgaacacgaaatggaagaaattgaaaataatgcttctgaggagaaaaatcatttttgttttaatatttgttcttttgcgttagtatgatatttacagaataaaaatcaaacagtgttcttagcataatttcagcgtgtttggtgaactcctattgaacatatacaatctatatataatgtaatttctcagttaactaaaacatcctagaatcaaaccaagtaatagtatttactgcatatagcaaatagacccagattaccaaactattatcaagaagctaatgccaatatcactgacttttgctatgaaagcagaggacagtgtctaaaggcacagagcatagttgctgctattacaaaacaattaacatttatccgcgtggaatgcctgccttttcttccatactccttttatcaagcattacagtttctattctccacttttcagatcctcgcactatttgaaagcccttctgagggaacttctgccaaaggcttgccttttctagaaatatcctagggtacaaaattaccacttctttctttctcctcctcacttaagccaaacctaaagtgataaaagaaatgtattccaagatacgaaagaacatgtaattggcccttagtatccagagggtgctatttgcattttaaaagaagagcttattatctctcatctattaaattgctaattaatagcatgaacatccacaaaactgagaccaataacttggttacctttttttcaaatgaattccttttataaaacactgaattgttaataaaatacttatgatggaccagtatcagagcatatatgtaaaagctcaggaatacaaaataaaaacaaaatttttagtaaatatataattaaaatcatttattttactcaagcaagttaaataaccttggaagccacccatcactcataggttcctgtttgaaaagtctagatataagaggttataccatttggatggtttcatgggtatatgcacatgttctagcccatataattttatgcagtttttgtatatcaattacacttcaataaagctgttaaaattaaaaaacataaaatgcagaaggtgccaatgaatctaaaaacataatcaatagatcataaaaatgcctaaaattataaattataacatatcctagaattttccaaaatctctgaaagaaatagtaagctagagttaaatgacagatttcctactaaacaaggtagtaaagagtgaggcttgacgtcaaaccagaactttttgatgtactttaatgcttgaaaggtagaaatacgcgtgccatatatttttctgcaaaattgtattcacagcgaaagttaggactgttatacctaaggaaatcttgactgagtgctaaccctcactgaatactgcccaggttttgtgaggatgtaggattaaaaagtaaaactcccactgaccttgactgacattgagggggctcaggcccttatataaacacaaaggttctcaaaggtagccttttttttttttctcccttcttaaagacattccccacacagaatgttttccctttctcctacggtaatattctgcccgcccaccttgggttttacccaagtgtcattcacactaggaaccatgaccttgaccagctttgcctactgctgtgaaatttactactgggataactccagacctcagaaggagtgtaaattcaaaaatacaacagacttcacacacacccttttctctttctgaattccattgacaatggtgtacaccacagggaattgcttgtgtggtgatcatggtgtgtgaagaaatttaaaatactgtgagcactagcttataaaaaaagattgcctttgtatatgtgtgtgtgtgtatgtgtgtgtgtgtgtatgtgtgtgtgttttctatgaagaatataaaatgctaaatccccaaaagattgtttccccaaccaggaaagaaatgtttcacattcaaacccattatgctgctactgcactatgtgcttgatatatattcacagtatcttaggtagaaaaagtgattgtggactatgagacaacctgaattaatttcaagaattttgagtatttttttctactttaattgtttgtcttctctcatttcttttatgtgtaagaacttattttagtgatattgaccctacatggtagaaaagagaggaggaagagaaagagtagctaaaagcctgagcaatacaatgagcctgctgggtttgaatcctggcgtgatcgcttagtggcaaatgggagagttaattatcttttctgtgcctcagtttcctcctttgctaaatgggaatattaacagtatttatgtggaaatatgattaggtgggttaacttagagaattcagggagaacatttacaaaggtgcctggcgtgcccgaaggattaaataaatattaatcatcatcagcatcagcatcatcatcatcattactactgctagcacatctactactaattttaatgagtcaaactatattccccacagtgtgagccccttctgaatgcaaagcaagtagctcgctgttttatggacattgtctagaaatgctgcaactctaaaattctccctttaacttggaagataaaagcaagtgcatagctctatcattaaaattttaaggttgaatattggttaaatttccttttaaaatgtgttttgtgatattcacctacaagtaaaataaatgtttgttccgggtgaactattacttaaatttttaatgactgtgtctcaaaggaacttcaagaaaggcagtgcagagtaacgaaaggacatcttcccaggaagttttgcttgtccattgttctgcagtttgatcttaaggaagtcattaaccttgtaagtcccagttttgtcatctgtaaactaggatggggttacttgctctgaccatgcctccggcttgtcctgaagtgtcaaaatcaagcaattgctcggaaaattgtaaaacaggatcctaatatgcttatgaacaaaaagttctacatgttggatttgttatttttccttggatcctgtatttacattcatgaaccaagggattcatggaaaaatttaactctgttagctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacattgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaacatacatttcatgaaatatcagactttacatcttgcatccttctctctagtctcagaggaagaggcgacttttctgctattggaagttgatttcaccatctgggcacccatctattctgggatcctcctccacatactccctctctctttgtgtgttccaacttcttgcctctctgcggggaccttctctagagacttcaaacatgagtgtctctctcatctttaaacaacaacaacaacaataatctgcactctatcattttctttcctttcacagtcacactctttagaaggcagatattcactcattatctcaacttgactacattcgtgccactctccaattcatgaaaatcaggcttctgccatcatcgttccactaaaactattctgacagaagtcactatggcaaattgaattactggccccaattctttacctctccctgtatccatgccctttgctaagtaactctgaaattcttcctacgaaagacagcatgcccttgacattgagcttggtcatgcgccttgctttgcctaatcccagtgggatattactagaagtaacacaagcagaggcttgaaatgtatttatgcagtgtggctatcccttttgcacttcaccattaccttaagacaaacatgctctggactagcctactcatctcaggaggagaatgagtgacatatggagcagagcgaccccaatcaacctgcaacatgaagaagtgccaccccacccaagctgaaaattcatgaaaggcaatatgggcttattgctatatgccactcacatttgtgaaaatagttaactgattcagttaccaaaagccaatgcctatggaaagatttaagttcttatttacttgatttatttgcagcaactggtgctgctgactattctcttctcgaagttctctgctttcttggcttccactcttttggtcgcctctgtattctctgagtgttcaagcttttttttttttttttttgcctgtcctttaaatattaatgttctccaaaattctgtctctggatcaatctgatatgttggtcctcaactggagcaggaggcagggaacatactccctgggtagttgtatcataagtttttttttttttttttttaacttttatccaaatcttctacttccattgacactaccttaatttacgtccctatcatctcttgctcaggtactaaaataatcttttttattggctccctccctccactctcaaaccacccttccacctacatacaactgcgtaaatgatctttttgtaatgcaaatagaacctcatttctcctctgtgtaaaacctttcaatggtttgctattacctgcaagacaaagtcctaacctctctctttggattacaaggccctcgaatatatgacccctacctacatattcactttcatcttttgatatcttcttcctttttgagcaattccataattgtccacatgagaatataaatgctctgaaaggttaagtgacttgttcaaggtgacatagctagtcagtgaaagagtcatcataaaaatgcaggtttctggactctcaattcaggtttcatttcaattcagttaaagaagttatgcatccatataaagaaatttaaggaaaaggactgggtttattttaactgagctttgaagaatataaaacaatcttgatgattatagcatgactggaaaattattatgtataataaagtaaggcatttctgaaaaaaagacagcagaaaaatacatagtttatttttgaaaatcactaaacaatttggtcccaagaatgaattaatgttctataaatccttattgggaaaagagaagcacaatttcttccctccttgtgtgaattaaaacgacctataaaacctctttatggatttataatagaaatgttaaaatagctgtaagaaagccatttcaaaagtaaagcctctcaccattaacttcaagactcatctattaaacctctgacattaccaaacaactctgtttcagaaggtaacactctatacagggcatactatttaagaaaatggccctcattttccggcttactgaaaatgattaatctttacaatagctttgaagactacataccaacgtcgttacttttctgtcctttcaacaatgactacaagctgagagcagactagtaaatgtgttatcggccaacccattagagttccattattttctgtcttacatggcttcatgtaatgaatttttataattaaactaatggcatacaatatatttttcccctctttactttcaggccccatttctcttccagctgctttggaataagtttcatacaaaaagaagggaggagaggtctccaagtgcttcgttaccttaatttcattatgacatttttgaaagcattctctttatctgggctctctctttaatttgctgactttattaaaaggcttaagcaatactgtaattaacaaatcacccagctaccccaggcatctgagaaaagtcagttgagagggtgtagaaatggatgggtggaaacgattccagaaacaatgccagaggacagaaccccagaaaatggcgttttttcagctccttttcagaccccatgagcatattgtggtagactgcattattgttctcaaatatccagtgccttttcacgccagaagattatacatcggcattcccattgaactcaggaatggccatgtgactggttttgtctactggtcacttccaggcagaaggctcaagaaccatgttccttgcctctatgatcatgaaagaatgtaccaagatggagataccatcagccatggtccccgagtgactaagctaagtagaatgctctcatcagtctacaacgaacatgtaacatgagtaaaatatagactattaagcctctagatttgaggttgcttattactgtagcttagcctatgctgactgacatacctattcagatatgaccttatttcacatagagtagggcaattctaatacctccagacagtcctggaccaggaccagggctagaataaactagtataatgacacataaagaacaggttctcttattaataaataggaagccacataaatgttgaggaaatgtttagaacaacaatatccctgtttttctgaactacaggtaacatctcagaatatattctataggacagaacctgcctatcttgaccataaaagaaaatagctccctatccattgtgtgatggaggctcccatctaggtagcagttatgttccacagacatggctattttttcatttctatagctggcaagcagcttcatgaaagagaaaaatggagactatgtttctaaaactgtgttcataaaacttgaaaaaataagaaaagatctgtagtcaatgacatgcagatatactttttaacataccataaaattctcccacttaaagtgcataattttctggttcttaatgtattcagggttgtgcaaccattattatgatctaatttgagaacattttatttgcccccaatgaaacccataccaattaacagtccctttctattgtctattctcctcctccttcagtctttactggatgttttatatgaatgtattgatacaatttggggtcttttgtgactggattccatcacttagcatatttttgaggttcactcatgttacagtgcatatcagtatttcatttctttttattgctaaataatattccatttttggatgtagaggacattttaaaatttattcattagctgatggacatttgggttggttctactttttggctattataaataatgctgctatgaacatctgtataaaggttttctgtgtacatatgtatttttatttctgttcagcatacacctgggagtagaatggttttgtcatatggtagcttcatgtttaatatttccaggagactgggaagggtagtggtagggggaaagggggggatggctaatgggtagtgaaatttataatacaaaaatatagtttgatagaatgaataagatctagtatttgatagcacaagaggatgactacagtcaaaaaatttattgtgaatttaaaaataactgattattattagattgtcgtttgtaacagaaaagataattgcttgaggtgagggataggccaggtaccccaatgtgactgttacacattgtatgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatggagatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcctacattttcttagaagagttttaaagttttagttcttattaatatatttagctctatgattcattaaaaatatattattattataaagtttattttacaaaagttttaaaacattttatttttaattttattttgctttgacaaataattatatacatttatggggtacatgtatgttctgatatatgtatacactgtggaatgattatatcgagcaatttaacgtatctatcactgcatatatttatcatattttatagcaagaacatttaaaatctgttattttagcaattttgaaatatacaatataatattattaactatggtcaccaggttgtgtcataaagtctcaaaaacttattcctcctgactaaagtttttaaccccttttgatcaacatctccccattttccacccctaaatccacagcctctggtaaccaccattctactctctacttcaatgagtttgacttttttagattccacacataagtgagatcacgcagtatttgactttctgtgcctggcttatttcatttagtataatgtcctccaggttcatccacgctgtcataaacaaaaggatattctttatttaaggctgaataatactccattgtgtatatgtaccacattttctttatccattcatccactgatggaaacttaggttgattccatatcatggcttttgtgactaatgctgcaataaacacaggagtgaagatatctctttgacatactggtttaaattcttttggatatatacccggaagtgggattgctggatcctatggtaattctgttttcagttttttgaggagctaccatactgttctccataatggttgtactaatatacattcccaccaatgatatacaagtgttaccttttttccatatccttgatcaacacttgttatcattcttctctttttataacagccattctaacaggtgtaaggtgacatctcactgcgattgtaatatgcatttccccaatgattagtgatgttgagcatttttcacaaacccgttagctatttgtacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgacttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttcttaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtaggggagaatttttccttgcctcttccttgcttctaatgatggccgttaatcattagttttacttgtcttgcaactgtagcactttaatctctaactgtaacatcacatggtgtttttcccgtggtcagtgcctttatgtggcattcttctctctgtgtatgcctcttttcctcttcttataaaaataccatcttaacttgactgcatctgcaaagactctatttctacataaggtcacatttgcagatacctgggctcaggcttttagtatgtcttttgggagcgggggacactattcaatccacaaaaccttctttttttttttttttttagacggagtctcgctctttcgcccaggccggactgcagtgctgctgtctcggctcactgcaaactctgcctccagggttcgcgccattctcctgcctcagcctcctgagtagctgggactacaggcgcccgccaccgtgcccagctaattttttgtatttttagcagagacggggttttaccgtgttagccaggatggtctcaatctcctgacctcgtgatccaactgcctcggcctcccaaagtgctgggattacaggcgtgagccaccacacctggccaataccttctattcttcatttgttaagtgttctttatttttcaagcttgaaagggttttgtactttgtcacatgaattttctatatttattgtgatgaccatacgatttttgtcctttattctattgatatggtataatacattgattaaattttggatgttaaaccaaccttacattcctgtgataaatcttacctggttatggtagcaatcatgttaatatgttgttgtattaggtttgataattttttgaggcgtttcaagtctatattcataaggcatattgctctgtagcttgttttcttgtgatatctttgtctggttaggaagtgttcctttctcttctattttttggaagagttgtttatatgtttggtagaattcatcgggggaagacttctgggcctgagcctttcattgggagaagtttttaataccaattcaatttcttgttataggtctatccaggttatctatttgtttagttgttcataatatcctcttttacttctttttatttctgtaatgttggtagtaatgcaccctctttttctctaatattagtaatttgaccatttctttcctaaccaatcagctaaaactttgtcaattttgttgaccttttcaaataactaaatttctagattttggttttgttgattttttctattatattttcttcctctatctgatttttttcacactaattgttattacttcctgctgcttactgtagatttacttttctcttctttttctagtttcttaaggtagaagcttaggctactgatttcagatctttttcctttttaaatataggtatttatagttatacattttactctaagcactgcttcagcctcctcccataagttttggtatattgtatttttatttccatttatctcaagatatttttgtattttcttatttcttctttgtcccattggctatttaagagtgtgttgtataattttctcatatttatgaactcccaaatttacatctgttactgatttttaattgtactccattatggtcataaaatctgcattgtatgattttaatccctttgaatgtagtgagacttattttatgacctagcatatggcctaccctagagaatatttcgtgtacagttgaaaagaatgagtattctgctattattggatgaaacgctgtatagatatctgttaggtcttgtaagtttatagtctttatagtctttttcaagtgtctatttccttgttaatttgcctagttcttttacctgttattaaaagtgagatgttgaagtctccaactatttttgttgaattacctaattcttctttcagttcagtcagtttttgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcactggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggagaacaaaagggaataaagaaaatacatgaagaaatggtaggtcctggcaagaagatttctaataatgcttttcattattgtaccagaaacccaaacctcaaactactagtgtgggtcaatttgctgatttaattttgtacaactccaaaaaatacacaaaatatataaaagaaaaattcagtttccactaccgtacatatttttatggtggatgagatatatgatgccatcgatccttccacagataactaaaaatgtaaggcactacttccatatttgaaaaatgtctccctttttagtaaaataatttgagacactcaaatagctgccttagttactacatacaataagttcaacttttaaaattaattatgtgattatagaatgtctgtgtttcaagtttcctaaagaatgccttcaaaaacacagagattttgcagccttagaaatgtttattcaataatttgaaaagtattgaatttcttgcttcagatagttttcaatattatatagccaaatcagccaggctcaaacaagatttcacttctctattgaattcatgtactcttagctcagccaagcacaaaacagctaatgctgtcacgtttgaaaagcttttacgctgaatttgacacaaaagcaatcacaaagccgacaaaaaggggatttctctttcaaaaactgacaggggaaaaaataaatgaaaactcggagcctgggaaaatctctcttgacactggaaaagaaagtttaaaacgatcaagaaataatttttccaaagaatccattgccaagtttggaccaatcttaaaagcctagggaacaggttatgaactcaaccaagaatccgccaaatgaaataaatcctatgatgatcactgttggcagttttaggtgccaatggcatactatttttgcctcttgtgaaagttctaaatggcatcatctctcataggattctgtcatagcctattggcaaagattttgattagaatgaaaatcttgtatgtttttgcctaacatctgtctttctatctcaaaagaactttattgttgtaccaggcccatagagaagataaaattaaaccatgaagccatgtggctaacaaaattaactactttctaacttcatgtttttgttttagaaaaaattaagggtgaaagaaaacaattaccaatatgttatggccgtctcttgatggcctgctaattaattgttgatactctatgccatctgcattctgttttttcaccaaatcaagactctcctgttgctgtttctttccactctgaccacgctttcaagataagctttttccacatgacatctccggttttatttctgttctgtgaataggttgttattgtccccatttattctccttatttatgtatttttgagacagagtcttgctctgtcacccaggctggagtgcagtggcgtgatcttggctcactgcaacctccgcctcccgggttcaagcgattcccctgcctcagcctcccaagtagctgggactacaggcatgcagcaccacgccaggctagtttttgtatttttagtagagacagggtttcaccatgttggtcaggccggtctcaaactcctgatctcgtgatctgcctgcctcggcctcccaaagtgctgggattacaggtatgagccaccgcgcccggcctcaccattctttttttctaaataaaaggaggagttttttctaaatgtcagaccagcaaggacataaagatggaaattaatgaaataatataaagaagttaaaataattattaaaagatgtttaacaacattgataaatatttatgcaatattaagtttacaaatcagaatttaaaatttaatttacattatgtagacaattaaaatatatgtagataagaactagaagagactgtcaataaagattagcaattatgaatcattaattgctttttggtatcaagcatttttggtaattttctttttacgttcaggtatggtgactggctcaaattttaagagttataacagtgttggtggttgggtttgaaacatttcattgttgctcagtagtgagagttagtgtagtcatcactgaggtgctgcaaaggaggctggctgctgtaatcacagctctccaaggctgtagacatagctttgtgattgccttgtgaggctcacaggctctcttgttaatcttaggcacacagactcagaaagaacttacggagcaagggggtgttgctttagccatttaatgtctcctcctgtctattttcacacttttttcctaaaagaaaattttaagtaataagccagctaatatcacttagtagtgatgacacattcgatgtaaagaccagataaccattttatttgctccctaccttttagaagaattaaacattgtcgtttcattaaaaatgaaatgcagtttgcaattattgttttattttttcatcaaagaatataatatgaaattttttttcgcagtatactatttcattgctttcattttctacctgttggtttatcagtaatgtaatataatcttatttgtcaattaataattacatgagtctttttcagattcttatggggttttcttgctttgttttagccacgtagacaattggaagaggaagcctgtgaggtcatctacaagagtaattgctatgcattcgcatcacaactctactactttcaaaagaagattctgaacttctctagccttcagttttcttctctgcaaactaagaataataagagtacttttcaaagagtgtttttgaaaggatgaaataaaccaatatatataaagtgactagcatactttttgacacacagcaagcattcactaaaagttattattaacattaggattactttaattttagcatacatcattcaagaaatggatgaaaaaattacagctttggccatctttatctgtatcgggaacttacattgaatctgcagcaatacacatcattaaattcctaaacacagagcacaaacaaaaaatgtcaatctctatagatagtggctgagccatttttatgatgtagttttagaccattccaaagcgttttttttttttaatttcaaaagtttgacaaaggatagcaattataatacaattctggttttattttaggtgattaaaacatcttacatgttttgacaatgcaattgttttgttttctactttcatatttccttctgcagatatttttgtctcttatttaaagctacttgctcttctaagagcaattaaaccctaaccattcttaccatcactttaggattttcttaggttaaatttatttctcatttgctaactaccagagtcctcttgccctagtcaaatctatcactgtatgcctctcatctctccttcttctcatctaactcaaggatccagtccaaacttcgtattttctgcttataccttcttaccagttaactactttggtttgtgatccaatagattcatagtatccgaaacttatagagaagaaaaagaagtagcataacatgctgactacctcacgaatatgactagagctttcaagaataaccacatgattctatatattacatagtcagaccaggaattaggaaaatgaccattggagattcctaattcatctatgctcatccattgaaaaaaccattagtggtaacatgtgtctcttgaaagaatttttattcacctagattttgactccaacagagctaatgataagactgtaaaattctatgtggctttctaacatcctcatcatataaactaaaaccttgtcctcatagcagctcaggtcccttcgataaaatggctatgacagagattggctaaaagctcactaattccattaactcttcctgaaattcaatcgagaacaagttctgtgtgatgggatgtggtggaagtgatatacataatttccaggcctggccataaaacaccatggattgactgaccacattctgtcttccttttctgcagtggcttttggcagtgtgttgaaaatgacaagtgtcacaaaattggaaaagtctgggtttccaagtgaccatgttgggggacagctcctaagaatggcttgtcaacctctactggactatgatataaccaagaaagcagtctttattgtgttaagctattgagatttcagagttcatttcttactatagcttagcatagcctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgctgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgacttcatgcaactacataaatacgtataccaattttgaagtgatcttaaagatggtgcaacagaaaaccagccaactatatccagattactaaacaaaattaactttaacattgacattagctgtcaattttcctctattctctaccttgactcaaaagtctactggctaggcatgctaactcatgcctgtaatcctagtgctttgggaggccaaggaaggagaattgcttgaggccaagagttcaagaacccatctctacagaaaacaaaaatttttaaaaaattagccaggcgtggtggtacacgcctggctagtagtcccagctactagggaggctgaggcaggaggactgcttgagccccagagttcaaggctcagtgagctatgattgtgccactgcactttagcctgggtgacagtgagactctgtctctaagaaaataaatatacaaagtctactgttcatttcagctttaacgtgattttctgttaataactttacattaaacatcattaaattacaatctatggtataattttatcaaatgtaaccagtattttattttaaaaaggtatctttgatactaaccttggtttctgtgattttcttttggattgcatctactgtatagggaccctccttccatgactcaagcttggctctggcctgtcctaagacctgctcagcttcttccttagcttccagccattgtgttgaatcctttaacatttcattcaactgttgcctccggttctgaaggtgttcttgtacttcatcccactgattctgaattctttcaactagaataaaaggaaaaataaatatatagtagtaaatgctagtctggaggagacattttaaatgtaacttccaaacgttatctcacatttatgttgcttatttaaaaaattattcattgtgttatggctaggatgatgaacaacaggattctttgcttttttgatggcaaatattagtttctgttaaattattttcctgaaggtgacatagaacatcaacatatatataaaattttaactcaattcttgatccctagaaccaaatatgaatcatctgttagaaaagcactacagcagaatatccatatcccctcatccttgccacttcagcacccatcagcctgatttcccagtgccagcatttcattgcctgaaggctttctgttgccacaggagtttgctttgccatccatgtgacaggctagacataccaggcaactgatgcctcccctccagctcccagaggcagcctgtatataatgactaattgtaggaattgggatattgttacactagctcccttgatgctaggggaaataactctgaggcatgtattttacaagggttccagagtttcccaagggataaagctccagtgacccacaacagcagctggcttgataatgcaccactctttactggctgccttgcctcacctgtctcatttttccactcttctactgattaatttaccccccaaataaatcacttgctcttaaaaccttttccaagggtcttctgagtgaacccaagggaagataagtgtattagaaacttcttctttttctttcttttttttttttgatggagttttgctcttgtaacccaggctggagtgcaatggtgcaatctccgctcactgcaacctccgcctcccgggttcaagctatcctcctgtctcagcctcccgagtagcaggaactacaggcacgtgccatcatgcccagctaattttttttttttgtatttttaatagagacagggtttcaccatgttggccgggctggtctcaaactcctgacctcaggtgatccacctgcctcggcctcccaaagtgctgggattacaggcgtgagccaccgcgcctggccaacttcttttaacaatacctaagaattcacgctgggtgcattttgtaagactggcttatattgaggctatcactggtatcattggaagtccaagagggaggtactatatagattctactctgaaatatgttcttttcaaatattaaaataaacaggactacattattttttctatgcaacttctctaagctggttttatgaaataaaaataatacagaaaacaagtaataaaactgccatctactttatcccttaagcatgaaacctgatagacattctagattctttcctaagcgtcacccaacacctcatataattagttacaaatttctctcatatataacttctttcctctttctattggcactgcaaacctctatcattttttgccctcacatccataagaggctctatatcatcctcccagacccaaatctctgttttagaatgtaaattctaccccaattaaagattaaaactaacataaatctgatcactgcactccctcttataaaacccttcaatgtttccctactgtcttctggaatatcttagctggacatacgtgttcttctatgatcttgcctagataatctgagaggtttatctacaaagcaacaaatcacaagataagcagggtataagaaaccatcacagataatacaagaaccttgcaacagtagagctgttactacatctaggcccaagggatgaggggagggaaaagtggccaaaagcagagaattggaatgagaaaccaccctgagaagagcaataaccttttgtcaaaggacatagtcagcctgtggcaacctcaaagggagggaattaggagaataaatatcttgacctcactttacctcctgtcttcaatttccttctagggctcttgggtgcctaaaccaactggaagccaaagggcatgggagcccaatgatgacagaggtcagcctcccagaataaagagcaagggagagaaggtcaaagaatggctacagatggacaaacaaaatgtatatggcacaggaatataaaactatgcttcttattttgttatgtaagtaaagtcctttttaattaaccctgttgcctccacaaagttatgtgaagttataagttaaagaaatacttgagatggccaggtgcggtggctcacgcctgtaatcccaggtctctgggaggccaaagcgggtggatcatgaggtcaggagttcgagaccagcctgaccgacatgctgaaacccagtctctactaaaaatacaaaaattagcacacgcctgtaatcccagctactcaggaggctgaggcaggagaatcacttgaacccgggaggcagaggttgcagtgagccgagatcatgccgctgcactccagcctgggtgacagagcaaaactccatctcaaaaataaatacatagaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgttccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtctctgattccaatttgccttcgctttcgttagtcttaattactaacattttactatgctagcaatattttttagaatgcctagtggttttcacataaacatagcaagctcttttgattcatgccagtaaatattttgtacatcctacagttcatttcaatagggaaaacagtctatatttttaaaaggccatctctagatattaggaaaagataaagcagttcttcctattatgtaggaagataattttaatcctggaaaaagaaggaaacttttataacctgaaccattatttcaggcaaacatgggatttgaatgcttgctcaataatagaaggctttcagcaaaaaagtggtcatatgtgtgttatgtagcaagttaaaatggctccttggggtgtgcatcccactgagggtatgctttttcacccttgaccttcaactgtacattatcataatttattagttaattaaaaatatttataggctagagactcactcaataatccatctatccctctgtgcatccccacacatccatccatgtagccagctagtctctattttatttaccatctgttagacaccagccattatgataagaacttggaaaacaaaagggtttaagacagattacctggcttctggtttaggtgcctgttagatagtggtgctattcactgcctatccaaagaatgcagagtgagcatggagaagataatgagttcagttttggacctattcactgggaggttgtgaggaacacacacataaaactaacattttagtcaggaggactgaaggatctatagcatagctgtgtattttgggagagacagaaatctgggattggccgtcactacagagaaataaaaagcaaagcctcaaatgcaagtgcattctcatttatatggcacatagactgagcccaacaccgggctgggaatggactcctggaaaatacaacgtaaaaagaataaataaaacacaaagagcaaataagatgaatgaaagactagagaaggaggaggaatatcaagaaagtgtacttttatagaacatggaaaagaaagattttcaaaaacacaagagtgattaacactttcaaatctcatagatgtcacaagacataataaaaatcataactaacatttatttgaatatctacactgtctgaagctctgtgttgttctttccttgcattaatcacttaatcatcatacaatcctataagtataattgtttacgttctttttctattgctgcaattatcctcatttaacaaatgaggaaataaagacagcgttaaataactggtctaaggtcacatagatagtgattgttagagccgacacttggattcaagaagttagacctccaaagcccatgccaaaagtatccattggctttggccacatggaattccctgaagaccatacacaaaatgatttcagtgcagtggtagaaatcttactgtaggagattaaaaaatacctatgaaaaagtaaggacagtaaattgtagactatccaaccatagatcattataagaaggaagtcagaggggagtttggtgtcaagagaagttttttcccaaatatggaaaacttgagtatgaatataggtattgattggggaaaatggtcaaaagacaaagatgatgccagatggaagaaaagtccctgagaaggtgcgtgtattgaacattaactaactacctccttctcctgtgtttcccctgttatttttccatttgtgcagttttcccacaatagacctctctttgctctgtggatggtgtgtacttagttttaactcatctccctggctttagtggttaattcaaagatggacttatggttccaagtaaggtcaatcagaaccaatgaaacaactctaggatttttgttgttgttgttgttgttcgtgattctaaaagagaaaacccattgcttcttgtttaagatggatgagaaagcacgtagttctgcagtatcctgatatccatcttagaacaattaagaggaattaaacggaacaaatactggggagcagagccatgcaatggagaaggaaaactagaatctggtcatgctatttaattcctgaatcaagcctcgtctatctttcaactgtttaatgacactgatcaatacattttgtctgagtaagtctaagctactttgaaatggattttccattactacaatgtacaagttctaacttatagagagagacaaactcttttgatgtaaacaaaggtctcctaggaattgtacaagaatcatgggaattgtacatgggaatagctttcaaatacaaaagtttaaaagaggactttgatcctgcttaaagtagctttaactagggtatctagataaatacactgaatgcttatatcaccttggaggagttcctacataaaaaatttccaaagcccatagaaccaaaacttaccaaaaatgttatggcatttagacaacattattctgtgagccttatgggtaggaagggatttttgccaccaatgtttacctctttctattcaatttctttatattatgaatacataaatgaaaatgacactcaaaaagagagacatctggggacaaaattatcccaggacattcacatatagggtggccacgcctggttacatccatggtttaaaataattctactctttttcccttttaagtagatctttgataacggaacacccactcaaatgtcatcatcacatataaagacttcccctgctctcatatgtgcagtcattttctctcaccgtggttctcccataacactttgttaagattttaaaacttgtactgtgtgctactatgatttacatttttacattttacatttctgtctctgactctagacagtgtccttgcctcaaaggcaaggacagaatctgtagaagatgctgtcagggcccatctatctgccgttggcactcatccttcaagtatatgccagcagtgtcctagtacaagcatttgccctactgcaaacctgagagattttcctcagcttgctaggtgcgctggccagaagtgctggaaagtttatgtaccaggaagcatttagccaatgatggataagagttggaatagttagccctggttccttgcctttacccccttgtggttgacaactttgaggcatgttttttgtttgtttgtttgtttactatctcccagagctccttcatcaggatcaaaccccagtggcccaaagcaataactagttccataactggcttaattattggcttctttcatttattatctcattgtcccactctcctactggtacttcctgggatcacattacaaccaaaccactttcaccattaatcattgtttaaaggtctgtttctgaaagaagctagcctaagttagtattttatccatttaaaaaaatccttctctggcaaagcggaagaagctagaaaataaaaataaagtaaaaagtaaaaattaaaaacatccttagtgcacaaactagtgtttggcatttggaataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttgtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctagggagacaccagctggcatggctaagggagtggttgcaccatacctcccctactcccagcagtgaagcttgcagcaacagaagtgactccttacttctcgttaaggagaagagagcgaaaagtaaagaagactttgtcttgcatcttggataccagctcagccacagtaggatggggcatgggcagagtcatgaggcccccattccaggccctagttcctggatagcatttctagacacaccctgggccaaaagggaatctgctaccttaaagggaaggactcagtcctatcaggattcatcagctactaactaaagaggccttgaacgttgaataaccagttgcaatacccagggagtacactgtgggacttggcctctgagatgtgctggcttcataggtcacccagcaaattcccagctgtggtggttatggtgaaagaccccttctgtttgagaaaagtagacagaaaagtaaaggggactttgtcttgccccttaggtaccagctcagccacagaaaggcagagaagcaggcaggcttctgggatttctgagtcctggcctaggttcttggacagcatttttggtcctgccttgggccagaggggagcccaaggccctaaaatatgggtcccagttctctcagcattcaccacaagctgatggaagagcccttgggctttaagtgaacaccagtggaggccaagcagaaccctcatggtggtgagggccacagggagaggatcctctgccttttaaaagggcaaggaagagcagggagcactttatattgtggtgtgagtgctagcttagccacaatagaatagaacatgaggtaaactgctaaggtttttgactccaatgactggccctcagacagcatctctggatatgcccggggcctaagatttccaccgaaaaatctgctgccagatgtattgaagctccactgcatgttatttgtttcctttctcttgctgcttttaggattctttctttatccttgacctgtgggagtttgattattgcatgccttgaggtagtctctgagataattctgcttggtgttctataactttgtcgtacttgaatgttggtatctttctctgtttctgaagttctctgatattgtccctttgtatcaactttctatccctatctctttctctacctcctgtttaaggccaataactcttagattgacccttttgaggctattttctggatcttgtaggcagacagcctatttgaaaatacacagccagagaagacaaaagaaaaaaataataagaaacaatgaagcatacctacaagatccagacacaaaaaacccttcaaaaaaatcaatgaatccaggagccagttttttgaaaagatcaacagaattgatagaccgctagtaagactaataaagaagaaaagagagaagaatcaaatagatgcaataaaaaatgataaaggggatatcaccaccgacaccacagaaatacaaactaccatcagagaatactataaacacctctacgcaaataaactagaaaatctagaagaaatggataaattcctgcacacatacaccttcccaagactaaaccaggaagaagttgaatccctgaatagaccaataacaggctctgaaattgaggcaataattaatagcctacaaaccaaaaaaagtccaggaccagacggattcacagccgaattctaccagaggtgcaaagaggaactggtatcattccttctaaaactattccaatcaatagaaaaagagggaatcctccctaactcattttatgaggccagcatcatcctgataccaaagcctggcagagacacaacaaaaaaagagaattttagacaaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaacgacaaaaaccacatggttatctcaatagatgcagaaaaggcccttgaccaaattcaacagcccttcatgctaaaaactctcgataaattaggtattgatgggacgtatctcaaaatagtaagagctatttatgacaaacccacagccaatatcatactgaatgggcaaaactggaagcattccctttgaaaactggcacaagacagggatgccctctctcaccactcctattcaacatagtgttggaagttctggccagggcgatcaggcaggaaaaagaaataaagggtattcaattaggaaaagaggaagtcaaattgtccctgtttgcagacgacatgattgtatatttagaaaaccccatcgtctcagcccaaaatctccttaagctgataagcaacttcagcaaagtctcaggatataaaatcaatgtgcaaaaatcacaagcattcttatacaccaataacagacaaacagagagccaaatcatgagtgaactctcattcacaattgcttcaaagagaataaaatacctacaaatacaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccacattgccaagacaatcctgagccaaaagaacaaagctggaggcatcacgctacctgacttcaaactatactacaaggctacggtaaccaaaacagcatggtactggtaccaaaacagagatatacaccaatggaacagaacagagctctcagaaataataccacacatctacaaccatctgatctttgacaaacctgacaaaaacaagaaatggggaaaggattccctatttaataaatggtgctgggaaaactggctagccatatgtagagagctgaaactggatcccttccttataccatatacaaaaattaattcaagatggattgaagacttaatgttagacctaaaaccataaaaaccctagaagaaaacctaggcaataccattcaggacgtaggcatgggcaaggacttcatgtctaaaacaccaaaagcaatggcaacaaaagccaaaacggacaaatgggatctaatgaaactaaagagcttctgcacagcaaaagaaactaccatcagagtgaacaggcagcctacagaatgggagaaaatttttgcaatctactcatctgacaaagggctaatatccagaatctacaaagaactcaaacaaacttacaagaaaaaacaaacaaccccatcaaaaagtgggcgaaggatatgaacagacacttctcaaaagaagacatttatgcagccaaaagacacatgaaaaaatgctcatcatcactggccatcagagaaacgcaaatcaaaaccacaatgagataccatctcacaccagttagaatggcaatcattaaaaagtcaggaaacaacaggtgctggagaggatgtggagaaataggaacactttacactgttagtgagactgtaaactagttcaaccattgtggaagtcagtgtggcgattcctcagggatctagaactagaaataccatttgacccagctatcccattactgggtatatacccaaaggattataaatcctgctgctgtaaagatacatgcacaggtatgtttattgctgcactattcacaatagcaaagacctggaaccaatccaaatgtccatcaatgatagactggattaagaaaatgtggcacatatacaccatggaatactatgcaaccataaaaaaggatgagttcacatcctttgtagggacatggatgaagctggaaatcatctttctcagcaaactatcacaaggacagaaaaccaaacaccgcatgttctcactcataggtgggaattgaacaatgagaacacctggacgcaggaaggggaacatcacacaccggggcctgtcgtggggtgaggggacgggggagggatagcattgggagatatacctaatgtaaatgacaagttaatgggtggagcataccaacacggcacatgtatagatatgtaacaaacctgcaagttgtgcacatgtaccctagaacttaaagtataattaaaaaaaaaagtaagttgtgatgttagaaacataaaatgtgggaggagggagagtcaaagtgttgagtatatgcacacaatcaaatttaagttattatcagcttataaaatgttttatgtaagcctcggagtatccacaaagcacaaacttataatacatacatgaatgataaaaacaaaagacccaaagtatactactacacaaaaccatcaaaacacaaaggaagacagcaatagaggaagaaaggaacaaagaatctgtaagacaaccaggaaacaatgaacaaaatgacactagtaagtccttacccatccatcattattttgaatgtaaatagattaaactctccaatcaaaaggcatagagtggttgagtggattaacgacaacaacaaaaaacaagacccaaatatgtgctgcctacaagtggctcatttcaccttaaaggacatgcatagactgaaagtaaagggatgaaaaaagatactccatgtacatgagaacaaaaagagagcagggtagttacacttacttcagacaaaataatctttaggtcaaatctgttcaaagtgacaaagaacatcattatatattgataaaggttatttcatcaagaggacataacaagtatataagcatcccaaatcagagcacctaaatatataaagcaaacattaagggatctgaagggaaacatagcctataacataataatagcaggcaatttcaatattccactttaagcaatagacagaaaaattcataagaaaacattggacttgaatgacattttagaccaaatggacctaacagacatatacagaacattgtgccctgaacagtaggaaaatacagattcttctcaagtacacatgtaacattctccaggatagatcatatgttaggccacagacaagtctcaacaaatttaagaaaacccatcgtgtatcttttctgaccacaatataaaattagaaatcaattacatgagaaatcatataaaattaagaaatatgtggaaactaaacaatatgctcctaaacaattattgggtcaaaagaagaaattcaagaggaaattttttaaaagtcttgagacaaacagaaatgaaaacacaacatagaaaaacttctgggggtagcaaaagcagtgctaagagggaagtttatatcaataaattcctacatcaaaaaagaagaaatatctcaaatgaaatacctaacattatacctcaggaaactacaaaaagaagaatgaattaagcccaaagttagcagaaagaagaaaataacaaagatcagagcagaaataaatgaaatagagactagagaaacaatagaaaaaaagtcaataaaactaaaagttggttttttgaaaagctaaacacaattgacaaatccttagctagactaagaatgaagagagcaggctcaaataaatcaaatcagaaatcaaagagaagacattatgactgataacacagaaatacaaaggatcctaagagactacgatgaacaattatataccaagaaattggacatcctaacagaaatggatgaattcttagaaatacataatctaccaaaactgaataatgaaaattggaaatctgaaaagaccagtaacagctaaggaaagagttaaggagattgcatcagtatttaaaagttctcacatcaaaggaaagctcaagaccagatggcttcatgggagaattctacaaacatttaaagaagacctaacacaaatctttctcaaactcttttggaaaactaaagaggaagggattcgtccaaatttattttacaaggccagcaataccctgatcccaaagccaggcaaagacactacaaggaaagaaaactataggccaatatcacgaatgaaattagatgcaaaaattctcaatgaaatactagtgaaccatatttaatagtttattagaaggattattcaccatgaccaagagggatttatccctgggatagaaggttgtttcaatatatgcaaattaataaatgtgattcaacatataacagaatgaagtacaaaaaccgtatgatcattttaataaactcagaaagagcatttgacaaaattcaacatccttttatgagaaaaactcttagcaaattaggtatagaagaaatgttctccaaaagaataaaagccataaattacaagcccacagctaacatcatgcacaacagtaaaacgtagaaggcttttctctaagatcaggagcaagacaaagatgcccactctccccacccttgtttaacttagtactgggagtcctagccagagcaattaggcaggagaaagaaataaaaggcaaccaaactgaaaaggatgaagtaaaattgccccttcttgctgatgacataatcttatacagcaaatcctaaggactccactgaaaactgttagaattcatacacaagtttagtaaagttgcagggtacaaaatcaacttacaaaaatcagtagcgataacaattgttattgtttgtacaataacaacaaactgtctaaaatagaaattaaggaaacaatctcacttataatagcatgaaaaaatatttggagtgaatttaaccaagaaagtgaaagatctgcgtgttgaaactataagacactgacgaaagaaattgaagatgacacaaataaatggaaagatttctgtgttcataaattggaaaaattaatattgttaaacataaagcaatctaaagattcgacacaatactaacaaaatctgcatattgttctttatagaattttttttaaaaaatcctaaaatttgcatggaaccacaaaagaccctggatagccaaagctgtctttactaaaaagaataaaattggaagtatgtcactactggatttcaaaatgtattacaaagctataataatcaaaacagcatggcaagtacataaaaacagaccaatggaataagacaaagaggactaaaataaacctacacacctttgatcaattgatttttgacaaaggtagcaagaacacacaatagggagaggacagtctcttcaataaatggtattgggaaaactgaatgttcacatacagaataaaactggacccttatctcaccccttatacaagaatcaactcaaaatggattaaagccttaaatgtaatacctgaaactaaaaactacaaaaacataagagaagagctccatgacattggtctgggcagtggtttcttgcatatgacccccaaacacaatcaacacaaaaataggtaagtaagattgcatcaaactaaaaagctttgcacagcaaaggaaacaattaatggaataaagagacaacccacagattgggagaagatatttgcaaatcatacattagataaggtgctaatatccaaaatatacaaggaactcaagctactcaataacaagaaaacaaataaccctaataaaaaaatgggcaaatatatgaatagacattctcaaaagatgacaaacagcatatatatatatatatatatatatatatatatacacacacatatatgtataatactcaacatctctaatcatcaaaaaatgcaaattaaaatcacaatgagatatcacctcatatcttttggattggctattatcaaaaagttgaaagataacaagtgttcatgaggatacagagaataaggaaaccttatccactattggtagtattgtgaattagtaacggcctccataaagacagtatgaatgtttctcaaaataataaaaagagaatgaccatatgttccagaaatcccacttctgggtacatactcaaaagaaaaggagggagtgtattgaagagctatctgcactctcacattgttgtagcactgttcacaacaggcaagatttggaagcaagctaactgtccatcaacatgcgaatggatacagaaaatgtggctcatataaatgatgcggtactatttagcaataaaaaagaattatatcctgtcatttgcaacatcttggatggaactggaggtcattacattaaatgaaataagccagtcacagaacgaaaatcactgcatgttctcacttatttgtgggatctaaaaattaaaactattgaactcatggagacagaataaaaggatggttaccagaggctacaaagggtagtgtggaggtaggggataggtggggattgttagcggctacaaaaaatagttagaaagaatgagtaagacctagtatttgatagtgcaacagggggactatagtcaataataatttaattgtacattaaaaaataactaaaagtacaattacattgtttgtagcacaaaggataaatgcttgacaggatggatgcctcattctccatgatgtgcttgtttcacattacatgcctatatcaaaacacctcatgtaccccgtaaatatatatacctactatgtaccccaaaaaattaaaaataaaaaaaaaattttaaaaacctaggaaattctgtcatttggaataataaggatgagcctggaggacattaggttaagtgaaataaacttggcacagagagacacatatcatataatctcatttgtatgtgcagtttaaaaaaagttgaactcatagaaatggagagtattatggtggtgatcaaaagctgcagtggtgggtggatggaaaaatgagagacgtttatcaatgggtacaaagttccagttagacaggaggaataagttctggtgttcttttgcacagcacaggaactatagctaatattgtcatattgtatatttccaaatagctaaaaaggaggattttaaatattctcaccacaaaaatgagaagtatttgaggtgatagatatgctattagcctgatttgattattccacaatgtatatatatggattgaaacatcacaatgtaccccataatatagttgtcgactaaaaacgaaataaaatttttaaaatgaatattatttgagttgtaattccactcccaggtgtatatccaacagaaatgcatagttattaatatattcaccaaaaaccatgtactagactgttgatagcatggctatggattgcagaattgttgacagcaatttcctcatgttggaaactactcaatttctcatctatatcaacatgtgtaaatacactgtggtatcaatagaatattattcagtaagaaaagtgaacaatccacaactacatacaataatatggatgaatctcacaaacatattgttggggggaaaaatacagccacagacaagtagatatgactgttcgattccttcatataatacacaaaaacaggaaaaagtaatagaaaacttttgaagtaaggatagtagtcacccttgtgaaatgttcatgactggagaagacatgaagggggatcctgagcttctggctatattatattatgtttcttgatttggatgctatttacacagttgcattctatttatagaaattcactcttctgcatatggctagccagttctcccagcaccatttattaaatagggaatttgatttgtgaaatatattctacatacaactttggacaattcatcttttttaaaaaaggtgtcacgtgtgaaatatgtgtcattttggctgctgtgaataataaaagatgcaatcattctgctacaaacacaatacgattttgactgtacattgatgtgacaaagaacatttcagaaattcttattggacagtgaactggactagattcacagacacacatcagcacatacagacgaatcaagcagctattctgctatttaataaaagaaacaaagcagtacaattgattgttatagtagtcccaagagtagaccctgcagaaatatatacaaaagacaattttagaagttttaaatgtatttcattttgtcaaggaatgaaagcaaatctaaaatctgaagatcatcagagcgaagctgttatcctaaaagtggatcagtgtggtagtctgacatcatatagacctggtaattgtccataactgagcatcaatttatactacagaattttaccacacttgcgacacttcacccaggagactgacagatcaaaaacatattatggcaatgtatttggccactagagcccatattgttagatttacatttacaccaaattcatctgacatacaaaagtgaaataataataaagtatatgcacataaacccagacaatctgtgcatgtttgtaattgaagagctacccaatgtacacattttttttttctcacaaaggtccgtcatggaaagcttctcgactaatttgtgcagtaaatagatgttgggtaataaagggaaataaataaccaatgctaagactcaggatgacagactgagacccagcatgtgtcctgatttacgaacctccagaagtgtcaaattggaaactcagcaatcatgtcaagaaccacaatattgcagagaaagaaacagttcagttgattgaatacgaaccaatctttcacttcaagttttttagactagctatgtttaattatcgatatacattcttgactgatataaattcccacaacatctctcttagggaggaatgttatttatacacaagaaatgattaccttttgaatacacattgctacagaacaaagaacagttctgttgcaatttctgcactgactgtacagcacgagaattagaagtctgtgtaactgatttttagaaagcaactttgactagcagttagtcttgggttataaccctggattagcgatgaaatagtggatttaaatgggaaaagttgatttgccacgatctcagtttcctcaactcccaaactgaaataatgacaactgcagaaccacagaattattgtgaagataaaattcaataatgaataaaagcataaaggatcctactaaagcaaggtgctactgcttctctgtatagacaagactaaacaatgaattatagttatcaacaaacattcacgatctgctagggagtgcacactatggatctcactgatcccacagagtacgccagagttccaggtagaaaatgccaaggtgaaaggcttaaattgcaggtaaatcttttgaggtcatttgagtgagtgaagagtgacggacatgactaactgtgggcaactctaaaggaaaaatgatcccaattgcagttaagacaaagatttctaaactatttgttgggatcaggaaaaagggagaaatagcagtagactgttctccgaggctaaaaccatcaaaaaatgttaggcatgatcaagaatgaagctgaaaacaaggaaaccaccattattgtaaccttgtacaaagctaggacacaactatacctagagtaatgtaagcataactcaatgtttgacatacaaagacatataaggaactgaggaaagtccaaataataacacagattataaggaatattaagatatgtcccttctacttccacaaggcatttaaacagggttctgtggaagacctatctatagttaagctttgcaaaagaagtttcaactcaaacccacaaagaggaagaaacatatatgctaaccatgtagctagtatgaacgggcattttttttcacttagatatagaaaaggaggaatgtggttgttttacaaatagagaataaagtatctgagatgtaacagatcaaaaagctaaaaacagaggggagttattggcacataaataaatcctggccactatgatgaccaagttgctttttctctaaatcccaaaaagctagaatgcagaaacagccaagcattttggttaagttcatggaagccagacccagaacaaatgactaaattttaaaattttataatattagcctaacatttaaggttagtttggaacatggaaaagatcaacagtttagtgctattttcacactgtttactcctctattatatggggataataacaagaaaattaataatctagaaagataaaaggaaataatgtacacaaggcactgagaaaagtacctgacccctagacagctctcaattataggggcgtaaataggcaatcgtgtactttggtaacactgttggacttttctggggcttcttaaatcctgagtcataaagcaaaggaggatagattggatgatccctggagatgttttcagctctaacagtttgtgaaatacgtttcttgatgcctctgtcagagctgaaagctcaccttacaaggtttttgtgaagaactcacccagcccagtgcctagatgaacaaatgacgtatcaatagccatactgttcccctggatggacctttggtaaatttcaacttggcaatcttatggtcatatattcagtcatgctacatgtcagttaaaggaaactcaagccaacctaaaaaatgttccctcctgtctgggccaaggctatttttttgtatcttaagagaggcatgtgtcacacaggtatacccattcatcaaaactcatttcataatacacatgagatttacacattctagtctatacaaattttgccacaaacaaacaaacaaaagaaatgtgaacaaatattgagctctggttaatgacatgcatgttgaagaacttaggggtaaagggaaccgatgtcaccaacttactttgaagggcatcagaaaataataggggttggcgggtagagaaagaagtaaagtgatacaacaaaatctagagagtgggttcatgagcactcactgtacaattctttcagctttctgtgtatttgaaaaattttaaaatagaatgttagataaaatgttctctcggctgggcacggtggctcacacctgtaatcccagcactttgggaggccgaggtgaacggatcatgagatcaggagcttaagatcaacctggccaagatggtgaaaccctgtctgtactaaaaatacaaaaattagccaggcgcagtggcaggcacctgtaatcccagctactcgggaggctgaggcaggagaatcgcttgaacccgggcggcagaggttgcagtgagccgagattgcgccactgcactccagcctaggcaacatagtgagactctgtctcaaaaaaaaaaaaaaattctctcacagaaaacacaaagcagtgtattatttaagcagttttctgaatcactaacaccactttccaatgaagaaaaaaataccatctgtgggatatggaagtttaaagatactaaacagaacttatacgagtggaaatggcaaaacgttttgctcaaagtcacaatgtgtatggagaggagttggaaatggaatttaggcaggtctcttaattttctaatcaacagactgtcaaagaccagattacctccttaaaagtatgctgaatattctaatagagaaaatgagttaaccttctaaagaaagctcattctcctgttttggtaataaaacatagggaagtatgtattgcttcccatacggaaagatgagctgggtgagaggaggattgggtttttaccactggttggaggataatagattatgaaaaaatatcaacatccagtcataatgaaacatgtaagttgttttattaattaaataggtgaatgctgaaatgtgatattatttgatcacattaaaatgaataatttttttaaaaacataatgacttctcttttgggggtgttggaaactattgcttaagatgaaagcctgaagttaggagaaaagcttgatgtatatctatgcaaaaatatttcagtttatcatcttaggtcacttacaagtcacagaaaagaaactatctagatgtgataataggcctaacatatcattagatgatccatcggtccagcatctcagtcattaactaattaagtgccaaatgtagcaaataaagtactaacaactcaaaagtgttcagcaagagttcattaaagcgaagctaaaggggaccattataattctagcaccacagatttattaccatgtcaccagcatgcaatgcacacaataaaactcattcatcactgtaaatttgcacatcaaatttgatgcatttgttggaatataaatatttttaaaatcatgtagaataaaaagcatttttttctcccttagcacacactgaatttcatatctacaccttgccacttcaacttttacttgatgagtgcagaaaacggaaattaaccccgaaaaacaaagtggcctcactcttatttttacaagcatactccaccatccaactattcaagttaagaaataaaaataaatggaaaacaatttcttgaacagaaactatggctaaaaagcacaattccatacattgcttactgacagaacttttctgtatttcaattcttccttacctccttctcttcagatttaggtgtccctcctacccatgcctaattccctcgctgtactcaatgttccagtctcttccatcttctatgagaagtgattccatcttttacccctcctatgtcttcaatctccgtctacaaccatgtttattttaagaagaaaacaaccaaaaccaaccaaacaaaagacaaaagagtattatttcctttggtcctacaccccacctgcgtcccctgatggaaaccctatgtcttcctcctttgtgggagagtggcttacaccagtgctacttaaaggatggtttgtgtatgagcagcatcagcatcacctgataacttgttagaaatgcagaatctcaggctccactctagagctaatgaatcaaaatctgcattttaaaataagatttttcaggtgattacattttgagaagcaatagtctatacccactatttccacatccacacctcacatacccttctaaaccattacgttttggcttttgccactgaaattacttttgtaggtgatagcagtgaccttaaagttgctacagtattagagagtctaaagtctttatgttttcagatatcccttcagtacctgccaattgacgaaccctctttgaaaccttctcttttgattaatatggaagattccttcttggattttattctgcctatttggccactcctcactctcttaggcccattccttaaatgttgctattccctaggggtctccctttgatctttttgttttcactttacatattctctctggtgagttcatgtatgtatattgcttcatttactatctctaaaataatcagagtaaaatctgtgttttaagctaagaattgtctcttgaactctgtatccatagagccaaacgcctactaaatctctatgaaatagccaacatatccaaactggattacatcatcttcattcttcctctcccctaatcactgatacacatctgttcctctacttagtcactgaaggagaaacatgcaaattatccttcattcttctttcttccttatactttaaccaagaagatgccgagtcacttctccttaatagctcttctggcctctatatcattcatctctctcttccctagattgctttagttaaaagcctcctgatggtctctctagttcagcggaacacaaccttgtctgtgcatttgaatcaagagggctgctttaaaaactacgaatgtctgggccctattaaggctctgatttaactggtttggggtggagtccaagtattggcattttttttaaactccccctagtgattctaacgtgcagccagggatgagaaccactgatttaatgttagccttttgcactccccatccttctttaaaactctagtcagagaagtcttttttttttttttttttaatagggagtctccctctgtcatccaggctgaagtgcagtggcaccatcttggctcactgccacctctgcctcttgggttcaagctattctcctgcctcagcctcctgagtagctgggattacaggcatgcaccaccatgcccagctatttttttgtatttttagtagagatggggtttcatcaagttgaccaggctggtcttgaactcctgacatcaagtggtccacccacctccagagaagtcttctgaagatgaaaatcttggtctttcatcacttattaaatttccttaatgtcatgcctcccaccccacactgctttcaggatagtattaaaactctttacctatcctacaagatcttttataacgtggcctttgtctacttttctagtttcttggcttctgctgcctgttgtgatgcctatactccagctttacagctacacaggaaggagccctaggtatgtacaatgttaccacacacctcacatttgtctaagtatttcacatgtatctcacatgtgtctatgctttctctctgcctacaatgctctctgccttttcagtttgcagcactctgctcaaaagtcactgccactagtcagttttgtcctgataattccctttcaccctatcaaagccttgtttacgtgccattccatgctaccttgtgagtttctcaagtcataaccaagaacttaagtactcatgtaagtgtccttcctacccatgcctaaactgtaaaagtgaaaatcatcacaaatatgcaatatataaacaaaataaacacatacatttagtcaatgctatgaaaattaagtatgtgatcaaatgttttgaagagtgaaaatggggcttttgtattaaggggaagatgaggaaatgaattgatgaagtgtagcctgaactgatttcttcaaatgcttctccagaaaagcaaaaagaggaataataaaaaaaaagatcaatgaattctggttcatttaacatacatactatattattaagacaaacacaggatcagtgaaaataaaatatattttagactaaaatgctggtagaaaaaccaaaaaggaaggagtatgaaagacataagttacccttcctaggctccattttcagatatttttgattgtttaaacttcagcaattcatgaatgttatagtaaatgatttgaaaaatggggagataaaagtaattctttcctcgttccaataatccccattcaagtaacaaaacagcttaatacaaaatatgtaaatttatttttaatttttttctgatgacttatcctaaaaatctacaaaatatgtaaatgaacttttaaaattagtataggaactcttacaatagtacagcagctccttaaatgcaatgcttgggtttatgggaaacaaaaaacactctgtcaattgctcccactgttttcatttacctcctggaaaatcataactatacatccagagaagaaagacctggagagagacaataccttggtgaaacatatggctacgaaatacaggaacagaatagtataatcaccttaattttaaagggaaattctcctgaaacagaattcccatagtaaaaggaaaaaaaattgaggaatttaaaataaggtaatccatgtgaacagtgctttgtaaactgcaaaactgtcagcaaataataaggtatgattgttattttctttaaaataagatacagaatagcattttgcctatactatttgcagccaagggaagatcctatccttttaaaacatataaaactaatgctttttaacccaaacaaaaagacacacatacgttgccagaacttggtctcaagcaagactatatttttctaagttctttaataaataaagagccatttggtcattcaatactgatttgtctttatatatttgttaattatttgttcctttatgtatgcattcatcacaaacttttttataatctcttatataactgagattgagttaggatgtatacaaaatcaaagctaaaaaagaagtaataaacattctgtaagtaaattacataattgagtattcacatgcctttggaatctatgctttcacgatagactccacttattgaatgcatcactaattaaaaggaaaaactaaaaaagaaaattttcatagctcccagtggccttgtgagttatggtaaagattttggtcttcaacctcagtgcaatgggaatccactgaaaggtttaaagcagggaagtgacaccgtctaatctgggcttgaaaacattagtcatgttgctaattggagagtagattggaggggagggcaaaaaagatgcagaaaaacagagtaagatgttagcataggagtccaggcacagcctgatggtgggtggtagatggaaagataagaaaagattagtaagatttagaagataaaatgtacaggactttgcccaagttcttccctctgcctagaatgcatcatctggtacatggcaggtgcttcatgaatgcttttgatgggaaatgaacagggttataaaaacctcacaattttttaaggggtcttaggagtcttggccctgccatacttttctctcttgcaggaaaaagatgaaactaatggactgtgaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaaaaaccaaagctgaaatagctaatatgagatgttcatgaaaatctccattcagggcgtcatcatcctaattggtttataacctgctgtgctgaatagttcttccactcatcctcattttgttttgttttttaacttaaaaatgaaaagttctaccaaatatcacatgttctcacttacttataagtgggagctaagcactgagcacacatggacataaatacgggaacaatagaccctggggactactagagggaggagggaggggagtgggttaaaaaaacgacctatcagttactatgctcactaacatggcgatgggatccgtactccaaacctcagcatcatgcaatactcccacgtgacaaatctgcacatgcaccttctgtatctaaaagttgaaattaaaaaaaagaaaacttctgtgttgtgaaaaggaaccaacaatgagagaaggatataggattttaaaacatagcttcaacaatgaccccagaaacctcagaggcctttatctaactgtctgactggagaaaattatctacaaggtaccacgtgtttgcaagctttcagttcaccttttaatagccacaatggaactatgaattaaggacactaagcccgaatctccctttaattctatgtggaaggaaaagtaaagaaataaacaatgattgaaaaaaaagacttacataaaagtagatggtaaaaataaaataaaggtcaagaaggtaataaataaatcatatttcctgaatgttgttctaaattgtgttcaaatttatatgttccagacagtagaaacaaaaagcaaatccttaatgatttataaatatgtaaaagcattccatcatttgtgttattactaaaaatagatgtttatatttcagctatcctgaaaaaattagaataatattaagtaggtatatttgcacattgcctttgaaacaccagagctctattttaaaaatgtacttaatttttttctaccctaaacttactgaatcagagtcttttggctcttgaactattgcatgcattctcaacagataatgacaccccaagggagtgaaaatttgttcttgagagataaaaattcttagctatttctgagtcacaatggtttattaccctctgaaagccacaatatacgggcagatctaaagcatgtctgtggtattaaaacacggatggatataaaaggaaaaaaatcaagttcacctcaatttcatgagtgataactgcaaaccactttgatgtatttccttccagttataatttcttttgctggttttctctgttttttacaaaattaggatcctatggcataaataattccatatcctactttttttcctgagcattaatgttgtaataattccctatatcattaaatactatttgaaactacttccattaaacattttaatattcagtggtaagtataaatcaatctataataaactttctccaaaaattaatgttttaatagtattagtattataaaatgcattttagattattaatcactttccagtgataaataaccaaattacaatcttaaatgatagacactaaagtgtttagtgaccaaatttcttactcagtttccatccctgttcaaacaatgccattttatcttctgctttctctctctgctttctttcttgctcttgctctctttcttttgagaagacttttgaaatcaaactttctagaatgtctgcatatgagctagattcctacttttgcagttctaaagagagtaaaatcggctgggcgtggtggctcacacctgtaatcccagctctttgggggaacaaggcagacagatcacttgaattcaggagttcaggaccagcctgaccaacatggtgaagtcccatctctactaaaaatacaaaaattagctgggcatggtggtacatgtctgtagtctcagctactcaggaggctgaggcaggagaatcactcgaaacaggaggtggaggttgcagtgagccgagattgagccactacactctagcctgggtgacagagtgagactctgactcaatcaatcaatcaatcaatcaatcgagtcaaatcaagaaaagagtgcagagtacaaagagtttgagactaagctctaagaactgggtctttaacgaagctgtaccttttattttcacttaattttcaattgattcctttgttgcattgtttatatggcaataatgcttgttcttacacataattaccattttaatttaatctagaaaaaataataatagaatgagaaagaagataaataaaaattttttctttatctgggtcaggaattggttgttattgtacagctctctctctctctctctctctctctgtctgtgtgtgtgtgtgtgtgtgtgtgtgtgtgtggtgtgtcagagagaaatatttgcgtttggggtccttatttcatttaagtttattatgctattttcaattaatagcaagttctttacatttttaaactatattttaagagtgcacatatttcttaagagttctaaatggcatatttctatttctatgtatacatatatgtttctattatatatgtctacttctatgtctatgcacttatctgtatctatctctatctctactttgatatctctttaagtctctctttttatgtacaagttcctagaggctctaagtcctaacattccagaaatttcaaagaaactagaaagaaagattttcttctgcaattacaataggataaaagagattgtggatagtaatagctatctgcaaaaataaactggctgagcctcagatagcctggggagcttgttataaatacagattcccaaggccttcttatatccctattatgtcagaatttcttatgttggaagcaagatgtccgggaatggccagtaatactagaaatctttgtgggaaatgtcgttttgaaagggttttggggatgaagtaacccagatgaatctgggggtaacaggtagcaatgtcattaacataaagctaccaactattaacttatactaacatatctgagttttatattgttctgtgacagataataggagagtgaaggtaaagctgtatatctgtatatggtggtggttgggggaaaacctcttgcagggaatctaaaaggaagccagggagcaaacatgtgctattatgttttttgtaccatctgagatgaattgtctgtttctctgtttctattaatatttttaaggtcatctagaatagtaaagatgggtagtttatgtagcttttctcacttaaggaagcatcctttcataatgctttattacccttctcccaattctatcactttgaacaataatctatcatttggtcttctggatagtcctcactggggaggacaccccgaacacattaccattattgattttcctgccagtcttgttgtaaaataatagtttgaattattatttcttctttcaaatggtttataaaccagtgccttgtgagtttgtgtagcatgaatcagtctcccagagcctgatcatctctaggtaaactactaaaatttagttgttggctatgcaaaactgaggattggacattaaatctacgacaactctgctatatgatatgaactctatcaatgacctctttatgcagtccttcctgaaatgatttatatcatcattttttaaaaataatcattaacctgaagaaagagtatattaagatattccaaatccatgagatacatagcactttttccttgattttacccatattctaaacattcaatattaacaggcattaagaatcaagaactctttgactattgataggtcatactcaatataaaatactgtttgattggctccagaccaaaaaaaaaaaggttttgtaaaattgtgcccttttcatgtctttataaagttcctagagtttatttctgttattctcaaaatgtttcctcaggagaatttagtaatatttagatccacttaaaacaatcactagttaagtacaaattagcttccaaaatcaatctgaaaacatgctgaaaacatacatctgctaaaagatggttttctcttttatgtaccccctcccatctaaaagttattaaggaagagtctgttgctatggaaacactcgatttgacaccatctgtattcaaaattcaattgctgcaagccttcagccaatctccggtttttaattggcaagaccttcccagtatgctctacaaatctttttttttattttttatttttaggaagtcaatctatacagcatattgcaatgtaaagcatcaagaaagttcacaatgcaagcctcattccattatcttaaaatcagacttgtgaagtttcaaagcattacagccttctgataattacttggcatgaggttaatgcctaaaatttattgccaagtttttttttttgcctattggatttcacacgtaaagaaaatactcattgtaagagtgactttagtattaggaagaccctgaaaaagagccttagtgaggaacttatatcacaatacacagtttagaatggaaaacaaatatagaaatcagagttaagaatgcaattttggaatagtcagactgaagttcaatattatttggaatacttgttagctactttatgtaacctttctacatcttcttttcctcatctgtaagagatctattatgaggattttaaagtacgcattttggggactacacatacttatacatatatagtatatacatatactataacggcatttgaaaatctgttaatccacatggtcttgaagcatatttctccagaatatcaagtatctgtatataagtgttgctaaaattcatagaagagaggattacaaaaaactggaattctctgaataattatttttaaataagggaaggatatgactggatattaaagaaatgtaaatatgcttctggcaggaaaatgccaaaaaaatgtatgcacagttgtgggtccaatcacgacattttgatgggatagagaagtaattcgccacaattgagcactgctgtggtttcttgggaggctctgtcaacctactaagttatagttatcctatgggaacagaccccatagctaaagataattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtatcctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacatatatgatttcttcctcaattagaagaggatggaagtggacaggtcctttactacctggggtagtgggcatggtgggcttcctctttctgtcttgctagtcttctctaccattcaccagctgctatttctcaccctaacaagggttaatgggagtggaagaagaagaaggggtgcagaaaattcttacttcactcagtactgtcactgttagagtgtgactttgtgctttctaatgtcaaatatcacttctggggtttcacggagctgaaatgtatttctcccagttttaagatccagcctctgatctacttcttctatgatatgttccacaattacttcagtagacagtcagtcaacacaaactcatctgaacctactttgtgccaaacactgatctaggttctggaaaatctatgatgaaacaagacacagtccctgctctcatgcagccaaatatttttctcctttgtactttcatttttctttgcttgtacctctaatttatgctttatatccaagttattgttggtacacatttgtctttccctagattatcaacttctttagaaaatgattaacattttactcacttttataaatcccttttccaatggtcactaaagtattattaaatgaagtaatgaacaatgaataaacggatggatgtacagagcgataaatggataaatgaacaaaattataccttcatacattgttcataaaatattgtttatattactcctatgacacatatatcctatctaatattatactaattttactttttctacctaataataaacactgtaatgaaagaggctgtatcatggtttccttggaacaccacataattcctagccccaataccttgcacactgtaagcacataatcaacatttgatgaatgtgtgaatatacttttcagtattttaaacttatatttttccttcacataatttaaatactaatgcaaattattaagtataaaaattagggcaagttgcaaatataattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagataaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaatacttttttgtctgaactagacaactgtatacatatgccaagtattttagaggatgaaattttcaattggaaatctgactcctatactcatgatgaagactgttacataatttctatgtcaaaaacatatttaaagtttacctgttttgaatggccatatagcttgttgacgtatatatttagaatcaggacacaaaaataatgaaatgatacaattaaatcaaaatgtaaacaaaatattatcaatattattaaattaaggaactccgaagtgccctatcgtagattttggtacttactgatgcaaagtattatggacagcctggttaagtcctaaaatttgtaaaattcgttacctacttaatgaagtgtaaagtcaatgaatgtgctgctttagtgatcacaacacattctgttagttgccacatgttgatatttattctacttctcctagggacaacaggttacttagtcaaacactttatatgtaacaggttacttagtcatacactttgtttatataatgcaaattctcattcccattttgtcttaagttataacataacattttaatgagttctctgtaccctctcaaaaaacatcatggtaataagaaaaagaaagttttattaaaaaaccctaatccaaattcctgctttcaagattgggggttggtggggggggagctgcgaaactgaacttcttaagattaagagctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattccagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaacttgccctcccatctccgtatctctagctgaaccaccagttctcccacttttcctactcgaatggtgtttattttttaaaaacatgtgttagcggccaggagccgtggctcacgcctgtaatcccagcactttgggaggccgaggcgggtggatcacctgaggttgggagctcgagaccagcctgaccaacatggagaaactctgtctctactaaaaatacaaaattagccgggcatggtggcacgtgtctgtaatcccagctactcagatggctgaggcaggagaatcgcttgaacccaggaggcggaggttgctgtgagccaagatcgcaccattgcactccagcctgggcaacaagagcaaaactccatctcaacaaaacaaaacaaaacaaaacaaaacaaacaaaaacaaaacatatgttagccttttatctttctaaaacgggctaaacattattttgcttaaaggcatagaaattaatgcctctgagaaattttaagtcccatgagtcaataaatacccaatatgtttgaacttaattgaaataaactatcacaaattgatagtttatatatcagtcgtatatataaaattgacatataagcatgtactttataactatctacatgcatgagtatataagaatacacacacacacacacacacacacacacacatatatatatatatatacacatatatttaaactttcaataactgactccaaatgtagcctcctttcagcataggtttggggaaagaatacccatctaacacctatttttagaatcagaggagttggattaaatcctggttccgctatctgtgtgatcttatgcaaaatattaatatctttgatagttggttctctcatttacttaataaggacaatatctaccatagggactgttgtgaaaataaaatccacttatatatgtataagagttcctcatccaattcgtataaagcacagcacaaatctaaagtattactcttttatgagatactttaaaatctgaataaagttagattttatttgtcccataaagaagtgaaaattttgacagtttcaaattgtctgaaatgtttcatattctggagttccctggaacatgtttttagttaccaaaataccaagctactgaagggaaacgtgggcattttggttgccctgccagacattaagaaaaaaatgaatcccattctatttattgctatgtctcttaaagtacgtttggcatggtacccaacattgagagacacataacctgctgtcctaaaactctgagcaatttacaaattcttgtaatcatagaaagaattccccattttacatcccaaaaggactgtgccttctcctcttagtggctcctacaagggattagactaaaccaaatccttcatgaggaacaggtaaagtgccattgctttaaaatgccaacgtgagcctatatattcctgtgctgttcatattaccttatcgttctgcacaattacacttgatgttcacattttcaggttgactgggttttatcacttcatggcacacttttctgtttaattacagagaaaggtgttttcccctcattcttattctgtgcatttgagacttgattttatcttttcaaacattctgttgtttgaacagacaattttctgataacaagtgaatcaaggactccctgcctttcctttcctcgaccagttctacgtttttctgagagccagctgtggcccagggcaacagttccatggttcctgtatgaaagagaaaaatctgactccaattgtcaggcttattgtatctaccactgccttgtatcctttgtaggggacccccaatggctttactcctatgacccagggttagacttagagatggtaataagccaaaccatgcagtaattggaaacactgaaaatagaaaattctgtatacattttgctttatcttaatattgaaagaaaatatcagagcatttcatttattcattcagagaatcttgatggaaaacctatttttttcaaggccctcgactggaatttaagagaagcaacactgtcaggaaagacaaatttctcgagcaagttctaaaaattctgtgcatagacattagaacagttaccaatattcgtgcacccattttctagatgtgaaaatttttttactcttatagctagcagggcactatcattgtcaacccttgagaaggcctagtggaactctcaataatgaggatagttgattgttatggactgaatgctggcatcccccccgccggctaaaatttgtatgttgaagtgctaacccccaatggatatttggaggtggggcctttgagaaataataagggttagatgaggtcataggttgaggcctccataattggattagtgtccttttaagaagagcaagaagagagactagagtacctctctgcaccacctctctccccaacatacgaggatacagcaagaagaaggttctcaccaggaaccacatctgtcagcaccatgatcttgtacttctcaacctccagaaccgtgaaaaacaactgcctgttgtttaagccacccagtctatggcattattttatagcagcctgagcttactaagacattaatatttgtatagtgagtagccatttgaaaaggacttttccatgcgtcatttcattgaatcctaacaccaaactagtatggaagttatcaggatcccagttttacagatgagaaaattaactgttggagagattaaataatttgccatgggtcccactgtcactaagggggcagagccagtgcttggaccaagtgctcttattttagattcagtgctgttactactatattactaaagaaataaaggccaaagaatctccaggataaaggtagaacctgtcaaacggataaaccaacatcagcaaccatttgtttcctgacttctagttttatatgagaaaaaagctcctgtttgttttagccactgaagtaatatagtttattaccttcaactaacaagagtcctaatggttacccctcagtccagtctttttgtgtaatcaggtagatagtatagctttcctctaatccagaaatcaagaatggggattaaggaaattaaggaatgaaattaaagaaggacattcttatgtatttatctcactaacataaaagtaataatcgcaattgctttcatcaccattgttataattatctcataaccaactattagcttcctaggtctttttgttaggcctccaaaattcaaaagctttctttacaatacccatattttccatgtggagccaggctgagtggacctgagataattatcatcatgtcccggagctataaagttttggtgggttcttgtttctttcaagaaacaaaaacacatgttattctgcacgtgtttcctgtacacatgtaggataaaggacatgtacaagtagtctgcaacttttagggcaaagagtatgattgacatttgtgggagtgtctaatggggatattcaaagcaacatgggatcatgtttcagaaaactcagggcaaaactcataggttgcttgtcctggggtaagccagccaccacatcataagaacactcaagtagtcccatggaggaactcgtttagagggaaaccaactagacagcaccaactcacaagctatacaagtaactcactgtgaaagtgaatccttcagccccagtcaagccatcatatgactgcagcctaattgacatctgagtgcaacatcatgagtgatcgtgagacagaacccctcaaccaagcaatgcatgaatcctgacctacagaacctatgagtgataataaatgattattgctactttaggacactaagtttggggtgattgttttacagtaacaggtaactattcaaactctttcctgacaaaagtagaacaagctcggctttccccttttcatgtagaaaggtcacaatctattaatccttcctacttactttataaatgttttacttaagacaagtacaacagaataaagacaggtggcaagcaattttcaaatcatgtataagtaaattttggtaaagaaagaagtagtaggtacaaaataataatccctacaattttctataacttgagagctgagagcattttttaggaacagtccatggcacgtgtttaacccttggcttagttttatctaaaatgcatgatgccatcagggagtaatattcctatttatgcccacaggtaccaaaatataacagaaattcaagactttagttacaatgaccctgtaggtcataagataaaaatgctagcctataaacatgtagagtatctctttctgggctcatctctgtttgtatttgtcttattagctcactttgtctgagtataaaattctttaatatatttactcataatcatctttatcacaaaaaaggaagaaaaactattttctttaattggtttatttatttaatagttttgtttattatgtttaattttcaaggtggatgaataaaacatttgttaacccagatctttccccttaaaaagaaacataatgaagacaaaaacaattagtagaaaacactatttatgttcataattatggtacatcactttaataaaaaatatttttcctattataaactcacttgaaagatttataattaaatataatcgcaacaggtaatttggattttaaatcctattcaaatatgttttgatattaatcctcttaatttaaaaatgaaatacatttatgaaaaatggaaaacattcatttcatgataggtaattagtattaatttaacacaacgtataggaagaaaaaacatacttgttttttatatatcagtttttatatacaagttacaattactctgatagaactctgaaattcattaagatattaaagaccatttctattatttaacgtatatttccaggtaccttattaactaggtactactaaaaaaataaaagaaccacgagatttatatgtgaagaaacacatgacattatgaacctcatgatgatggctgatgatggtaaattttatgtgttaacttggctgggctatggttcccagttgtttggtcaaacaccaatctagatgttgctgtgaaggtattttttagatgtgattaacatttcaatcagcagactttgagtaaagcagattaccctccacaatgtgggtgggccttctccaatcaattttgaagtccttaagagaaaagactgaagtccccagaaaaggaaggaattctgctatcggattacctttggactcaagattgcaacatcaactcttcccttggtctccatcctgccaggcttttggattttacagatttttgacttttcagctcccacaatcatatgagttaatggcttaaaatcaatctctctctctctctctctctctctctctgtatgtgtgtatatatataatattattatatatattagtattattaccaatctctctctctctctcactctctctctctctctctctctctctctctctctatatatatatatatatatatatatatctcctaattattagatacaacagaagatagatggaaagagacagcagcattctaaactctaatgataatggtgaattgataatacaggtgaaatattggactgtgagttttcagatgatgaaaacctagataaatgttctcaggcccaaggactgattaatgcacaatatatttctaatgacagaaaggaaatatgatattttaatccacttaattattcaacaggaagaacttcaccacataatattagctgtaagaattttaacaatcctgttttgctaaaggatgtgtgacagatattatgtcatttatgatgtttgtgcaccaaaatttatttgatacaaaaagtaagttgtatttcttttttattatttatttatttatttatttacgatggagtttcactcttgttgcccaggttagagtgcaatggcgtgatctcggctcagtgcaacctccgcctcccgggttcaagcaattctcctgcctcagcctcccgagtagctgggattacaggtgcccgccaccatgcctggctaatttttttgtatttttagtagagatggggcttcaccatgttagccaggctggtttcgaactcctgacctcaggtgatccatcgcttcagcctcccaaagtgctggaattacaggagtgagccactgtgcccagcctgtatttcaattcttattaaaatttctcataagattgtctttcactatctctttatacttccataagaatttgtagagtaacttagacatatacaaaataaaaagctaaagggttcattagacctacaaggcaaacagtaatggctaatttccctggtatactgagggctgcatcagaaacctggtctacctaaacacaacaatctttaatcctcagctaaagagtttctatactttattcatggtatcattaagaaccaggatgaaacttatgttacttgaatggttgtacagcagcagaaaaaggaaaccatacagtgtagcatctataaattcattatttaggctgggcgcggtggctcaggtctgtaatcccagcactttgggaggccgaggcgggtggatcacctgaagtcaagagtttgagaccagcctggccaacatgacgaaaccccgtccctactaaaaatacaaaaaaattagctgggcatgatggtgggagcctgtaatgccagctactcggtaggctgaggcaagagaatagcttgaatctgggaggcggagttgcagtgagcaaagatggcaccactgcactccagcctgggcaatggagcaggactctgtctcaaaaaaaaaattattattcagtgtgtgtctaaatgcttctatattgtaagttggcagggttgggggttgtgtggggggtgggtggtgctacctcttctcaaattccttaaatgtaaaccaacttctaggctttttcctaggttcacttttctttgcaccaggtaccctctctctgtgcaagctcagacattccaggtaacttttgaattcttgtccaaaagtaacatcactcctgcaatctctatgttttcaaccatttctttaaaatctcagtatggtcatctagcttcatgttaagcacattactttgtctcccataatcaactccttatcctgagtttgtctctggttatgacattaatcttccaaagaattcaatctccaactcttagaggcaggccttctcttagattgacagttttatatatgcaatcaatgtcaaaatcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaactgccttgcctaaatatacttgtccaaatacccacatttgattgtgagctctttaaagacaaaggctgaatcttacttttttcctgtatcccctctaccatctctgatattagatagcacagagtaggcattcaaacgttcgctgaactgaactgaactctttggttgccagcggcatcctagtggatgtgaattttgagagctgcttgtagctataacaggttgacagcaggtgctagatgtcaaaagaaggaaatttatatggttgactccacttcttctaaaataagcaaccatctaatagacaatacctgagaggaagatactggctggcatttcattagcaacagagatttcatacaaatgtggagaacaacagagcctttttatttcgccatgaaggatttcatagatttggttgcagcaatgaatgatgggttgacaaagctgctataaaactgtcagttaattcaaaaatcgtgtgagagatgtttttttttattctcatacagaagaacattctccccttctatggccctgtataccagttctttatgcaatataatgtgaattccttttcttaaaatttataagctatcactaaatttctctaagaattctggactgggttgaaaaatccttagctgaaaaaataattccaaaataaacgactccctcttaaaacttggaattctgtttcagaagtccttcccttggtttagctaataaaaggccacattatacacccttcatattctcccatctccagttctctctgtaccaaatccatctcaccataacaatatgtaccatttaatgagcatctaatatgtgccacatatttactttagaaacaccaattattttactttcttaatcaccctaccagcataagtactattattagccccacatgacagatgagagaaccacagtttaggaaagagaattaacttggctaaggttacacagctaatagatcattggggtccactagtctgtacatctccaacacatgtaaaagacaatcctttgattagacactcaaatacacagaagtcaaaagtataaacaggagcagcaaaaatgtatatccagactataattacctgaggttagtcctaatattttaagttgtcagataaatataccttcctatttttctgactaaccagccttttccatttgatgtgcctcgggctttaaaatcatatagacgtgggcttgaattctacttcctcacttgtcatcttcctaagaccctagacaagttacgttagctctccgagtctcggttttctgtctctaaaatgggagtagtaattttatctacctattaaatttatagataataaaaattttgcagtatttcccacaaaaggctttcctgaatatttgtttaattctatttatagatcttattccatcttttccaagcaaccttctcctgtcggtcttttaaatctctccttttggggtggtggtggggggcgaaataactaaacagctaccaaaaagctcattaagtattttgcattaagccttcaaagcaccccaatagattataattaaaataacaaatgctaacattcattcagcttttactatggccctgatctaagggctctacattaattatttcatctaatcctcccaacccatgagatagttataagtgagcctattttacagagaaggaaactaagagcagatagtttactgagattagtcatttgctcaaggccacaaagctaacaagtggccagtctaggcagcctgccttttaaagtaatgcatgctattgctgtatagccccgaaatggtagtggtgggggttacggagggagaagctacagaaacaaggctcttaaatccaaatgttacaggaacgacattcaccaatattgtttgtgaaataaacagaatgataaaaggaagcagttttatctttccaaatcctcttcactgctatgcaaggtattatggtattatgccttgcagtattaacagacacgaacaagagtttcatgtaattcagacgcctccaaggaagaaaatttaaattcttctaatcttatctgcttttggtcccctgacccagcccttttgcagaagaaaatggccaggaatgattgacaaattcagacaccaaagagttaaagaaaaatgagcaattcgaatattagaaagagggagaatttttcatttgatctgatttagacaaaatttactctcttacctagattattactgcatgatttccatcaatataattacctgaatacaacagataccacggtaatagtttcatatagtaaaacatggtggtggcttgcacacccaattacttgaagtttaacatgaatatttctagtagacataaatagctttgtactgaacttttctcttgatagactgcaataactatgtatagattttcccaactgttcaaagttatgaaatgggatttaccagagaaagaaaaatgtttcaatatagtattacatacatatattaactattttttctttatttagctgatttctttttgagcatttctagaagtttcatggcaataaaaaggaagaccaaaatcatcaaatgagaaaatacaattttatgagcaagtattttatttctgtccttttcctgaaaaccaaatctttactaagaaaaattctattttgaacacgatcgaaaagtttatgagtattgaatttccatcccattttatagatttcaaagggagagataaactgaagtgtagcagggctgcaaatgacattgtttagataaacatatcttgtcagaattatcctggtaccatttagaggctccaggcatatttggaactaagattccagcttagactcttaataagcgctatgacacatctcgacagacacttgcttttaagaaaatgctttcttggaccatttggattacagcctttccactaggctgcaaatattcataaaggtattcattcctaaaagacaaaagcttagaaaagaagaactattcaaatcactgaatattggcagagagatacaaacttgccctccggtcattcaattttaatctctatcatgaaaaagtcaatgcaatatgaaaaaaaaatgcaggggataatggaaaatgttcagacaatgttgaacaaatactgtataatacattcatattgtcttcctcttagggaaaaaattgaagtgatttttcattagtaaaataacaaatgactctctgtatagtatgttcagatttgcataaacctcactgccaaatttccatatttctcaggcaagaaactgatcacttacctgtgtaatgggaattcagtctcatattgagtaaatcactcactaagattcactcttttgggtcagtgtgttgcaacttgttggagaaccctcaaggttccagtatggtggaggaatgctctgctaaatcaattgtatggctatcttaccaaatctgttcctcttcctaggctcaacagtgtacactatttccctaattccctcgcagttaggtgtgaccatgtgacaagatccatccaacagaatatgaacaaaattaacacacaccatttccaggcgtggctcatgacaaattttcatgagtaatactcattcttcatctgcccattaaatgcatatgagtcttatgctctggacacaaaagatggaaggagcttgggttcctgaatgacttcatagagggctgcttattttggactgcactaaaataagaagtaaatttctgctgtagtaagcctccaagatttgggagattacctgttatagtggctagtgttactgaaataatacattagcatacatccacattcattgtttaagcaacaataaagagttaaactttcaaaaccaagaacagcctattttaattagcaatcactacaactgaaagaagacatgtctttaggaagtgaatcaaaacatacataatttcagacaaaagaagtatttagtcttagtacaatgattaaggtcattaacaaaagcaacaaaacaagatgggaaatggtaaacatactagaaagagcgcagattttcaagtcagaaagagacatttacaaattccaagctctgttctttgcttgtttgtaaacgacgcagtctcgctctgtcgcccaggctggagtgcagtggcgcaatctcggctcactgcaagctccgcctcccgggttcacgccattctcctgcctcagcctcccaagtagctgggactacaggcgcccgccaccacgcccggctaatttttttttgtatttttagtagagacggggtttcaccgtgttagccaggatggtctcgatctcctgacctcgtgatccgcccgcctcggcctccccaagtgctgggattacaggcgtgagccaccgcgcccggccgagtaactgttcttggaacctgttttctcgtctataaaatggggattataaaatatagctcacaagattctgtaaagattttgtacacacacacagaaacacacagaaacacacacatgtgcacacaccatctaatgcttatgaggtactgaataaatactagctattatcaataagtacttacccaatatgtggaagtatgactaataatattttaaaatattaaccttttactctggttactctttcactttccccaacatattgacaactagtcatttccttagggaagggttaacatagcagaatataaattatgaagatatagactctcatggtttccgagtttgaaaagtctaagcctggtaaaagacaaaagatttcaaagagaaaaaaaaagatggctgaaaggttttcctccttcctgcactacaaaggattcttcgggttgtgggaaggaaaatgaggggatattgcagaggaagcaagaaaattcaataccagtgtgtgtccctggagggaaggaaggtagagagaagtgaagaaaccgagagagatctgagagaacctgaaagcagagctgacttggacctcatttctgaggagaatctctgagggaaaccgggtggcgagtttcccctactccttcgtctgtcactcttcctgaccccatggaaactcactgacacaacacacaatcactgcgaatcactctccccattaaatggataggagtgtatgtcagaagaaaagaatatgcacagcgtctagtcagatgggtcttaccaaagttcctgcccaccctactacggcataaggtacagtacgatgatttttgatattacaaaatgggggcatcaaagtagcggagagatatccagatctgaaagtcactgcacatgggaatgaaagatggcccaggaagaagccactgcctgcttggaccaacagccaaggatatgagggagagactggcatctccatggatgccagcccagatgacaactaaagaacaaatgttctgccacaaatgttctgccacactgtggtcaccacacccatcaatgcatgctttgcaactatataagccctgaattgatttaaaaatgtatttcttctattcaatggaattacattcatttattaaaaggtaacattatggactgaaaatctcagcacaattgttatcatttacaattatttcacattatttttataaatgtgagggggatatatgaacttaagtttttattgaaacttgtcatgcatcttgctttgtgtgtcccatgcttgttaaaaaacttacttcgatccgtaatgattgttctagcctcttgattgctggtcttgtttttcaaattttgggcagcggtaatgagttcttccaactggggacgcctctgttccaaatcctgcattgttgcctgtaagaacaaatatcccttagtatcagggttcttcagcgttgtgtattccttttacataatacaaagtaaagtacaattgtgagaccagccaaaacacttttagaaataaaaaagatgttactgtataagggtttatagaaaacaatttaacaggaaatatgtttcattcttagatatcaaaaatatttcaaatgaaaatcttgactatagattttcttcatttaaaggctcaaatggagacattccggagtacctcggattacttaaaccactgtctgaatgccttgagtaagaaatgttattctgaattacgacaatgtatttaaaagatagataactatttatacttataatatcattctgtgtgacgtcaaaattaaggtatatttattttaaaaacagaaaaagcacagaaccgatttaagagatattacttatttaacttcattgtacccctgagatttctcacctgtcaaatgaaaaggtgaagtagacgagctaaatcagcttttctcctaagctgcctgtccgtaagaatcaccaaacctttttgcctccctccagaactaatgaatatgtagtggaaagggctgcaaatcttgcattttaaataaattatctaattaacttttatgatttaggcaagtttggagagcatcagattacaggttagtattcctattcccctgtattataaatgactttaatatagcactattttaaataaaaatacaaatataataaagttaacaatttttaatttataggtagtaatgtaaatcattaagatattcttccctttcttcagtgtctattttctctgtcatcttagtctctctagatttaaggaccacaatctcagaggtatttatgaagaaatttatgaaaaaaaggcatctgactagctctggttctaaaactcagtaaattttattttaattggggaaaatacaagtaatatttactgttagtttataagcaatatgtgacagatgttttatctatattttctcatttttttcttataataaccacactagtaaacaagccagcaagtttgtataattttaaatatgatgttctaccacatgaggccaatgaagatgaagagatgaaagtggtagatagtaatgtatctgaaacttatatgaaacttagttatttactctgtactttgactcctgctgattttctaacgaattttggttttggaaaggccaaattttgatcattctgtagtgtttcttctgtgaagaggtagggagacaggctttgtgatttaaactcaattgcttttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcaggtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggcagtggacaaatatattcggtatagtgtgtaactcacatgaaaaatcgtgcttttcgatacttggaaatttttatataacaaagattatctttattgggttgttcttcttttaattcactctcacataaccagattttttttgcttctcagttttagatacattattcactgtttgctatacttttttccttcttttaagatttcaaagttcatttaagaagtatgttgtaaaagtaagttgatcaactttaatctgaaccttaccaggctctaaattaaacctgaccacaatgaacagcttttattgctgaaattagcaagcatgtcaacttagactcaaaacaagccattttcctctctaatgaacaaaataggtctcagggtattgtgaaacctgttctctagttgggtgattctctaattctgctgacagacacatgctttgtaagcacctgagaagattattaatgagatcctttgaagcagcctccttaaaaatctaaggaggttcacaactgcagtacaactatgcatttctaaaatatttcaaaacaaaatttcaactttttatcccactctatggtcaacacatacaaacattcatttcaacaaagaagctgtaaaatgataatgtatattgctatgggatttatcatacactaataggctctttacttagtggtcttttagtatagcagaatgggaattttctcctttgattccctttctagaaataaagagagggatttaatatggcatacgcttcagtattttttcattaagatattataaaaacagtggttaaaagaatttcttgctaataagaacacaagcatatggtgagagtaacgattatttttcatttggtttccttttaagggtattctatttatttgctactatactttctttgacttcaacttagttttataattccagaacttctcaaataaactgaccttcacctctattccttcgagccacccacagatgagaaaacaccttagatctaatcattactcaaactacttgcctccaaaatatccatctataaaattctgttctctgcccccaatctgctacccctaccagatgttactctcccaaacatgctgttcctagtattatcttcatcctcatatgacctctggtccttttctgtttcctcaacctagctttagtcataacaaacaagtagaatgctaattgtgcttatttatttctctgatatgatcccagatatttgtgacacaaataacttaaagcgaacaaaactaaaatcattacatgcttaccagtacctaagcatgataatggatcgtgtctacatggattctatcattctagaggaaacaaaacacaggagaaggaaggaatcaatgctatttctaaggagtcataagtcagctactgggctttactaaaaactgcttaccccttggagatgagaattcatcatggattccactagctgagcaaagatggaggaaaaaaaattcttcaaatacaaagtgaatcagaagtctttaatctcactaagtccccccagagttgagtgaagtggttataaatagcaaccctatgaaataggaagttaaacagtgaaatcatacatattataactagggcattttaggcttttagacaaaattacaattttttattgtattcattaaaatagaattccacctaaataatactcaaataaaaactctatatgttgagttgaatgcttagtatttacatgtctaagaaaagactttgaaaatcaaactggtcatatttttatatttttctataaaaatcaacaatctacatagcataaatgcccatgatgatttttcaaatgttcccattttcagtaaatgaatatgaattaagctgaaatgtaacaatgtagaactgatgctattttatttacaacttcaaaaaattaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgatattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctctgtgtgtatagatatataactgtatatgtaatgttttatatatatatattttttttctgaatcatttgagaataatttgcagatatcatgcccctttacccttaaatactttaggttttatttcttaatagcaaagacattctcttaaataacctcagctcagtttcaaagtcaggaaatttagcgtggctttagtaccataatcttatccatactctatattcagagtatgacaattaccccattaatgaactttatagctatatttttatttcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaacaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttctcctcacccaatgattgggtgtggtgggaatactaaggcagagagccttccttgggagacatgggacttctttgcctggctctgcctcaatgacttcccaacagctttgccaaaatttccttccactagaccgcacactgggatgcttctgcctagccttctctccctctctcttccttgcagagtcagaattgcatcttgatctaacatctcttgcaccttccttggcttcctccttcttttctttcacatagatatttccactaataaaatattgtcccattttatcctgtctgggtacatataacctcaggccctgactaatacactcacttttgtcctcctagaccctaaacctctcatcagctcttcagttccatgtaacgtgatggttccatgacactactacctgaatgtgtaactgtcaattattgaatattaattagtaacataggtttcttcatgcctcccatgggctggcctcttaagatgcaattcaagtaaatatgtatttttacatactacctctatttagaaatcactaaggtagggtgcatgaccattatttccaaggagcgcagaatttaactggaggaaaataagagtattcagatgtgttacatggtaatggtggagttccattcaacacatgcagctcaagaactgtaggaaactaaagcaagccaccaggaatccttaacagataacaaccactaggtttgctgcaagagatggcaaaaggaactttggggcaagttttcagatgacggaagacagaaagttaagattattccacctctctgagtgagaagtgccctaggtagacaaagacctcaaccaggaccagcttcttgaacgtataacttgtgcagttagttacacaaggatctgcattagaagggattcatacttggtttcatgctctactgttgccatcttgaaattcttaatttttttttaaccaagggccctgcgttttcatttttcactgggctctacagattacgtacctgattgtgacctcaaccctaaggttagtggagaataaaagttatgtatcttggctgaagcactggttaatcgttgatgggaagaacacatttaaacacaaattaaatgacgtcaatcaaatgcctcttgcttaattcctgagaatgcgtttcaaatttctggaaggagcagttatgaagctaaaaaatgtattttgggggaaatctggcctcaggaaaagctgaacaggacagttagaagtggttccaaggtgggactgtcatcactatcaatggttattggagaacaaaagtcactataggaaaaatgaagtagggaaacgacaaagaaagtggtgaatcatctgaggaagaaattggagataaaaaggagaacctgtggcttcagcaacaatgatggctgctgaaatctcaaatgacatttctaggtttagctaagtgttagctgtttccaaggctaggatagacttgggaaatacataagaaacaactaataatttgttttagaaacatttactaaactgcaactatttgccaagcactcagctagtacacatagacaaataaaacttgtcttcttttttcaaggaacttataatctagcaaacaaatactcataaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagtctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgatatacttacaaggtactcatgtcatagtataatataaggtagctatatgatagtatgatataatataggaatggataaagggacagggatatgaaacgagaatacaaaaggggaaattaactatttcattcaaggacagattatattctgaatcagtcatggttcttgcaataaatagttcattcaaagtgggatgaggaggctttcctcctcaaggcctgaaaggctaaggggagggtatagttagtagaatctgagaagtggctgcagggacaagacctcttgacaggagctggggctgtgagtaaaggaacctagccatccctcgactcactctcctctcatccattgatctgctgatgcctcccaacacaaggaccaagccaatagacaagcaagcccaatgctactgccatattggtcaacctcctagggtagaacaacaggttagagattggatctgcgaaagtatccagcaacagtataaaaaaaataataataatggcaacaactattgaaacaaatcagtgaaggaaatgaccacatatgggaattctcagcaaagacttcatatcaagtatggcactacagctgaactttggcagatttggctagagaatgagaagagcattataagggaaagacagacatgaacaaaggcatgaacgtaaaataaagcctcaaatgggctggttagagcctggaattctttacaaataatggcaaataagtttaggtagacatagtagaagcagtatatagttggctttttaaaaatcagtttgaggttttgaattttatcacaaggacaactgggaagcagcgaacttgcagaaaaaaactgaggctataggagcaaagctttcagtaatcctgtgcctccatagattttgttctttctggttgggataaatttctcaattcttggtccattcctagaaatacagttaacagatacccatacgtaaaaagtgttgattgaccaaatcactgactacaatgaagggaaacagtggtacaagaaacaagtaattagagacttgtggcagatcaagaatacatacaaatggcaaacaagcatatgaaaaggtgctcaacatcactgaatcattgataaccagagaaatgaaaatcaaaattacaatgacatattacctcactcccgttaaaatggcttatatccaaaagacaggcaataaccaatgttgacaagtatgtgaagaaaaaggaacccttgtatactgttggtggaaatgtaaattagcacaaccactatggagaaccgtttggaggttcctcaaaaaactaaaaatagagctaccatataatatagcattcccgctgctgggtatatacccaaaagaaaataaatcagtatattgaagagatatctgcactcccatgtttattgcagcgctattcacaatagccaagatttggaagcaacctaagtgtccatcagtagatgaatggacaaagaacatgtggtacctatgcacaatggaatactactcagccacaaaaaagaatgagattctgtcatctgcaacaacattgttggaaatggaggtcagtatgctaggtgaaataaatcagacacagaaagacaaacattgcatgttctcacttatttgtgggatttaaaattcaaaacaattgaactcatggacatagagagtagaaggatggttacctgaggatgggaagggtcgtggggaggtgggggtggtgtaggtatagttactgggtacaaaaaattagttagaaagaatgagtaagacctactatttgatagcacaacagggggactataaccaataatgatttaattgtacattttacattaattaaaagagtataattggattgtttggaacataaagaataaatgcttgaggggttgaataccccattttacatgatgtgcttactacacattgcatgcctgtatcaaaacatctcaagtaccaaataaatatatacacctgctaggtactcacaaaacttaaaaatataaaaataaaacaaaaagaaacaagtaattagaatcagaaatgtgtggaaattgctagaacacatgttccttttctaagcagtatttatcagtattataaaaatcactgatcatttggctagctttaaaaataaaaaatatgatagctgtttaagaaatcattattagctattcaaacttaaaaaacaataagacagtcagtgaaatttatttctctatttctttgtagtaatgtttcaatttgttgatattttggggagttaaaaaaactcttaagcctagcactgcatgttctcactcgtaagtgggaattgaacaatgagaacacatggacacagggaggggaacatcacacaccggggcctgtcaaggggtgaggggcaaggggacagagagcattaggacaaatacctaatgcattgggggcttaaaacctggatgttgggttgatgagtatagcaaaccaccatgatacatgtatacctaggtaacaaacctgcacgttctgcacatgtatcccagaacttaaagtaaaattaaaaaactaaaaaataaataaataaatataaaataaataaaataaaaaaagagcatagtaatctcaaaaaaaaaaaaaaaacctcttaagcctaccaaatttggtgacttctttgaaatggtaataatattaatctactattagtgtgttatttttaaaataaattatctccctgtgttgaaaaaaagattaagatggtcctttccaagctattataccacacggaacttaaaggattgatttacttgtcatttactaaaacccttaacatccaaaaatgaaaatgcctttcactttcacaagccagtaagtaaataatgtggtgtaaattgcggatcttgaaatacaatttcaaagtcaagaaaaaaaaagaattttatgctacaatttgttgataatgatttgcaaacgcatttctaaagtgatataaagggcgttgataattttagctattcaacgttagatcttttagttattctacattgttcacatttcttgaaactctattgttctataaatttggcatattaacaaaggataatcaagacaggtttaagaccagtttttatcatgtgcatcagattcgcaggcttttgatattatggcccagtaacataagtgatataattttttctcctacacacattttagaagaaagagagacatgaaacaatatataggactgccttggaatattgtgtgtttggttccagactgctgcaataaagtaaatatcacaataaaatgaggcacacgaatatttttggttccccagtgcattaaatgttatgtttacactctactatcatctgtcaagtgtgcaatagcattgtatctaaaaaatgtacataccttaatttgaaaatacattactcctaaaaaaaatggtaacaatcatctgagcctgcagggagtcataatctttttgctggtacaggctcttgcctcagtgaggatggctgctgattgatcagggtggcggttgctgaaggtcgggatggctgtagcaatttcttaaaataagacaacaacgaagtttgctgcatcgattggctctcctttatagccaatgatttctttgtagcatgtgatgctgtttgatagcattttactcagtagaacttctttcaaaatttgagtcaatcttctcaaaccctgatgctaatttatcaactaagtttatggaatattctaaatcctttgttgtcatttcaacaatgttcacagcatcatcaccaagagtagagtgcatctcatgaaaccacaatctttgctcatccataagcagcaactctggatccgctgaagttttaccttgagattacagctattcagtcacaccttctgactccacttctcattctggttctcatgctatttctaccacatctgcagtgacttcttctactgaagtcttggaccctcaaagtcattgatgagtgttggaattaactacttccaaactcctgataatgttgatattttgacctcctcccctcaatcatgaattttcttcatggcatctggaatggtgaggactttccgttttcagtttactttatccagatccatcagtggactcaccacaatatagcagctatacctttatgaaatgtatgatttaagtaataagacttgaaagttgaagtgacttcttgatccaaggactgcagaatggatgttgtgttagcaggtatgaaaataaaatcattctctttggacatattcctcagggctcttgggtgaccagggacattgtcaaagagcagtaatattttgaaagacacatttttttgagaagtaggtctcaacagagggctcaaaatgttcatcaaaccatgctgtaaagagatgtgcagtcatctagtctttgttgtttgatttacagagcataggcagactagatctagcataacctgaagggccctaggatttttggaatggtaaacgagcactggcttcaactgaaagtcaccagttgcattagcccctcacaagacagtcagcctgtcctttgaacttttgaagccaggcattgacttctctctagctatgaaagtcctagatggcatccttttccaatagaaggctgtttcgtctatattgaaaatgtgttgtttagtattgccacctttattaacttagatgttagtttgatcttctggatagtttgctgcagcttctccatcagcacttgttgctctgccttgcacttttatgttatagagagggcttattcattaaggctcatgaacatacttctgctagcttccaacttttctgctgcagcttcctcacctctctcggcattcacagaattgcagagaattagtcctttgctttagattagccttttgcttaagataatggtgtggctgttttgatcctctatccagaccactaagacattctccatattaaaaataaggccgttccactttcttattcctgtgttcaacagagtagcacttttaattttcttcaagaacgtttcctttgcattcacaacttggccaactggcacaagaggtctggctttcagcctgtcttggcttttgacatgccttcctcaccaatcttaatcatttctgacttttgatttaaagtgacaaacatgtgactcttttttttcccatgaacacttagaggacattgtagggttactgactggcataatttcaatattgttgtgtctcagggaatagggaggcccaaggagaggaagagagatgagggaatggctgatcagtggagtagccagaacacacaaaacattgattgattaagtttgccatcttatgaaaataagtaatgggaaaaggactctgtatttaagacatgatgctgggatggctggttagccatatgcagaagaatgcaactggaccccctccttacaccatatacaaaaattaactcaagatggaataaaggtttaaacattagatctcaaattataagaatcctataagaaagcctaggaaacaccactctggacatcagacttgggaaagaatttataactaagtcctcaaaagcaattataacaaaaccaaaaattgacaagtggaacttaattaaactaaagagctcttcacagtgaaagaatttatcaacagagtaaacagacagtctacagaataagagaatatatttgcaaactatgcatctgacaaaggtctaatattcagaatctatagggaacttaaacaattcaacaagtcaaaaacaaataaccccatcaaaaaaaatgggcaaaagacataaacagacactactcaaaagaagacatacaagtggccaacaaacatgaaaaaatgctccacatcactcaacatcagagaaatgcaaatcaaaaccacaacgagataccgtctcacaccattcatactggctattattaaaaagtcaaaaaaatgacagatgctgctgacgctgtagagaagagggaactctgatacactgttgctgggaatgcaaattagttcagccacagtgaaacagtttgaagatttctcaaaggacttaaaacacaactatcgttcaacctagtgatcccattactgggcatatagcccaaataaaacaaattgctttactaaaaaaccacatgtattctcatcctcatttcagcactattcacaatagcaaaggtatgaagtcagcctaggtgcccatcagtggcagactggagaaagaaaatacggtgcatatacaccatggaatactatgcagccataaaaaagaacaaaatcatgtcctttgcagcaacatggatgcagctggaggccattattctaagtgaattaatgcagaaacacaataccaaataccacgtgttctcatgtggagctaaacagtgcgttgtcatggacataatgatggcaacaatagaaacggaggactactagagtggggagggagggaaacaagggttgaaaaactaactatcggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgacctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatcacagatcataacaaatataataataataataatgtttgaaatattgagcaaattaccaaaacgtgacacagagacgtaaagcgagcacatgctgttggaaaaattgtgcccgacggacttgctcaatgcagccttgccacaaactttcaatttacaaaaagtgaaatatctgcaaagtgcaataaagtgaaacccaataaaacgagatacgcatgtacatatttggggattattactcctcaattttttcagtattaatttcttgttctaccttgaataacatcattttggaatccttcgaacttccacttatcaagacgaattctcttgtccctattcagaggaatctatacagcaaattgaatcataagtgtactaaaataccaaagcagaagataaattacaagacatgaatagtgaaatgtaactatttgagggcattatttgtaatagtttgcctggtacatactcctcctaattttgcatcctaaagatactatccaaagactgtagaaattccagatacaagaggctagagttgacaggtaattaagctttggtcaatcaaagagctagaaaatatttattgaaataattgtatgcataacacatcacagtagggaatgtgcctcatggatgacatgaaagagactctctagtgaaataattgaacttgtgatgaactttcaatgcagttggggaggtgaccttcaggccagcccatgcatgctcgcacacgcagttacccaataatagaagacaatatgtaaatgacaaacgtaatagtctacagaccacatatcctaccctaatgggattctgagagatgggattttatatgggaccaggttcagggaaggtgccatagaggaacagcaacatgaactgtaacttagaggatgaactcaattaataatgacctaatgggagaaggaatttcaggacaaggagtagctttaaaactaaagtgtagaagtcagaatacagcagagtggttgagaaagagtgggaagggcagctgtgtaattagttagcagaattacgatggctgtgatcaagttgagaagggaagctggggccagaatgtgagggctcagaacactagatgcccaaataaggacatcatgttgaaggccatgggaaatcatcagaggtttgagagcagaagaatgccacaataaaagtggcatgttagaaatattaacctcgtacaactgcatccaatgtcccttccaagaaagaaatggaaaattaaattgcagtaacccaagaaaagcctcttgtatctcctctttgattaaatgtcctgtcatgaaaacatgtaaaacatttctaatttaccttcatgcatctttttaagaagaatataataactccactgcacacaaggaacataaattcaaccccattgcttgtaaaaactgtcccaaagaattattaaacaaatttgctgattctacttgtaatattatattttactatataggggtaaaaagggattgtagtttcagtttagaaaaaaggtaaacattcagaatgttttgttaaattcttacattcctactctaaaggataaacagagactttcagagtgtgagaagaaattgagatctctctggaaatacaacttcaaggattattatcagtgataagaagtattaacatatgttatgatgtcacattttgtgaatataacttttcaatgcccttaatacgtattgctgcactagacctgatatttttctttgggaaataagtcttcaggtagtactcctatttctaggaaaggagtactggggtattgtgctcatctgttcaaaaataaaagtcaaagctaacaaaacatttgttaaaaatgcattcaaccttttcacgttttaaaaacattttgaagatattattcatttaagtactgaaacaaaaccatgctttttatttctaacggcagccatcaataaactgaggcaaagcaagagatgttaccattcgctgatactacctgtagatgggaagtgaagtgaagaaatgagtgattatctagaggcgattacactcatgaacacagttaatcagaataattcaagccccctaaccctcttctgctgtcttcacatggtagatgtgaaatttgaattatcaaaataattggcacagctgttcaattcatgtttcccatatagggatagaatcaggctcagtttattcagctataaagtggagataattacattcatataaaccactcttgtgtgattaaagcaatgaatctatttataagaattcaaataccttaggtagaaattagtcaaatatggctagtccaggtttctttacagtaacagcaattaagacatatgttatatagaatatatttaatccatgaggtttcagccttctgattttgccaaattctgagtgctacaaagtgaagatacatatggatggtgaacaaccatgtgttcaccttaaacaatgctatattaatggcttggaaatccttgtgagttttacaaataagtgtgaaacaggagtgcatgtgtgtatgtgtgcatgtgtctgtgagcactcacacagacaacatccgaatggagaagagaggtatgaataaatatatatcctaaatttgcatcaaaatggtgtaatggttacctttggacgtacatataaggggaaaaagtgcttaacaactaggtctcattcttcaaaataaacaacatcctttgtacattttctcagcagttgtctgggagatcaacattaatctatttcttctcagaacttatatgactgggaaaaagataaaaatctgcccttgattgggtgctatgtgtttaagctctggtttagctgtaaatcatttgtgaagatcatttcttggtaggtgagtggaattgctattatagagtgttaatatacttgcagtgaagtgttgctgggggtaggaggtgttagacattgatcaggagcttaagagatgagctatttatttttgctgttgtaagagcaaatttctataataaaacaatgattctgcttctctgtcaaaaaacaccattttatgacatgaaagctctcttcagtaaacaaagaacagactgttattggagaacgtaaaaattacaatagaatatatttccctataggagcacagtggcctttaactcagctggaacttacagtatgacagcttttaaaggaagggacatattctatggggaggattttagacatacttgtctattccctaggccgtactaattcttatcatataaaaatgggtctacattagcacatggtgccagtatatcacacacttgcactgcggcatgaaaggagcccagcttgagggggagaactgctttctgtggcatagttccaagcaaacacatggcacaaatgaagccgattctgaggaatatggaaactttatgtactgtttgatagggaaatgtgcacagcttctaaacggtgagcttctagttctgctccaagaacaagtacaatcaattcttaagtggtttctgtaatgttgtgttcctaaccgagctgtttacattatagggaagtgttaagtttaattttctgttttattaggcaggtttctcattatgaacaataatttcaataccttttaagtaatttaaaaataagcagtaatccctgcagaaaggctgcagtaccatttctctagtgattcctttttctgtgttttatttgtataaggtgagcaaaattgcttattctttgttgcctcagagactttagtggcatgaggctaggcagagacaaaaactgataatcataaataaatcaacactattgggtggttccaatatccagtatctcaatgttctctgccctttgtctctttctgctatattaatgatctgtcttaattttacaagttttctgtaagatagtagacagaataggtgttactgaggtgaaggcttcaatccaaactacaaaactaggtagcctagaggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagccagttaggatcaggatagcatttgtttgtttctttttttaattattttgagattttattattattattattattatactttaagttttagggtacatgtgcacaatgtgcaggttagttacatatgtatacatgtgccatgctggcacgctgcacccactaacccgtcatctagcattaggtatatctcccaatgccatccctcccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtaaatagtgcctcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttttggatggggttgtttgtttttttcttgtaaatttgttggagttcattgtagattctggatattagctctttgtcagataagcaggttgcgaaaattttctcccatgttgtaggttgcctgttcactctgatggtagtttcttttgctgtgcagaagctctttagtttagttagatcccatttgtcaattttggcttttgttgcccttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagtggtagatatgcggcgttacttctgagggctctgttctgttccattgatctatatgtctgttttggtaccagtaccatgctgttttggttactgtagccttgtactatagaagcattccctttgaaaactggcacaagacagggatgccctctctcaccactcctattcaacatagtgttggaagttctggccagggcaatcaggcaggagaaggaaataaagggtattcaattaggagaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacgacagacaaacagagagccaaatcatgagtgaactcccattcacaattgcttcaaagagaataaaatacctaggaatccaacttacaagcgatgtgaaggacctcttcaaggagaactacaaaccactgctcaaggaaataaaagaggacacaaacaaatggaagaacattccgtgctcatgggtaggaagaatcaatatcgtgtaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactaaaggatagcatttgaactcaggtctttctgactcctaagtctagccctgtccacatgtcataaggtctcttcccaagcaactctgcttcctattctaacacttattccttactttcctgcctctgtgactctggttctcatgccaccaaatccatcaacacttccttgcagtcctgtttctaaaatagaattcagtgggttaaacaaatcatgattttaaaaagcagaagggaaaactacacaattggcttgcttctcctcatctttctctaacttcatttccagctggacacttttccctttttgttctgctttattattatttcacacaaatacattcagatttgtcaccttttgttctaatgctggaaatacaaattcatatggctaaaacggagtggaccatgacattgcccccagaccccacttttattccttgtaattaagaaaaaataaaccttaataagaagcttgtattaaaattgtgcaaagttagtcattactaaatgttcatggctgtattagctgcctgtggctgttgtaacaaatgattacagacttaatggcttaaaacaacccaaatttattatcttacaattttggaggtccaaagtccaaaaaatgggtctcacaagctagaaacaatgtgttggcagagcttgcattccctctaagggatgtaggggaggattcttttccatgccttttccagcttttagagcctgcctgcatttcttggctcttggccctgtccttcatcttcaatgccagtagtgtagcatcttccaatctctcttttactctgcttgtatcatcacctccttctctcttaggaggactcttgtgattacattgggcgcactggggtaacccaggctatctctccgtgtcaagatttttaacttaaccacatctgttaatacaaagccttttgccatgtaaggtaacatattcacaggttcctgggattaggatatggacatctttggcgggggaggagtgggcattattaaacctttcacaatggttctgcatttacttagcatgagaagctgtttgtcacaatgtgacatactgacatacttcttcgggtgggttcggtactatgtgtcatcgacaagagttacagtatctcacaatctagaaagcacaggaggcaaaaaagcaaacaaaaaacaaccagtcataccaggctcctgtgtccttgtggcagacatggtttaaccaaaggcctccggaagtgggaaaggtgtattgttgggtctctttcaccctgtaaccaaaagaccatttgaattgaggtggaaactggagttcacaaaagcgttacattaaaaaaataataataaactgtgactccctgaggaaatcacagtgtttctgtttggtgacaagctgctcttcaggaatgaatcctataagaatttcagataaagctcttatcttttggggagtgaaggctgcaggaaaggctagggtattgccttctgggatgcagaaaaaccatcttccccttagctcagctttgttcattcaacttagttcttcccctccacacccactcataaacattaagccttcttcccagctgtcttcctctctctttttcatttttaaacttcatctactttttgaattcttttctctgcaacaactactactaaaatctgaaagcttcttctattgttaccatggagagggcaattttctcaacaagtaaaggaggtggtgcagagggagagggaagaactacatatgaaaattgaaagttagcctctgtgtcttttcaacaacatcaaattaaatcttttcacttccatacacaaaacaacaggaacacacagtgggtggcaaattcagcccagggatgtgaatgaatcagtaggctttgtgataatatgctgggggtgtgagggaggtggcgaggcagcccctcaatcctaaaacagaaaagtaatgaacaatgataactgatatagacaattactctgcagttgtttgaatatatgctgctttctatcattttcaggtaaatgaccttcagaatggcagtagatggatttctaagaaatcatgaaatacaaacatgtagacaaacaaagcaggcagaaggaagtaataagtttaaaaaatgaagtgctataagaactgagagagaaagattatcaatcctccctttttctttcttctattcttctctatacaagttatgaagtggaagaaaatacaaatataaaatcatctgatggtgaaacatcagtgagattttaattatatctagattttttaaatctcaaactaggaaaaatctgctgattcacaaacatgaaaatattttaaaagatcagagatatattaattctcatgttctaattctcctgacatgaaccatatatatgctttattctttctgatgattctgagaaaaatcaaattctgaatttttaaaatgatgatgttgcccaaattgtaataaatcaccatattttccaaagaaaaattctacacaattcctgtacataaattttgtgtggaaaggcttgtatcataagaataatcaaaggaaaagaactgcaaactagtagaagcataaatttaaaatgttgctgatgatgacatcgagtaaagatttgaagtgttaagtagcatgttaaccaactttttctatgatcctcttccccttctcaatacccactctagcttttaaaaacacaatgagattgttttctacagcacaatgatgaacatttcaggtgtataaaaaatataaagaaaagattacaagtgaagtctatggcatggctgtactaatccacacacacgtacgctcggcagtgtaaaagttacctcactgatttgcttgaattaacaatttaaaataaaattttatactgaattaatgtttatttttataaaatagcagtgttattagaaagatttctgacaagtagtgtacgattacaaatatcatctaccttggagttaccatgaaattaggagggtaaaaatagtaaataaagatcctattctagacatctggcctatatgcagacaaccaggcagcacaaactcaagagtccgcttgtaattgcttttgaattcagagaaaattaatggtaagttggttggtttacaacacacaattctcttatttgcaaagcaaaactgaaaaatacagatagatagccaggcagggaaaaagagagagagacagactgactcattaaaagagagagagagagacactgactctgatttataggatacttgcttatctattcctgttagaattttctgcttgccacttcacatagtatcaacaaaacgaatgtattacccccaaattacagactattaaataaagataaaaactaagatgattttcatgagaagtaaacaataagctttttacacagcacaaactgaggatttcattacacaaagttatgggaaaagctacatattgatatctttgttattgtgaatatctcagttattgtgaatctgtaaattccatgccctattacccccatacaagccagggagatgtactcgtataatagcatttcactcatgattgaattgacaccaaatggttgcctctttgcaatatatacaaagaaatttttagttgtgggctttgtgttttgttttgtagttagaccgctaaaaataatcaaatgtctgatatagttaagccataaagatgaaagaagtgtctcacttaaaatatttattaattacatatgtttttatatctataatatacttatattctgatgtgcaggaactcagttacttaagtcaggaattcacgtggggatagagttagaatttaatcagaaaggccagtctcctggggtgggttctaccagcatttgaactattttttatcacagtcaacactagaggccttgctaatgagcaaaatgaatattagaaatgagttttcacttatgagattagtgttacttaagatacatgctttggttaaaatatttgagagcaattcctcatctctagcttgctaggtataaaaatatagtaagttatggaacctgtattctttggaatggtgcccaagatttaatgcctaaactatgctttgtttccacattgaatccgaagattctagttgtctgatgccttctctaaggttaactgcatcctgcctctagattctggaatattctcatgtctcccttgattgaaccttttatacggagtatgacaacacctgagagtgagggtatgggagtgtagctaacctttacctattatactaaagttttgctgtggttatctaccaaaaataacctaatagttggccttgcataatagtgttgatctagggcaattcataacaccacgtaagccacaaattttaaaataacctccactataaggaagtgtaaccaactccttacattcaacaatacatttgactttattcttggagtatattattacatttttctttttatttcctcatggttatatttgttataaagcatggttttataactaggtcgttaaagatctttaaagattgtgttattttttgcatactattactatcatatgaataatttcacaatcttgccttgtctttcatcttgaggcacctattcacataattattttttcacagtccaaacaataaccaggccttgtaatttagttatgaaataaaaaggctggtatttacataatcgtcttatgagttatgcatgtgcaagaaatgttctgcatgtttgtgtgcgtgagagagacacagagagagagcgagagattgagagtaagcccgatcattattgaggggtgtaagaaattactttatggagatgcaaaaacctggggttcagatacgagactgcggtgagatcattgcctcccaccctctgggggctcatctgagctgccaaaatattctcctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttggtcaaagccaaacactgtatgtttaaataatgatggttgggcaacaatgctatgtctttaagcatttctttccatttttcaaaatctgctctttcttattcacaattatttctactatttaatattttaatgggaagagttggataaacctaaatgtgcagcattgggattcttttcatagtgatcacttaaagtttgttttgctttttttttttaccttatatcaagaaataatatataaccaatacataattatatgaaaacatcgatctttaaaatagcataaataacatcaacaatccttccctatgtgtatataaaatattcatagatatatatgtggtgtgtgtttctaaaagtaatatatgtgtgtttgggtatataataaatattgcaacaaaaacaatatcatgtagtacatactggtttgaaggtgctctcctcactatactccaatttacacaccacaatctatttcagcatcccactaaattttgggcaatttaattttttcctgctagtccctatttgaaataatgagcttatctgtagtgaaaagctgtaaatatgctgcctagattcccctttggaaatgaaggacttagttccccagctgctaggagtgctgctggtagacagccttcagctgtcagcccttgtcttagtctgggccgctatagctaaataccttagactgggtaatttataaacaacagaatttattgcttatagttctggaggctgggaattccaagatcaagacatcagcagattcattgtctggtgagggcccactcctgttaaatggcatcttcggtgtgtccttacatggtgggagggcaaggaagctttctggagccgcttttataagggcactgatcctgtttctgaaggcagagcccgcatgacctaatcacccccccaaacccccaccttctaataccatcaccttgagtgttaggtttcaacatacacattttggagggacaaaaacattcagaccatagcagcccccttatggaaattcccgtggctaaagagaatcatcttgctaaagttcgttgccttcctggagtagcccacatccagtgcatgacttgacacggggttataaagatccagtcccctttcttcgtttcctagcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgtttctctctctctctctctttttaaatttgtaccatcaattggaaaggggctttgagacactatactaccattgcccttttgattccctctcaaatttgaaagctttatttatgatgcaaaaatagccatcatgattaattggttttttcaagtgtctatcatttttcaccaaggataactgctatgattagcaagaagaacctccatacaaatctatttaatcatctaaaattcatatttgttttaaggatgactgttattttgactgataacgtaaaatactactatgatttcagcgcaaagttaaagtgtgaagaaaagtaatacagaggttggcataaccatcaaagggaatttcttaaagaatatagaacaaattcaactacagagtagagatttattatttactaagatcttaaaacatgctttttaaattctgataacgaaaatatgacatagagtttgctatcctagttttacagttgaacaaactgtaatagaatagatcctaaaatttgtgcaggttgtcaataacatacagggcaaggttttagatgcctgactttaaacaaagctcatgctatttctacaaatacaagaaaaccagaaaaaaatattcacatagtcttaaagcttctctatatttcaggagggggtgaagtaactgaattatattaacagtgttctttaccatgatacccaattcttgtcatgaataaaaggtgatgttcagagatgtcatcaaataattgacaaaaaaaaaaaaaaggataagaaaaaaggaatgaaataaggtagtgaccaaaccttccctttttatcagtgatcaaaatccttgcttttacatatttataaaatccattctatttctctggatgtgtaatgaaagaaaatgaatatgtatgttcatttctaatccatttgaaataacaaaagagatggcattctgagtccacattctctttccagattttaagttttataattacttacgtaacactatcaacgaataggacaatagaatacaaacaaaaagtgaatcctttttagaagacagtttgagtacaaactgctatatattatgtactactctttaaagctctcatgcagattttaataattaatcaatattctaaatataaattactatatgtaaagcagtaatctatttttataaataaaatgatttcgtagaatgctgtgttaaattctttccctcagacagttgctctagagaaggaatggctgcttggaccctggtaggtacatcatggtgagaggcacaaatgttatcctggtaacaacttcacaaattatagacatagtgcgaagagaaaagatttctaaaagattaatttggtaaaagcatatgtagagaaatcaagtgactcagagggacatacacatccaactaagataatgttctctcagctgtgctcctcaagatgctctacacaaatggtttccatggagaaatcactgagaaatactgagctaacaatactaacattcctaaaagacttttcagtgaccttactatggagatgtacatcatagattgctaggataggcaacgtctatgcatgtttttcagcttatttgaccttttcatgaggatcatgtatgaacacctgatgaacctggttttctgtaggacaattttggaaatgttgagatcttttatcaactagaaatgatagtatatttcctagtcaaaatattttttaaccactttattgatttcttaaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaatagactacgaatggccatgtaaatattggggtttgtgacaaaagataggaaagcctatctcaagaaggaaaaaaaagtgttacaagaaaggcaacattggtaaggaagaaaaacttgatctttaaaacatgttattctaaacagactatattacttgttttcttgtttgattatcattgctagaactggtaatgtttttattgctcagtgtatactttctcttgaactcagtgggtttatttgggtcttaataattcagaatataaaaactgatgacctaataccacgtatattgatgctaacggacatgtttagaatttgtcagactatgtaagctattatgaaagttactgctttctctttctccaacataaaaatattcagaggcagaaagatagacatgaataatagagttttttctccattttatttccttgatttctgaaacaaatttaaacagaactaagaagacaggaaaacaatcacatcatatttagctaagttaaaactgcttatgtccaaagaagaaaaatgtgcattattaagagtatcttggctagcatagccagctgcctatccgataccctttctttccttcttagctaaaaaaatccaaattctgttcagactagcaaggttttataactaagttaccaattttcacattttgaattatgaagaaagaaacacacctattcagttaaaacactcaatcctcccaagatccttagaagttaggaatggtcacgtgacacatttctggttaatgcactgttcaagtagaaactcttctgtgtggggctgccagaaaagcactggttttccttacaaacaggagctgacacagctggaatatgcttttactttccccattttcccttcttccattttaaagtacagacatagtgcctggaggcagagtagccatgttgagaccacaggaaaaaaagtcttgctgggcacggtggctcacgcctgtaatcccaccactttgggaggctgaggcaggcagatcatgaggtcaggagatcgagaccatcctggccaacatggtgaaaccccgtctctactaaaaatacaaaaattagctgggcgtggtggtgcgttcccgtaatcccagctactcaggaggctgaggcaggagaatcccttgaaccagggagtcagaggttgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacaggaaatttaaatttatttcgaggaccagaaaataacaatctaaaaagtcaaatgacaacatacatttgaaaagaaaagttcaagacaacagaagcagctttacaagaaaatatatagttaaaggacaaaatgattttggactgaatcattgatgaaaaagaccaatacatattggcagccgggcacggtggctcacgcctgtaatccccgcactttgggaggccaaggcaggtggatcatgaggtcaggtatttgagaccagcctggccaccatagtgaaaccccatctctactaaaaataaaaaaaattagccgggtgtggtggtgagtgcctgtaatcccagctactcaggaggctgaagcaggagaatcgcttgaacctaggtggcggaggttgcagtgagccgagatcgtgccactgcactccagcccgggcaacagtgcgagactccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattatatatagcttcttgcctgcttgcattctttccaactactgatctttgcccccagtaaatgtcctcttctagtgcctaacatctattacataacttaaaaaaatcaaacttgagtaagtgtggtaaagtggcaggctaatttttatgtagaatttctcagaggggacttctgattctatctgtggaagcatttcattactttcgtataatataacatgacagaaagcttagcctcaatgaagttgctacaggttattttccctctcactacaatctacttctttcacatttagggaaaaaatatgggattaagagtaaattactctctccaaattactctctcctctccactttcttaagtatagaatcaactcaatttatctatatgcttttggcaaaaatcgtcttcatggatttaattttttttaatttctagtttgagtgttcaaaaataattctggagttgaacatagattaacttgatatgggggaggggttacattggtcattacagtttattttgcttccataattgaagagagaagatgacagttaaatcaaagcatttctgttcttgaaataaataatacagtatatattcttttcttgaataaatcataggagatatataattcttaaatattatgtcacttgtttacacagaatataaaatataaaggtaagggaactgaaagcatttgtgaattactaaaattgtattcaaagttatttttataaatcgaataagaaattgactcaaatcattttagaaaccgtggcattatttttaatgaattctttaaaaatcataaaagcacaatcaaatcctgttgctttttttttttcaaaaacaatgcagccattactaccttggaaattactgatcaattcatttatgaaatttaaaaacattaaaacatatgcaaaaatcaactttcactcccaagttattgaataaaaatcaacaagatccctggaaagataaacatagcttaattttcatctatatgaaaaaggcaggcacatatttagaataagaaatcacaattgatcagttgatttattcattctaatacatatatgattgaaaccaccataacacttttttcttttgtggccatgactgccctatcttttatgtttttcttatagaggatacactctaaaattagggcctatccctttttaatttttgttccctaagagcagataacactgatgcctttcaccagcaagtgttcaataaataacagatgaatgtaaactcagtattgtatcaaaagctcttaaaagacagtcaatatatttctaaagaatctttatgacactgtaactcgaggtatcaaaagtaagcacttgaaggaggaaagaaaatactagtagtatttaattacagactattaaaatatctacttaatgtatacgttaattttatataatatgtatcactttaacataagtaaccatatacataaaagtgtggatacaggtacagaaacacttttactaatagtgatgtgtgatcactgcctcatcttattcacacttattcactatcatacacaaggaaatcaaatttaaatccaaattattactctagtgtctctttctattctcctttcttaatagtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgcccggctaattttgtatttttagtagagacggggtttctccatgttggtcaggctggtctcaaactcctgacctcaggtgatacacccgcctcagcctcccaaagtgctgggattacaggcgtgagctaccatgcccggcccagaattctctatttaaacacaatggcaaacataaacttccttatcagaatcccactggtattttatggaaaacacagtacagtgacttccatcagaattcatgtaaatatcctggatcagttttgcttgataagattttgacagaaaagtttacagtgaattgaattaaaatataataagatacacatttccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattaggtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatttgatgcccatggaaataaaccatgtttgctttgttttgttataatttggatggagaaatgagatgtgtaagaagttgaggggggtggctgaggaaatagaaaagaagtaagaaacattatctattcccaagaggtctgggggtctgggtttatgttaggacaattacatttactaagtgactttagatcaattaactaaattgtctataacttctctcatttgttgaataagggaaactattgtaatagccactttctgctgggtttgtgacaacagaataaaaccaagaaacattctgttttgtattgcttttagtttaaatagccaatgccactttacccacacattgtcccatcaattcttccagggctatactacacaagttgtttagtaatcagattttgactgaatctattcaccaaaagttataatcagaattattctgtagctaattcaaatgctttttgtgtatagacagagttttaaaaaatcataatttttaagtactttgaccttaacaacaacaacaaaaattaaactcattcaagtaattatgtcccatttaaatatacactatacccactaaaactgctcattcaatttttagataatgaaatctcccaggtaacagtgcaatgtgtggttaaaaattaatcttgaacaatgctattatcatcttgtccagattggccaatttgtctcaaccccaatctggaaaggtcttactggaggataaaatgcctttgccaactcaattctttattcaatacaagtgcagtggttgagattttgtggtgaattatcctgaacacctggccaaacggaattgaaaaaaaagactacaattaactcagcacaggcaatcagacaccagtattatgaaaaataatatcatatggccatctaaattctatttgttgatagcaacactagtctccactgctgggaacctctcttcatatttccccctccacctttctccctcctgtctcccaccatccctcttccatttcctcctttcctcactcctcttttgtcctctttaatattcctttcttgtctttttttctttccttgctacctttcttttgtcttttctctctccttcccctttttcctgctttccttcctctcttccttctttttttccctttcctcctccttccttccctttctttcctcccttctttgttctctccttcctttccttaagggtcagatttagtaatcactctcaaagcaaaacccaggacatatttttcccttcatttgatagattatgtcaaaaaagaaaactgctaattcttgtcaaatattgttgtttcagagcaattttacttatgtttatgtgatgaaacagaaaaagcattttttaatcagatttctccgacactaagctataaagtacaaatcatccactgctattgattcacaattctagaaattaaactttgaacttcatgtgtgctttacttctaaaggcttaatttgcatatttcacatctctattcttctaaaagataatggtatattttctactgtctaaaatgaagcagatttgcttaatttttttaaatggctgtattcttaaaacttaaaaaaattaaagttgtaattgtagcttccatttttttcactgaatataattcacttagtaaaaattatttttatttcaaaatggaagcagctcaccattttctaaaataatactttaatcaagcaatacatactaaaggggaccataagcttttcaccaaatatgttttctgagttcaaagtctaaagctagtgaaaggttagcttacttgaatgtcatgtccttataccccttctgtggcaaatatttcaattactgcacgtctaaggtttggtctgaatctcataactaactttgccttgagtcataaaatgtctcattgcattatcttatctatcttctggtgctttggaattataatcctcacattccagtctttgttgaatatgaagtttccttatcacattgcattcacattatccatcaagctatccacatttattgagaaccaattactgtacgtgtcatggtcaaacaaatttatatttcaggtattggtatatgaatggtctttatttcaggtctacacgttgtgaagttgagtagatgaacctgttgctttagatcagctgtatccaatcttttggcttccctgggccacactggaagaagaattgtcctgggccacacataaaatacactaacactaatgatagctgatgagcaaaaaaaagtcacaaaaagtatctcatgttttaagaaagtttacaaatttgtgttgggccacattcaaagccatcctgggacgcatgtggctcacaggccatgagttgaacaagcttgctttagatcataataattacctcctacaaatctcctttatttgctctatcctccaacttattctacatgttcttgactgagttcagtggacaattattgtttagtggttggtcagaatcatttccttcttctattgtcaatagaacccagtttctattcaggagaattgcctttccctaattttgagactttgggaggagagggatttaaatcaaagttttctgctcccttctagctcatgtattaacatgtgacccaaacaaggtgaactggactctcttttaagactttaaaatttgaacagagttacacacaggatggagaaaagagagtatcacaaacagactggaatacttcttgctagccacatgcccagaaaggcatgctcagattctttttccttttgtaagttttgttccaatgcctttgtgctaattacagcacatttactttctgcctgatttaatcagagaatgatttctgttgcttgcatccagagagctctaattgataggcaactaaactatatgtgatgattttattttcctgtttacaatcctttcagagttgccactgcctgtaggccatcatcaaaattcctcagtctggcaacaaaggattcccattatttagccccagtcctctctattcaacctcatcaatttcttcctcatcatatacccttaacttcagccatatggaatcacaattcctctgatatactctgttttttttccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttattatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttgcctaatttttcacacatcaaacattaaagttgggattgctttatttaaaactttacataaaattgatattgatttcctgaaattataacaaaatcctccccatacttacttatccttcttatttcccctctcacacacatttgtttaatgattatttagggccattttaccgacaatttggtgattgaggctataaaagccaagaactgacaatgtctttaagaattattttttaatataagaggaagaggcaggcaaagcatccccctattcagcaagcaagagaagggagattagatttttttataaatatgtaatatatgaacattacatatcattatatataatatgctatatatactattttaaaaatatttttatatataccatatataatttataaatcctgtatttttgtgtctcagaaatggcttttgatttttccccctaaatttttttttttctgagatggagtctcactctgtcactcagtctggagtgcaatggtgtgatctcagctcaatggaacctctggtccaggattcaagtgattctcctgcctcagcctccctagtagctgggattataggcatgggccaccacaccagctaatttttttattttcagtagagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctgtctgcctcacttcttgttttttcaaaaggtagtactttaatacctaaataccttcagcacaactttgtatttctttagaaaggcttgaaagctgttacaagtgaaaaaactttaatgtataacaattccaacattatttttcttaatcattcacaaatataaaagatatatagtatatttgatctagctaggtaaaccatatttacatcaatgtattctaatgtttctagttgatgtcataattttaccaaatggattacactgaggctgaaaaatgcactatttgtattaaaaacatgttcatttgaacatggcattgcataaatgccaactttaagatctagggtaattttaaatatcttatgttttgttacttttctctttttaagttatagctctctttcaattatccttatcattggagaaggcaaattggcacagacaacttagaagagtggataataatcaattcccagactattatatttgattctgcaatatgttgggctgcgtagtgccaaaacaaacagtttaaatgtaaatagctcagttgagtgacttatttggtataaaatagatttttaaaataccaggttgtttagtaaatttaactgagacaactattcttgtaaggtttctgcttttttttttttttttttttgtatatttcctttttaatgtatggctacttttgttatttgcattaatttatatccttgattatacttaggctgaatagtgagagtaatgtgtttgctgagagagaaacagttgcctaagaactggtgggaaatggtctaggagagtaaagtgattggtggaaaatcttcattttaaagaaaaacttctgccaacttttatcattttttctcataccttctgcttgatgatcatctcgttgatatcctcaaggtcacccaccatcaccctctgtgattttataacttgatcaagcagagaaagccagtcggtaagttctgtccaagcccggttgaaatctgccagagcaggtacctccaacatcaaggaagatggcatttctagtttggagatggcagtttccttagtaaccacaggttgtgtcaccagagtaacagtctgagtaggagctaaaatattttgggtttttgcaaaaaggaaaaaagaagaaaaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacgattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagcagtttatcatatttttttctttttatttcagattgttagtaaactggccagcagtgaagaaaaaccaagatacaatattttcttaaaaatgcgagttagtagtttttctatttagacatgaaatactgtttcaaagtcattaaataaatcttaatatgaatagtgttggacactgtagagtaagtcagcctatggtaatggttaagatgcatagtactagaattaaaatgtctggtagacaatcctgttctctgccctaggaactctgggaccttggtaaagccacataacctctctaagtttcagttctaacatttgttcagtactagcaataagcagtaagcaaggcaaagtgggaagcatttttcatgtatttaccttaaaagaggaataataacagggtaaatgtcataagggcagttgtgtagattcagtgagtagtacaagcaatacacgtatgacaatgccagaaagagcagcataatcatcatcatcacaataatattattacagcgcctgacactatagtaggtgatcaatagtgttaggtattactgtttttataaacgcctggctagtaagaaacacagtgatgaacaactgtggtgagaaactggagataaggccccaaaatgtgaaatacttggggagtagtcagtcaaaagtccgtgtgtggccctatattgattgaagagggctgaacttgctggtgtgaattgatactaaataccaacacacagctgggttatcagaggtgagtggtgaggggaaggaatgcctaatcaagtttatagacaacagactcaagagcataatataaccagaagattggtggcaaaattattggactatgtagtttggaatgaaaggtttcaaggaaagctgcaaaagacatctcaacaggagactcacactggacaaccagtgaacgattctaagaatattaaaaaaaaatgagacattgaattttcattctgaggtagccaatcattaatttttatggctatgtaactgtgcttttaaggttgtctcctcattagagaagaagatgagtagaatggaagaatgtttcttgtctctcaagcttctcagggacaccaagagttttctatgaatgaaggaactaattttgatcaatgcagacagaaaaaaatagtgttttaattgtcagagagaataaaaaaatttgtgtcacgaaacaatgattgaaaggcagtaacagtgaggcaataaagaaaaagttttgtttctcaaagctatctgactactctgaggctctttctagaaagaattaaatgtaatgtaaagaagaaatagcattttgtgtcacagtccaggagaagaaatcatggaagcaaaaagatctagaaatcttaaaagggattccaggaaaggagctaaatatccagagaggatgcatgtgtgaggatgaaaagagagctaaattaaaatatcactgtaggaactaactgcagaacaccaggctgactggcaaatgtggatggagtgttcctaaaatagatacacaaggtatactgaggcaatatacagcaatttaggaggatttcaagcttatgggaagtgtcagaaaatgcttttttaaaaagtgacttattgaaaatttgaccctcaaataagagcagagacaagagattttttttttttctccagacttacttctgaccatgaaagaagtacctaatgaggtggaaatgatcatgtcacactaaatttcaataaagtgaaggatgaggaactagagaattatcagacttcaacaagcagaccactgtttcctgaaaagcacgtttggaaaaagacagaaaggaagaaggaaagaagaaagtcagggagggagggagggaggaaggagggagggagggagggagggaatctattgaaaagcaaggcaagacaaggcaggaaggcaggaaggaaggaagtcaggaagccaggcagtaagggaaggaaggaggaaggaatctattggaagtctattgaaaagcaaggccagggcctgagactcaaaaagagagaatggttcatgatgactaaatatgccattgggatgataaattagctgaagcatattcagaggatgatggagaggtctagcaatgcggccatccctgcgccagtcatgggcagataatctcatctatagacccgtcaggccagtatttctggtcttctcttctccagcatgcaccacctgaagaacatctatctgtacactgctgggaaagggaggggaaaccttatcagactttctcactgctctatctcttgcatcttgcacatgtcctggagtataggaggtgctcaattgattccctttgaatctaaagaaaagtcaatgtgcagtaagctctttagtgaacttagaggtcttctacatacaatgagtactaaaatttaacagccacccattagaatggaagaatggaggctagaacacaaaacatgcctaggtttttactagttaggtgattttagctattttcacgagaagataatggaggaagacccactgcttggagcagacaatgaaagatcaaatattaaagagagaaaatacagccagtcaatttatttgcccccaaccccacacacatacattttttttcctatcgaagggagaaaagcaggaaatagctctgaatcagaaagcagggtgtagaatatttaggctttctaggaccagattgttgtatttgaatccttgctctataattttttttttttttagctgtgtaactatagtcagatgacttaacctctctgaatctccatttactcctctgtaaagtggcgattataatagtacttccttcatagacaactggccttactttttcctaaatagacaatcttggaaaagtaatgttcactgacattggaggcatcttgaggtaaggaattatactatgcctgctacaatgaacatcttgaccctcaaaagttttcacctgtgtaactatgaaaacagtaccaatctaatggaattgtgttacggattttatgacatcatacatgtaagtcacctcctaggattgttctgactgtaagtacactatgtggatttttttcttcctctttttcctgcatttctcacacaatggttattggctcctcatgttctacattcgtatgggattttatgctctgtactctgaaccagatttgaccctccagacttacctctctccattctttccaggctcctccacacccatgtctattgtgcattctctcatgagcacaggccatttcaaacctgtgtcctttcatacgctttctatacttcttgaaaactttttctctcctgtttccagacaaaaatctcattttctctttaaatgtcaactctagatttctgtgttttggggaggaccagaataagaagtgtgtaactaaaatatctccatgaggaacagaattacacctttcttgtgggtcctaaacactttttagtctttaacgttttcttacttaaatctagttatcactaggaaggacaaaatcttgcaccactattaggttttggaggattttgaaagtgtctagaggatagctgatagtagttgagagttggattctaaagtcagaaactttgggtctcaaggaatatactttaaaacataaagaagcaagaggctaatcttcatcgacctctcacattagagccatttctgttcagaaaaacattacttaaaatattttatgttttctaaaaagacttgcctctggattcaggcatgtatatatttttttcattttttaatcaaagtgtttcaaaggacagaagttttgaagtcctgaaattttttttttttttttttttttttgagacagagtgttgctctgttgccaggctggagtgcagtggcgtgatctcagctcactgcaatctctgcctcgcgggttcaagcgattcccctgcctcagcctcctgagtatctgggactacaggcatttgccaccatgcccaactaattttttgtactttagtggagacggggtttcaccatgttggccaggatggtctcgatctcctgacctcgtgatctgcctgcctcggcctcccaaagtgctgggattacaggcatgagccaccatgcccggcctatttatcttattttattgtatatatcacattgattcttactgcactttcagatgcgtttacctttatctaacacatatgcggttctttcttttccaccatgtcatagtactagaaatatatgcaaatcacctttttcagtgaagtgtaggctggtcagatttgttagtggttttgtacagtctgagcaacctgttcacagttctaagggtcaggcagggtcgtattgttgtgccaaggatatttcctgttaagtcaatattttaaaagactgaaagaggatttgttttgctaagagtgcctgaatccataatctagaacgaacgggtaaagagttaggatatataaattattacatagaattttcaatgatgttctgggctgggtctcctgttgtcatccctaaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactctactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagctactaaatcttttaaaacacacacacaatgtgtttggcatatttcctttgaagtattcacacatggttttcctgtaattcacaggtctcctttggttgataagaaagcaagaagcacatactctatttctagctttgttgaatgaatgtgggtaactttttttgtttgcttcacttttatatttgaaaaatcactcaacttacaaaataagttattgggctcacattaacaattctatgagagaatatctaaaaagtgctgttagatattcccttcctccttatcattccatgtcaacaggagagcaatgttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaattaacctgattttaaaatgggcaaggatttaaatagacatttctccaaagaaaatatatacacagccaacaagcatctgaaaacatactcaacatcgtcaatcatcggggaaatgcaaatgaagaacgaaaaccacaatgagatattacctcacaaccatgaggatgaccacgatcataaacagaaaataacatgtgctggcaaggatgtggagaaactgaaacacttctgcattgttggtgggaatgtgaaaaggtgtagccactatggaaaaccgtatggaagttcctcaaaacataaaaatagaattatcatataatccagtcctcaaaaaataaaaatagaattatcatataatccagcaatcccatttctgggtgtacggttagtccccaacttactaaggtctaacttgtaatttttggactttacaatggtgtgaaagcgatatgcattcattaagaaaccatacttcaaattttgaattttgatcttttctagggctagtaaatatgcagtatgatactctcttctgacatattgggttgcagcatgatatttatcatgaggataaataattgatactctactatgtactgtgttgcaagatgattttgcccagatgtactgtaatctacatgttctgataacatttaaagtatgctagactaagcaatgatgtttggtagcttaggcatattaaattaatttttgacatgatattttcaacttatgatgggctgattgggatgtaatcccagtgtaaatcaatgagcatctgtatatccaaaagaattaaaaacaggatcttaaagagatatttgcacactcatattaactgcggcataattcacaatagccaaaaattgaagtaactaaaatgtccattgattgataaacggattaaaaaatgtggtataggacacaacggaatattattactcggccacaaaaaaagaaggaaatcctttcctatgctacaacatgggtgtaccttgaagacattatgctaagtgaaataagccagtcataaaatgacaaatactgcatgcttccttttatatgatgtatctaaagtagttaaactctttagagacagaaagtagagtggtcatattgccagtgctggggtacagggagcaatgggagctcttcagtgggtttggagtttcggatttgagagatgaaaacattctagagatctgttgaataacaatgtatgtatagttaacactactggtttgtacacataaaacagttaagctggcaaagtttgtattatgtgggttttgtttttcaaccacattttttaaattatactttaagttctgggatacatgtgcagaatgtacaggtttgctacgtaggtatacacgtgccatggtggtttgctgtacccatcaacccttcatctacattaggtatttctcctaacgttatccctccctctgccccccaatcccccaactggtgtgtgatgttcccctcccccatctccatgtgttctcatcgttcaactcccacttatgagtgagaacatgcggtgtttggttttctgttcctgtgttagtttgctgagaatgatggtttccagcttcatccatgtccttacaaaggacacgaacgcatccttttttatggctgcatagtattctatggtgtatatgtgccacattttctgtatccagtctattattgatggacatttgggttggttccaagtctttgctattgtaaacagtgctgcaacaaacgtacgtgtgcatgtgtctttacagtagaatgatttataatcctttgggtatatacccagtaatgggatggctgagttaaatggtatttctggttgtagatccttgaggaatcgccacacggtcttccacaatggttgaagtaattcacactcccaccaacagtgtaaaagcgttcctatttctccacatcctctccagcatctgttgtttcctgactttttaatgatcgcctttctaactgatgtgagatggtatctcattgcggttttgatttgcatttctctaatgaccagtgatgatgagctttttttcatgtgtcttttggccacataaatgtcttcttttgagaagagtctgtttatatccttcccccactttttgatggggttgtttgtttttttcttgtaaatttgattaaaccacattttattttaaaagggaattcatagaccaggtgaattgtggactttttaaaattcccttctgagttaaggagatttaaaagagatttttttgagtactataataaatatcatcctgtaaattccaatggttctgatatattaaggcccagtggaaaataatcgatttattttatgtcctcactactcctacttgcatcctcattgcaatatttgtggggtaagcagaatatgccagtgcctctctgtagtggatactgtaatgcttcatcaagatcctcttctggagtcgatgcacccacactaccaatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgtgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggtgcatggctgtaatcccagctacttgggaggctgaggcaggagaatcacttgaaactaagaggtggaggttgcagtgagctgagatcatgccattgcactccagcctgggagacaaagcaagaatcattctctaaataaataaataaaaagttaattatttattggtatcacatgttatataattcaattgaatgctctaaaaaatgacaaaaagtatgcagaggattgttggcatatttattgtttaagggcttataaagtagttttacactccttgggtatatttgagtttcaatgtatcatcagagttgctgtttcttatgtgaaatatgcacacttcctgtaactaaaagacccatgagcttgacaaattcaactgctgaagtcttgaactccgtcttcataatgaccttggaaatgtaactgctatcttaagttggtttgaagtgactgtattgaactaaacttgagttttaacgttctgggtcagtaaacatgttatgaattgcaggtatggaaaacacactaactgaaatagtggaactagctacatcaaaatcaatttatgtttttatttaacttgtagaaaaccatactatgcccagaagtgcgacaactaccaaccatacaaaagagatcaaaatcaaggggagaaaacaggtaacacttacgtaggaaaaattgcttgttagaagcacaacaaataaaaatttggtgtttgtttctttaagacatccctgccaaaccatctcaaattctttttgaacgtatgaaaggtaatcataaataaaacatggtttcagtggttttaaattatgctattgaaataacaatgttcctcagagcattagcatgacagttttgatgcacatacttcctattgtcttggacttgaatctcattgtcttaatccttttgatgaatgggtttaaaattaagagtgtaaagagtgtatggaaaagctgtgagcccacagtaaatggtttctgaagtagaaacatatccaactctgtttattcagaaagatctgtgaagctgtattattacagttgcttcattatgaacttatttttgctgcttacaaaggggaaatcccatcagatcagggctaagataattcctttttaaacaatcagtaaatcatatttaaaccttgtttacactagtactttttccatgatggcgttgttttacataaaatacatgctttcaatcttgttaaatttgttaggactcattttgtggcctaacatatgatctaccctgaagaattgtttcttgtgcacttgataagaatgtatattctcctgctgttagatgagatgtactgtatatgtctgctaggtctatttgatctaaagcataaagtccaatgcattcttattgattttttaatgtggattttctgtctattgttgaatttggggtagaagtcccctactattattgtactgtagtttgtctctttctttttatcactttatatttgctttatatatttaggtactccaatgttgggtgcatatatatttacaattgttataccttcttgatgaattgatccttttatcattatttaatgaccttctttgtgtctttttagtttttgatttttaaagcctattttgtctaatagaagtatggctatccccattctcttttggtttccatttgcatggaaaccaaaatatctttttctatctcttctatttcagtcaacatgtgtcctaaaagatgacgtgagtctcttatgggcagcatgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacgtaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatcatgctatttttttcattagtagaaaaataataatccttaaaaatgatgtttcttttttcctaagatatctagataagaactaaaagtaaaatgtatttcctctactgtaaaattacaatctatattaatccattattttaaaacaaaaagatacgaagggagaaaatttttatcaagttatgttacaaaatctctagcttattgcatgaaattaaaccacataaaagaaataataaacctaactgaaacaacattaactcctatctagggtttatcaaactacagaaaacagaaaggaaaggaattatacatcttgagaaacataactactaaatactggtggaaactatacatgtgcatagttttgaattggtaaaattcttcatttttgccctgtaaatggtggaaagaatgaaaaaagtcactaaagctctgtttcctacttttgtactaattcaaaggcatgattatgctatacttaataactatttctacttaaaaattgttaatcattgtgattttaacacctaatgtatatattttctgtggaatacaagaacgtgaacagaggcaaagagctaggtagaaagaccaatttccaaagagaaagtagggttagtttactactgggggcctcacattcccattcaatctgacgtaaaagtggaattgaagggcatatgggctgaagttatcagagactgtattgctaaaatggataatcttcccctattgacaatgggggcctgtggctaccaaaattaggtgacttgaacagataaaaccataacaagttcggatcctttcatgcatctattttcaaaaatgatattttggtgattagtgaatcagatttattattatgataaaaatgagtaagtaaattatttataaaaacgtaagctatcaaaaacttagttttcagtgccatgaaaatataggttatagtaacttgtgaagatcttcaggaaggttaatttatactgtacattctaaaccatagatgctacatctggtaatattaagttgggaagggatttatctgggaaaacaccatcatttatcaattaaaccaaggcagaaaaggttgaatagtttgcccaaaacccccaaaccatagccaacaagagatcaaatgaggactagatcccaggtttattaattcccaatccagtgatcttttaacagtgcctggtttacaatatcatgagcatgcttctgaaatattaaaaatgttacgtctctatataataactttatatctagcatgcgtagattgagaaaaatagtgacaaaatcaacttattctgaattcagtaatattgtaatataattttgcatttattaattgcagtagcatctacatcacttaaaaaatgtctactacatgtttgtgggtaatgcatcactcctttgattcacagacaacacttgaggtggttgtggatttgagaatttctttcaatggtcctgggaaattttagctatatccagcacacaggttgagaacttctataatgttggtctctgccttgcaacattactcttaaccaaatatctttaaaagtcgtactctttactcttagagttgatttcagtttcattgttgccaaacaatgatatctcaatcatttgacaatgggttgtggcatagatataaaatatccaaattgtctaaatatttttatatttttttataaattagaaccaactaaaggttgtcaatataagagtactctcgcattccaaagtgcttttctgagtgagagagggtgcacagtcagaactagtgtgcttgaattttgctatttaacttcattcacctttacatatctgtagcccctgacatgaatatctatcttcaggcaagtgagtgaatattgccaacatctgtgatgatactggtaggatagggatgggggcaaaacaaaggttgaaaaatcctatatgaccatatccaatacctgaattctcttccactttacttacagaaagtgatttcccactgcttaccccaaaagtacacattgtgtcaaactagccagtctctttatgtaatacccaatatgctttcactctttacaaaataaatttatccttgttgtttcttagacttttttttgcacccattttattccttactaatgtctacgatcacaatcttctgtgaagtctttgttgacaactctagttaacccatacagtcttctttccaaactcctatgttgatttcagtcttacatatttatttatattattatttgctatctcaattgtaaaattctacaattggaaggaaattatggaaattccaatgctgaactttaaaatctttctcctttgagcattgtaaatcttagactgaaatgctttacatataatttagtagatgtttaatattctcaagaggtatgcctaagagtctttgcaaatcaaaaagcagatttatatgatctgatagtcttacttaggagttaagggattcatccctgcccagtagtttcccagtacatgaaattagtactggaggccttccttacatgttagaaccacccaattacccaataggatcaatgctattaaacacattagaaatcactacatatcatggacctttagaaagcaatattttatcacttcatatgagttatttagcttaggacaatgttttgccatttcttatttagattatgagaaatgtcacatctcattttaaaaattatttcttagtatatcacatcattctgattatctgcactaaagcaaaatcttccaaacataaaggagttttcaaaatatgttctaccattagaaattagcatgacggctgtattttcatttaacatattttacaaaaggaaataataggttcatgaatgagaaagctgttttctgtcgtgtctttgataatctgaatttagtctaacagaatagctttcatttaagtattattactgaataattactaacttagtaaagggtttatacctacttagtaacgaagcaggatatttccctgacccctttgtggaactcgcaacaggggtgccttatttacttagcccactgctctcaactcctcactggagggagtgtgcaagcaaacgaggtgggaactggagtgcatgagcactggagcagcatctaggtggaggcgtctgcgacccctgaagccccagagggtgtgttacagtgctctgttagctctgccatccacggacagcttaggcgttaacagctcagtgggccatttgtcttttcacaggaggcagctgccctccaccagcaagggcaaagggccttttgtattcacacttgtggctcctgagctcttgtccagcatctagggaaaatgaggtcacatgaacaaattgaaggattgtaaatgtgagggattgtactgccgatgaaagtggctctcagtgggaaggggagctgaaaaggggatgggggtggcaagtaatcttcccctgaagtccagccggattcttctctaaagttatgccatcaagttgtccctctgaagtcaagctgcttctctctgatgtccagctgtagtcctgtctaccagctgagtctggggtttttataggcacaggatggggtggggtggggccatgggtggtttagaaaaaggcaacattcgagcaggaaaactgggatataagttcccactttgagctgcggtttcaggctttttggcttgagggtggggttttcgctggggaccatcccttttctgcctagagcttctctgcctcctgccgctatcagtacgagagttgtgtaaatgcctatattgatacaggtgctcctcaacgtacaatgggattatttcctgataaacccatcatacgttgaaaacatcataaattgaaaaacccatcataagttgaaaacatcataaattgaaaaatgcatttaataaacctaacctactgaacatcattgcttagcctagcctaccttcaacatggtcagaacacttacattagcctacagttgggcaaaatcatctaacacaaagcctattttattaaaggtgttgaacatctcatgtaatttattgaatactgtattgaacatgaaaagcagaacagttgtatgagtacttgaagtatgatttctactgagtgcatattactttcacaccattgtaaaataaaaatatcctaagccgaaccattgtaaatcaaaacatttttagattgggaccctctgtatatttctttatttctcaggcccttgacaaaaggagataattgaagcattcttatttttattaaacagtgaacatatgtgctaacaaaggaaaattatattcagagaaatcagcacttgcccttgtattacacaggaagtgctaaaagctttactctttagagttaaatgctaagaaatttagattggtataggttacatacaagttttcccgacaattctatatcttgaaaaaaaaaatctaacattgtattatctgagactacagcacagttggactggtttagactaaaactagggtaagggaagtggtgttaaaattgattgaagattatagtatacgtctaaaatcttgggcatcattaataaagcccactctacttggacttattgctctattcatatcctttctgaaagataaactacctcaaaattcaggacccaatagtaatatactattattgcggagatgccatgaaacattcctggggctgtgatcgggatgattgagaggagcgctaaatgctgaaaagtggatgtgaccagggaatggcttagctgtttgccagtgtaaaaaataacttgatatcaacattaagcagcagctgaagaatcttttaatagtttaggcactttttctaaatccttcagttatgcttcaccgattaaattattaagaacctctgatctagctatttcatattttagatgtgagtgaagatgttttgaaatcattttcattgttcatggtttcttgttttttaaaattaaacctagaggacgctgagataatctctttttattaggtctgcagaaaccaagaatacaccaaatgctgaatagctgcatggaagtatcacttgccttgacaatattgtattatgataagctagttcctcttttttttttttttaagttgagctatatagattccaattaatgttgttaaaccaattgtttaaaaaatggccagaggcttctactggcttttagatggaggccaagatatgattgcgtcaaagatcaagataaggatcagaaacgaaatttaggaagagcctcccaatgtgaatgactaaattgtatatgattaacttttctaaaaatacttctcgttgtcatttagtttataaatagcttgcagataatattgtcttcctataggttcgttgaacaaatattaactgggtacctttgggcccagtgtcaccccaatggagtgaatattgttggtggcttaaacaacttccattcaaagatatccctacacccactctgaaattctgctttctaggagaattccaattgtcttcaagtttctacggaatccatcctcagttctggagatggatttagattcacctaaatcttcgattctaagccagtcaagataatctcatcctcttggttcaggaagaaaagtttaaatcaaccagcttatgaaaccattctgaatcatctttagtacaatagtagatatatatgaatacctaatacatatactaatgatacagtagatacacaattaaaattttgattgttcttatctgagggtgaaatctctgaatctgtgaggtaagtgtttatgtctctcactgtaacaagaaattatgttacccatttgttgctggcagtcatcttggaacctggagggcaactagtgaggaggtcaaagctgacgcagagaaaaaaatcaggacaaagaaagtcatagagaaagagtgacagagctctgcttgtacttcatctggagccagctttaacctctgaacttccagttatgtgagttgaattattcttatttttgaagccactttgaaagtgcattctctttcttgcagcccaaagcatcttaactattaaatatgtcaccagggtaacataaatatgccaacaattaatctcagtaaaatattatgatacttgctgaaataggagtaaattttaaaatgataatatggagagagaagcacatgcattcccctggaggactaagtaggaaaaaaggtacttacacaaataatattataaactgagaatgtaatggtaagtttaccaaagagcctattatgacaaatgtatttctagcaaaaggaagaatatatgttaaagtataaaggcagcaattggtgattagggagttacaaatagtttagtattacttgatttttcaagagagaggagggaagatgtaggaaataccctagatagactagtaggtaccaaatccatgaacggccttgtgtaccaagctgaaaaatttagcttttatcctagaagagaaagagaactattatacaacctttactaatacattatgattggcatgttaaaaagtgtagttttaatggatttgcagtgtacaagatgagctgagagacagaaaaactagtgaagaggttttgtagaagatgctatctgaatgaatgagaaaacaaaattgcagtgctaaataagagataagaaatttcaagcttatttgtcttaacaagatcgaaaggattggtaatttatcgtggggcttaatattaaggaataaagaaagtgccagaaaaacttcctgatttttaacatggccagtccattagattgtgtcattcacaaaaatagggaatatagtaagaggaatagattttcagaaaataatgataacatcaattttacatatcctgagttagaaatacctgtggaacatctacgtggtagcttgtcagcaggtgaaaatatgagtttggaattgaagagagaagcctgaactagagataatcattggcatagtttcagtagtcttaatcttagattctctaataaatggaattggtagtaaaattatttgaattaagataatgctatagttcagatgttgtcccctccaaatctcatgttgaaatttgatcctcaatattggaggtggggcttaacgggaagtgtggggtcatgggggtggatccttcttgaatggcttaatgcccttcctgggggcaggttgagtgactgctcattctgttaggttctgcaagagctagttgccaaataacagcctggcacttcccctctctctcttgtttatgctctctaaccatgtgatctctacacaccagctcccctttgcccttcaccatgaatggaagaagcctgaggccctcatgagaagttggtagtggtgccatgcttttttgtacagcctgcagaaccatgagccaaataaaccttccattctttataaattgcccagtctctggcattcctttatagcaacatacatgaacaaagacagatggtaaattttccgttatgtgctgtttgccacaataaaaaatttaaaaaaattgacaataagtacaggataggtgatggccaatcagccaagatgctggccatagagcaatgcagactaggaatgggttaacttccaggtgatattaacactgaagagggctaacagggaaaaaagtaaactaagtagaaatggttggaagtgaccacagagatcactgaaaaaccaaaccaaaccagagaatgtgcaatctcagaaactaacacaatagagaatttaaattgaagagggataggtgatccttgggtaagactatttaaaggcactgagggtgagattacagaaccctagcaaagggcaaaacagttaataaataaaatcttgtccagtagattaatactaattacgtcttaaattaatactcaccatgtgatgcaatttaaaaaacaattatatttaccaagaatgttaggtaaaatgtgcataaaaatagaattacttgacctaatatattaataatttgaactcaagaagcaaactatagtaagaaagacagagtagaaagttttcaagtcaatggattactgaagagtacatgtgacaggcaaataaacactggtagataaatatattaaggaatttggagtggcagattctttctgacatataggatgacaaagaatgtaaaaaatgaaagactggaacaaaaatcagaggagataagggacatataaagtgaaatataaagaaccaggaagatttataggtggtaagaattggaagtgaccaactggtttcaagaaaacaaagaatcttcagtgagaggagctgaagacaggcgtgatgtggcaacctccaaaaaaagacttaaagtgaatttttccgctactgcaatatttttttgttctcaaacaatatttttgcttttcttttataggtggaaatagtgaggatgatagtacactgaaaagacatttcatggttctgacattcaaattgtaaaatatatcgggttgaatgacaaaattacttcatcccccttttaaaatttctatggtacttttgagtctcaaaatcaagggaaaactaatacttttgaagctcatacagtttttgttctagaagttttgtcttttttgtgagcataaatttacccagtgggttcaggaagaagatgagtatttttttttttcaaagcaaacaacgagacagcaggaggttgaaagttctccacatggagttgtcactcaagcactgacatcaaaatcaatgaaaagtggctccagtcttgtgctaagtataatttgtagcagagaggaagttggaggcaaagtgtgaggagaagagagctgagaaaaatagatagtcagatattcagcaaacacaggggaaataaagaggaataaaccctaaagttggcaaaatgatccaaattccaaatggaatgaagtaaaaaaaaaaaaaaaagtggcagcaccatgtagtgcaaacatcactggactgagaatcatttgacaacagacactctgggagtctacttgatctgggcaccattctaggcactgggagtacagtggtaaatgtggcacaggcaatggcctcatggaatttatattgtgatatagaaaagagacaggaaatatacatttaacatcattttagattatatgaaaggcagtaaagcaaaacagagccaggaaaaaagtaagagagtgagagggttgcaagttgggctagggtctatgaaaaactagcccttagctcattatgaaggtttggatgagactttttatccctctaaatttccttagctcccctagctagctttgtctctggaacaagatgacagtttatttcatctttatttccatttctttacatacttcctcttttactgctactactcattctccacttctctttttcactcccctttggtactccttgtttccagaagactctgatccccagctcaagggttccttctctgtactgagtcttgctcgtaattatcttgtgtaacttcaggatttctatattgaacaatacgctgatttctatttctgccttcctcattcattcccaggtaatggggattcaatgaaaatcgacaagaggggatgttggttgtattagtctgttctcatgctgctatgaagaaatacccgagactgggtaatttatgaagaaaacagttttaattgattcaccattctgcatggctggggaggcctcaggaaacttacaatcatggcagaaggcacctcttcacagggtggcaggagggagaatgagtgccagcaggggaaacgccagacacttataaaaccatcagatctcatgtgaaatcacccactatcatgagaatagcatgggggaaactgcctccatgattcaattacctctcactgggtccctcccatgacacctggggattttggagattacaattcaaggtgagatttgggtggggacacagccaaaacatatcattctgctcctggcccctcccaaatctcatgtcatcacatttcaaaacacaataatgccttcccaacagtcacccaaagtcttaactcattccaacattaacccaaaagtccaagtccaaagtttcatctaaggcaaagcaagtcccatccgcctatgagcctgaaaatccaaaacaagttagttacttccaggatacaatggggggtacaggcattgggtaaatacacctgttccgaatgggagaaattggccaaaataaaggggttacaggccacatgcaagtcttaaatccaatagggcagtcattacactttgaactgcccaaatgatctcctttgactacatgtctcacatccaggtcatgctgatgcaagaggtgggctcccatggccttgggcagctctgcccttgtggctttgcagggtacagccccctcccagctgctatcatggctagcactgagtatctgcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacatgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggtttttcttttctatcacattgttaggctgcagattttccaaactttgatgctctgcttccctttaaaacaaagttccaatttcagatcatctctctcaagttcaaatttccacagatctctaggccaggggaaaatgctgccagtctctttgctaaagcttagcaacagtgtcctttgctccagttcccaagaagttcctaatctccatctgagaccacctcagcctggacttcatcgtccacatcaccatcggcattttggtcaaaaccattcaacaagtctctaggaagtttcaaattttcccacattttcctgtcatcttctagccctccaaactgttccaacctgtgcctcttacccagttccaagtcacttccacattttcaggtatatttacagcaataccccactctctgcagtaccaatttactgtattagtccgttctcatgctgctatgaagaaatacccaagaccgggtaatttataaagaaaagaggtttaatagactcacagttccgcatggcttcagaggcctccggaaacttacaatcatggaggaaggcaccttttcacagggtgataggagagagaatgagtgccagcaagggaaatgccagatgcttataaaaccatcagatctcatgagaactcattcactatcacgacaacagcatggggggaaacaaacccatgattcaattacttccccctgggtccctcccacaacacatgggaattacagggattacaattcaaggtgagatttgggtggggacacagccaaaccatatcattggtcaaagggcacaaactttcagttataagatgtctggggatctaatgtacattatggttactatagttaataatactttactgtttacttgaaatttgctacaagactggatcttaagtgtcctcatcccccccccccaacacacacacaatagtaactatttcttgtgctagatgtattaattaatttgattgtggtaatcatctcacaatatagtcatataaaatcatcatgttgtataccttgaatacatacagtttttatttctcaattatacttcaataaagctaggtaaggaggaggcagagtatgtcctcaagaagctcacaattgagtagggggaacaacatgaattcaaattgtcccacaaataaatataagatttggtgtgtgctctggaagaggagtataaatagtgccatttacactaacctagtttgggaggtaaggagcgtctttcctgagtataacatttgagctgagacctgaaaagtgagtaggtatgaggtcaaaaattcaaaaggatagtgtctcaatcagagagaccaatatgtgcaatggctttaaaaaacagaaaataagcactttcataagcaaaacaaaactaggagggaggtcaatgtggagataagagagtaagtagttcacagtatctggtataaggatgatgaaatggaaagggtcacactatacaagatcctgtgggatatcatttctttttttgaaatttttattttgagataaatggtaaggtactggagcattttaaacagagttctgtctgtcatcaaatttatattttgaattttcacacagctaagatgcataggagagaagaaatgaatgaggagagattaggtttggatgacagtattatttaacccaataacctgcatagtgttacaagtgaaaggtgggactattagtcactctgaggcaatgacataaagcatgttttctctaggcaaatcaagactatgatcatcctaatataagactactgtaacagtccaggaaagagatgatgagattgtacaggggtatgcaggataaatctaaaaatgaaagctgaaccaagaaatatttaggagcaaaaaaatcaactgaacttagtggtggatgtccagcaggggtgaggtgggaaggttttaagaatgacccccaagattttgttactggatagctaagtggtgctacaaaacctgaagaaaggaatatatcaggggaaggtcatgcatttcatagcagtaaaagatcatgagattatttttgagacatctaagtggaactgttgagtaggcagttaaatatgcagtatggaatacagaggaacttttttcatgccttaaagtcttctcctctttcagttccatttttcttattgttgtctttgggtcccctgaaaacagggcctggatgaggacttgggtacagatagctcatttggaagctgatccctaggaagcaagaatgaaaaaccaaaagagtgagacagagggggaggaaatgccaatcaaatgtattatcatcaaggtaatgcttatggaccatggggactgtattttgacagaacttttgtatgttcctgagaatcacagagaattccccttgcccccggaaggaatagtggttaaaaatatatccatgggctcccatctccattggttgaaggttgctcactcactaaaacttcaagggtgagaaagctcacaaaatctgtgggctcctgggatgtcagagaagtcccttagatagaaagtagaaaaatgggagccattcccttgacatgggatgctgtcagctaaaggcaagtctgaactcacacagggctgtccactgcagctgcaactgcagtgcaggaaaatggcgtgtgactccaggcaccaggggaatctgttacaattgtgatgataatcttttggaagcttttattttcttttacagtgaaatctgtcttatctatagatgattacatagaacgtacacataaagtgtgaagaataattataaagcaacactttatgtaaatacaaccccaatcaagaaatagaatactgctaataccttgaccccacccttgtgttccccacagcacaatcgcctccatctccctggaagtaaccattctcctgaatttttctccttttcttttctttccctccctccctccctccctccctcccttccttcctttctttgtcttcctctctctctttctctgtttctctctctctctctctctctctctttctttttattttttgagacggagtttcactcttgttgcccaggctggagcgcaatggcacaatcttggctcaccgcaacctccacctcctgggttcaagcgattctcctgcctcagcctcccgagtagctgggattacaggcatgcgccaccatgcctggctgattttgtatttttagtagagacacggtttctccatgttggtcaggctggtctcaaactcccgacctcaggtgatccacccacctcggccccccaaagtgttgggattacaggcgtgagccaccgtgcctggcctctccttttactttttacctgctgccttctccagcctagatgtttaggtgttcttaccctcgagacttcagctttgttttatcataacgctggttaactctggcatccatatttttagcctaaacttctctcctgactcatatgctcagttacctcagtggccttgcaaaactagatgtctaaaattgaactcacagttcccctgaaccctaaaatactccatagtttagtaatttctaccacggtctactcggtttatcaagccaaatgcctgggtgttctattcgcgttctctgtatctctccattttatgtccaatcagttaccagggcctgttgtttccacgtgccaagtatcacttgaatctgtctactttgtctccattccctttattacttctttagtttaggtcattattatctatcacctgaaccactggaatagcctccaaagttgctcttatccaatcagttacctattcttcagccagagtaatccctctaaaacccaaatatgctcatgtcactagtctctctacaatgcttcagtggctttcaattacccttcaaataaaatgtgtttgatttctctaacatgtcttaaaatgcagtttgcgaacatgcatgcatttccagcatcatctggaatgtcctccctgacacatcgctcctcacccattcccaaccccaactcagtgcttcagccatactgatatttttaaaacgtgctaggctccattttgcctccaactgttacttgtttctcttgcctggaacactctcccctacttgtttgcctaggtacacctacttatccttcaagtctcatcttcaaatttccttttttttttttttttccagaatttttcctctgacatcgctctgttgcaatactccagactgggtgaggtgattcttcctgattcttccctagtattctacatcctagtatttgtcacgtacagttatttagttttcttactttctaggagtctaggaatcacgcttatcttgatccatattgtatccctagaatctaacacacaggagggcacacagtaatccttaataaattatttgtcagattagtatattgataaattaaggatacaaatgagtaacctacagttaaagaaggaactgcaccagttaagtcaaatagtgtactggaaaatggcttcttatccccctgatggtgacatctcctgctgcctgtaactatataatttaactcttcctaactaattcattatttaaatgatagtcagttgaagtggcattatcatagctcttttctgctaatctatgacgctgctttgggagaccattctacctttgtacaagtatgccatttcaagtttcaaagaaagctgagatgtggtgtataacattttaatctcgagaactatgagcagtaattagatttcccataatatcgaaattattacttctacttaggtatatttaagggtacttcaatatctaaatatatgggacttatagtcatgagaatttagaaaatctaagacctagttatcccctttctttgtattttttgatgctgagataggaaaacgttatccaaagtgagaacaaatgttttaggctcgagtccttttatataactactactcatcattttttcaaatgatagtggaacactcttaagagttgtaccaggtatttcacatctctttattctttccatgagtggctttataaatgtccattctatgctaagtaagtggtattctttgttctgagtaagcattaataacactgctgatgataagaaatattttttcccctggaggaagccttaagaagattagggaaacacattaaacaatctatattccctttattagctacaaggaatctattgactagtatttatctaaaacaggggtcagtgaactacggcttgtgggccaaatccaaccaactgcctgttcttgcaaacacacttttattggaacacagccacacttatgcatttacaaactgcctatggctgctttgcacctcattagcagagttgagtaacttcaacaaagatcttctggcttgtaaaacccaaaatatttactatctggctttttacagaaaaaattggcaaaacttcgaccaaaaccttcttgaagtgacttacattactaacctatacctcccgctgaaacagtaaattatataaaccaataattgactttataaatatggattttttatttgcctcaaatcgtgtcttccaagattcaaatggcatcccctaattgcaatgtattatgatttggtgaataaattcttgttctcactactgtagttagaagaaaaatggactaggaatacgaagagaaaagattctgtcctgattctcctcttattcagtttcctcaactgcgggaatttataatcttcattcttaagggaaattttagataatatatacatgtaaacaattttattattttttgatcagatggatttcaatattttgttttcttcactctagggttcactaactacagtcataacttgtttcagttgatattcatgtgacagtctgatcaaatgtatcatttgttcagttattctgctacctccaatttattccttgagtgtgcatcccttggtatggcttattgctgacctcattatttctgcccacgcaggtctatccactcattcatctcaatccacttgcatccatggccttgctcacactgggttttactataatgcttcagatttatccagatgagaaaaataaattccagccaagaagcatgcttaagtgggacactggctagaggaaaggtcaacaatatccattatgataagtggtaacacctctgttaactccctttttattttacagaaattttattatcatctagtccagtgacttttagtatttttaaagcatacaacccttttttcaagtgagctcctaagaagaaatccggtatgtgaagcctaaaaagggcgagagcaacagactggttgaaattgcagatgggaggcaaagggaagtatgaacatatgttggaggaaactctacccttttgacggccgaaggggacgctttccagaagaggtgatgaactctatgtttctggtttgtgtgattgattgaagttccagcccatattcatttctacgatttcatgctgtaggcaattgggtccacttattcaccacagccaccgaacaaagaaaacactagaaaatactttcagagaatcaggtctgaacacaaaaaagaattttccaagggagtcgtggtgcccttaagattaaatgaagtgctgtttaaacatatttatttaattgattttgacttgcagcagggtgctggactatggtaccctatagattttccagatctactttttgtaattctgctgctgtactggctttttgaccttgaattgacagttacagatgtgggagaataaataaagctaagtagtaacactgtgggagaatcaagcctatcatcttaatgtctttttctctcctgattgccttctattctagaggagccaaaaaaagaaaagaaaagaaaagaaaagaacgtatatatttcttcatattgaaaccacttccgtaactctgaggttatagtattaagcttcaaaggtactactacttaaggcccaattccacccacggagatttaataaaagatttagatgtcatgcaaaacggaaaagaaaggggaagagagagtattgttgtttaatttcatttggaaaatatgtacaaaagcatgcacaatatggtagaattggtcctagagtatatggagtcttcattcatagactgcatgaccaagattcagtatgtttaacataaaggtaaaagacaggcatgaactttataaagactcaggttcaaggccatgctgtgcccacttagtagctgggtgtttttggataaccattctctctaggctttcatttcctctcatggtgaaaaataataataatgtagtacctatttcataaggctgctgtaagattaaacagaaaaatgcacaaagaatacttggcaaaatgcctggtacagagcaaggcattaatgcgtgttagccctaagataaatattaggtatgttcgggtcaatgcaaaagctagggggaataatcgaaatgaaagcaggtattatttttgaaaatggctatgataggcctatatattactggaatagaaccaaactgtgagaccttagagaccctccaggagagttaaacatgaagtgacaatgttgttttgcctgatttacatcagacttatgttgttaaagcaccccttttttcaatatgaagcatttattcacccagataatggatacaaatccatgcattcaaatgttccttggagtcagagatcaagatggaaatccccagaatcatagagatttgcgtctgtaaactggcttattatattcacattcaaagaggttggaaggggcagtgtcagctttttaactagaatcttttcattacttctccctgttggggttgcaacacatgctgtgagtgacctccagagattcctcaagctgtatgcaggcagcaaattgaatctgaaagctttattagacaagtttttcttgtctttcagctggtgggagtggatgtcagttgtattggaaaaaataaaacttcttgtgaaactgggtcctgaccttgaaaaaaaagctcaaatcgaagtgtacaattcaatcctgagttatgtgcttatttgttaaacagtgtgcaggttcaaaggaaaagggcatattttaccttaaagaaataagaatcaacaataaaaataataggagttctgttttgatcatgctgaacttagtaagcaaaagtgcctatcaccaaatcacatagttatgaaaagtatgctaataatcgaagaaacaattcccattcacttcagtatgacaagaaaactattataatccataatgaacattatagaacatttatttatattgtgtattcatacatttctttgagaataaagaagagtcctgggaaaatgaagggacattggagattggctagtttgttttatttcaatattgtctctcatatatacatataaaatctcttatatatatatgagtttatatataaatatatatgagtttatatataaatatatatgagtttatatatatatgagtttatatataaatatatatgagtttatatatatagtttcctatataaaaactatatagagatatagctatctgtatatataaccatatatagtgacatgtaatatatatataaactatatacagttatatgtctatatagctatatatatatagtgatgtaatttagttcctggtttttaatattggagaacaattatgagtttttttgaaggtgtgataattattccagaagtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacagtaactggaacttaggttaggtagttgaaaaactgtcaagtatagcagattggtagaactccatctgctcttcactttttaagaagagagttggcagttacgcttctaagattgcttctaatagaatgagagcctttcctgagatagtggaaaagaaagaatgactgttcaaatacttttcagaccacaatcttaaaatcgacaattgaagtacaaaactgctacaatttcctttcgaaatcttgtttctctctgaaggtaaagttatattcaattttaaaactattcagtgaagttttaggaaatattaggaatacatgttgaagccttccattttgagcggtagggtacttactctcataaatatgcctaaatagttctggtttcttggtcagagtatgacagtcaagattatggtatactctgtagtgatttcaagcaaaagtcctttcttgaagagtgttaaatagcataagaaggttaaagtaagtttactgtaattaacattttatttctgttaaaatgcaggacataggtaatcaaaaaatctctaatcatcagaattgatgttagccttctctttttcctagaaatgatgaactagagtttctcttccttcatcagttcagaccccaaagcacaaccctaactggaaatggtaaccatgcaataaaactaccaaaaggttaagagagggagaagaaagggaacttcatcacaaaatggataattaacatctaaatgctgaatactaaatactaaacagtagaagtttcacattctatcactgtcttggatgttaacaatgatgccactgtagtgcctttcctgttaaccagtgagcattgttgaaggacctggcctgggaccagggaccccctactgccttcatggaaagacttccttctgatgagtgtgagaagtgctggggcctcaccagccagggctttctgttgtcactcccctttctacagtgtgacacatctcattatatttcaagcactcttacctcactgatacatacaaatatgaatttttaaattaattaattaatgtcaagagttaaggagtctctccagctgctccaaggccttgcagtatcttgggatagggtttaaaatggatttattttgttattggaactgattaagggtcttcacattttttgtacaaaagcttgctcctgacgtattagactttgaggaagttttcaaggtttagagcctgtaactataaaaccggcaatagtatagccatgtcgtaagtgtttttagcagagaaatcatctgttaatgaggaagaaaaagatttggcctcacggaaatttatttgcctaatcctaaaggttcacctgaagcagaatcaacagtggaaacataaccacaacaggaaagggtgtgggttatatacccctcccctgccatgtttctattaatgagaaggatcaggacccaagagaggaataagaatgcaagaactaattgccatcctctttttcctttgctgcagataaacgaaggccattttcacaaaaaaaatgatcactgcagataaatgtagggtattgtcacaataaattaaccattttttttttttgcaatttaagccaacaaaagtagtatgacaagagtacatttaagtgccaagtaacctcatgctttaactgcctagatatttaaagtattattgaaatggaaatggaatgctttatttaactttgtagaggtgagtgaagttcaaattaaaatgtataaatcaccatggaatactatgcagccataaaaaatgatgagttcatgtcctttgtagggatatggatgaagctgtaaaccatcattctcagcaaactatcgcaaggacaaaaaaccaaacaccgcatattctcactcacaggtgggaattgaacaatgagaacacatggtcacaggaaggggaacatcacacactggggcctgctgtggggtggggggaggggggagggatagcattaggagatatacctaatgttcaatgacgagttaatgggtgcagcacaccaacatggcacatgtatatatatgtaacagacctgcacattgtgcacatgtaccctaaaacttaaagtataataaaaaaaagttaagcaaaaataaataaataaataaaacaaataaaaaggtataaataaccttatatgtgaggatttgatattcaatttaaatagagacttcaaaaaattcaaatgaagataactaaatcactgcttgatacatggtgcactgattaatagcataagctctggaatcatagagacttatttttgaatacccactctgtcactgactagctctgtaaccttggacaaattatttaacctttctgacccttggttatctcatctataaaatgggaattgcaacataacttactcaaaaggtataactgtggcactaattctaagacttgtattaatttaggtttgctcagaagtagaccctgagacaaggatttaaatacaaataattcaattgggagctgatcccagaaagccatggtagaagagaagatagagctgcagagctgaagatacatatatatctgtcagttgtatctcagcagggaacaaagttgagatatatgagaatactgaagaggactgaaatcaaactcaggagatgtggggttgggtccagattctgccaaaatgggaagaaagcctacacatcggaaggaagcctatacgaggcatgctaataagtatgcttatcattgtggtcaactgcccaattcactggagatttttagtgtggaacatgcattggaggtgtcctacccaaggggagaagaaggtgggatatttattgatatggtttggctgtgttctcacccaaatctcatcttgaattgtaactccaataatccccacgtgttgtgggagggaccatgtgggaggtaactgaatcatgggggtggggttttcctgtgctgttctcctgatagtgaataagtctcatgagatctgatggttttataaagagcagtttccctgcacatgctctcttgcctgctgtcatgtaagaagtgcctctgctcttccttcgccttctgccatgattgtgaggcctctccagccatgtggaactgtgagtccattaaacttctttttcctgtataaattatccagtctcgggtatttcttcatagcagtatgaaaactatgaagaccaacacctttatcccccagcttttgtccattggttaagtgctattccagagataatctcctccccagcttccagcctgctctgcaagtgggagagctactcctacaggcagagaaaggactcaggaagactcacaggtacttgtagttagacgcttcatggtttataggaaggctgagtgctaaggggaaatgggtagcccactaagggtcaaatctatcttacctgcctcgtttctgtaaataaagtgtcactggagcacagccatgtccctttatttaggtattgtctgtggcttttagtatacaatgacagagttgaccacatgacccataaagcagaaaatatctagtatcggtcctttgcagaaacagtctgttgatcccttatatagttggtagcacaactgagatatcagaatttaggcttcttgacctccaatactgtgctttcctaattacacttgagacttgctctctccaaacttaattacaggaagagatgattttaccagtgtttaatcaactagaaaactctgggccgggcgcggtggctcacgcctgtaatcccagcactttggaaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgggggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaaaaaaaaaaaaagaaaactctgttaactggctcttctatatgtccatatacaatgggttattcattccatagttattaccaagagacatttgaatcaaatatcctgatttggagtcttcacattaagcatgtctatatgcaatttctttcaaaaatgctaaatcgggtattgtagaacattaatgttctcaggcccagcagcttgtggataagaaaggattcacattgacatttacaaccagatttgctggctctttgcctccatctgccatgcaagccttcagacccatgcaaagtcctgtctacctaaatgattgtgaaagtctctagaggaacttatggcttttcttctcagaggtctcatccaggaacactgaacagctctgcagggcaaatactgcctggtttagtgtgttgtccatctccttgaacttctaagctataacatcctcggggtggggagatggggagtagaggtgctaaaataagatggatttccctttagcattcacagcactggatctcattggaatcccactccttgctgcacacagcagaagggatgaatttattcttccccactcactgtatgtctgtggtagtagttctcaaagcataggccagcatcagcataacctaggaacttttcagagatgcaagtcttggctgggcacagtggctcacgcctgtaatcccagcactatgggaggctgaggcaggtggatcacctgaggtcaggagttcgagaccagcctgaccaacatggtgaaaccctgtctctactaaaaatacaaaaattagccaggcgtggtggcgggtgcctataatcctagctactcaggaggctgaggcaggagaaccgcttcaacccaggaggcagaggttgctgtgagccgagattgcaccactgcactccagcctgggtgacagagcaagactcagtctcaaaaaaaaagagagagagagagatgcaggtctcaccccagagctagtaaatcagaaactctggggttgaagcccagtaatctatactttgcgaagaactgggtggttctaacgcatggtaatttttgagaattaagttggattaagaccaacacttttgatctccagtttccctccttttccccaatgtagtgatttgtgtataaatacggtgacaataaaaccttctatccccaatatgcatacccctttgatatgcgatgtggcatctcctcctttcacgagatgaagtaatttcctcatctcttgaatctgggctgatcttttgaggtgctttgaccaatataacttagcagaagtaacctacacgtttcaaagcctaggcatcagaaggtcttgtagcttccacccgccctctcttggaaaactgccctgagaataccatgtaatgaagcctaatctagcctacaggatgatgagtggccttatgaagaatcaaggttctgcaaccaacagccagctgtcagatatctgagagagtgcattttagaccatctagctcctgttcacttgctagataactgcatccacataagtaacaccaagcaagaccatcagaataactatccagctaatcacagagcaaacttcagacacacagaattatgagcaataaatcactcgttttgaactgttaagttttggggtgcttctatgcaacaatagaaactgatatggacaggtgtctaagcaacaacaattgcaagttttgctttttttttccagtatgttgatttgtcctgataattaaaacaatttatacagctcaggcaaggccaccccattataatttataatttaagtaagcagccacaaggtagtttggtttagtgttcataaaacaaaacaagcaactttaggcctcagcttctacatctataaaagaagaatactcaactagataataattgcaataattattccaagtttggatttctatggttctaagaaattcaaatagagtgaaccaattttttctacttcttaagtagaaaaaacacagaaacaggccagtcaaggtggctcatgcctgtaatcccagcactttgagaggctgaggcaggcggatcacttgaggtcaggagtttaagaccagcctgatcaacatggagcaaccccgtctttactaaaactacaaaaattagctgggcatggtggtgcgcacctgtatcccagctacttgggaggctgaggcaggagaatcgcttgaacctgaaaggcagaggttgtagtaaaccgagatcgcaccactgcactccagcctgggcaacagagcaagattctgtcacacacacacacacacacacacacacaaagaaaaaagaaagaaagaaaagaaaaaacacggaaacttgtatcacttttactccagataaatttaagattgagttaaattatattaactgctggccagctgcatctgtatctgtaattttccattaggttcttggacagagagatagtgtaaagcacagccacaaaacaaaacacaggctgtggagcttgacatgtggactgaaacccttgcttgcttgctttctagctgtgtggccttaatctagctatctcccctctaaacctcaggctccttaatctttaaaaattatctatatgttctttgcagttattttgaggataaagacatatatgttaaagctacaagtatatgtgtagcttctacatatttaatagtaggaatgcaatggaaacaatctgctataatgaattataaattctattacattgtaatacagtacatgaaataataaacatatacaagaagcataatacaaattagattttctttttttatattgcatttatttctgattaacttcctgcaagtcaggaagtcgggaatagaaacaattctttattctgatatttgaactaccacagtaaagaaaaaagaaaatcttattttaataaaagcagctctgaatttaaatgactaccttttgttttttttttcattcaacatttgtgtatttaacatcttgacttaatgctcagatctgtttcggtttgctaaagaggatgaaaagcacctgcttttgagaaaattcctctttcccttaattcttttttagctactaccacaactctgccagctatcaccaaacagctttgagctgagggcattcccagactctccatactggcagcaatgtggaggacataggagaagacaagagtggtggggggtgatgagaccctcatgttggggagaaggaagtagggcagtgctatgaaagatgagtatctctcatggcttccatcacacttcccctgacccactcctctagtctcactgatctccttaatattccgtcatcttgttcctacttcagtatcgttgctcagtcttttctctccctgcctggaataattttcccagaaatacaccaggctcacttcctcacttacatcagttttctgatgttctcttaacagacaagcttccctgaccacactatagacaataataccctcatcccatctccctgcttagttgttctctgtaatggtgtttctcaaatgtcagtgtgcacaggattcacctggggattctattaaaatgcagattgtgattcagtgggtctaggataggggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaatttatgaataccttctatcaacaactgaagaggaaagaaaataaaatagactgaaaatatgcagtgaaaacaaaagttaaaactacagctaaatgaggaaatattcctcccccaagtcagcttgtggtcctcccaatccatttttctttttcttgaactaaaaatgggagagctcttaaattgtttgcaaatgggacagggagaggtgctagtaggactgtgtgtgtttctgtggtttctgtgatttttgtagacatacttgtccctcttcaggaacaatgcacacatccctggatgctaggaatattggttgttaatggtgttccttactaagaattgccttcggcctcagaaaacttgtccaagttgtccttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcataaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggctttgaaaaatttagtgaggtttccacattttttttcctttctattgctggaagcagaagactcttaggtcctacggcaaatctttacaacttactgaggagagaattaagtcctaacgccctagggcagttgttctcatactttaggatcaacagaatcacctggagaccttgctaattgctgcatggtagccccggagttctggatttagtagatactgggtggagcccaataatttgcatttttaacaattttccaggtggtgttgatgctgattgttcatgacaaaatcctaagatatctattacacctaatcagttacctgagcatttatcatagactagatatgtaccattcttgagaacataatagaccctcagatcattttcaataggatttcatcctcttgcgaaacccgagcagagaaaagctaccaagggaatggcaggcagaggaagaagatgaacaggacctaggtttctgcaataacatatgtaagaaagctgcttgactaggaaaacatacgctgggttgtcatgtgagcaagaaaagaactcctattgtgttaagccactgaaatatttagttcattacaagcagcaataccttaccagtatagtagcactagtcacaaaagctttaccagtgcctataagagataatagctgcgtttttgtatcactgtaaattcctatgcttaccttatgaggaatacaaataacttgattgatgtcgggtttggttaaaataaatacattagcagaaattgcatttctagtctgaagaatcagagttggaaaagagccagaaactacaaactctttaaataggaatggaatgaacccaacctaactggaatgtttcatatacacgttgtagtttaatgctaatcattaatttaatgcgaatcatttcaatgaaaccattactttatttattccagaaaaataattgttcaggtgctactctgtgccagactttgtgccagttactaagcttacaaaactgaagttcgtaacctctaagcattcacagacatgtaagtaaattagaacagagattttaggaaaaaataatgatttcaacaagacacctcgggggaacagcttaactcagcctggagaggtcaataggttacccacaaaagctaacatttgaatttattttgaaagacgactaggaagttttcagaaggggccattcaagcgccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctaacatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgaggtttctcttcaaataatctgatcaatcttttattctttaattcatagtaccccctgatttttctcctttttcctttttacctttgttagatgcccaggcacacctcagtaccagctcacattcatttccttatttggaaagaggactaactttctagctcattacagacgccccttccccttcctctccacttgattttacgtgcccaccctatctaaaaaaatcaaatgtttagccaactgggattagtttagattgtacgacccaaccccagccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcctctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcgggagagcagtggcaagatctcggctcactgcagcctcgacttcctaggcaatcctcccacctcagcctcctgagtagctactcagtactactactgagtagtactactgagtacatacatttttatgtagagacggggttttgccatgttgcccaggctggtctcaaactcctggactccagtgatctgcccatcccagcctcccaaagcgctggaattacaggtgtgagccaccacacccagccttattaggcttttataaatcctgaaccaaactgtatttaaaaagtaatctcatagactagggtcacaaattcaggtccctatagggactaggttgtaacaaagggaagaataagccttgtctaaatcagagagctataacttcagatgtggctgctgactgccaacagaaaggtgggcataagttaaaaagcaaaacacagaaaaacaaacaaaaaaccctgctgatcatattccctcaccagtgtataccggagaagtttctctcacattcttaaggtcataaggaagtacaagaaagtttgttgctgcattgtggggaattgaggccaacatgggtatgtatgtgaaagaaatggataagggtatatgtagagcaatgtggatggatttttttcttttttttttttagatggagtttcactgttgttgccctggctggaatgcagtggtgagatcttggctcactgcaacctttgcctcctgggttcaagtgattctcctgcctcagcctcccggtagctgggattacaggctcgcaccaccacacccgggtaatttttgtattttgtatttcaccatgttggccaggctgccttgaactcctgacctcagatgatctgcccatcttggcctcccaatgtgctgggattgcaggcatgagccactgcgcccggccatgggtggatctttaaaacacaattatgaatgttagaaaagctaagaaacaagatttatagcacaatgtagcttttataaatttaaaatatacttataaataatatattttaaaaggataaagcaggaaagaaacaggaatagagatattattgtcacatttcagtaattttgctaatcggttattaaacataaccattaatataaattaaattttataaatataaaataaactgtgctaagaacaaaagataatatatagtaagaattcatcacttcctaatttaactatcatcagtgctcttgagactatgtctattgtgtctgacatcaagtcaaatcaaggctttcaatgtttttatccagaatgcatgatgtaaatatttactagcatatcaataaatgtaacttttttatttattaaaaatcagtcttgaacccaaaagcaaacaaaaaataatgcctctgattagtcaggaaaaccacccttggaagtcatcactcacggaagatattttcctgtcctgacatcagaacctaaacactaaaaattaaatattctaagagactagtgagtaatatatttgatcttctggtttccctgtgaagtttctgtaaccctacaaagacagaatactaaaagcaatgagaagtaatcattctgataacagaaagtagcaataggagacaatgaacatgaaaaacttaaaactgagaaatgtggtaatcttagtcatttatcaatgaaatgacctttcaacatgggatgaaatctcatcctacaccatttaatttataggaaatcacctatatgtgctgagatagagagaaaaggagagatagtgatagattagggattgatttaaatactgctgggggtatgcccatctttccactcagtaagcatattgcccctcagaatgaggataaagagagatcaaagtttgctgtttctatgtttctaccagttgacttaggttccactctcttctcatggtgtaagtatctcagtgatttgagttagctttaatacttaaaggtatgtatttatcttacagtctagcttctaaaagcaaattaaccacttcaactgggtctcaactgaagaaagggtgctttgaatttcatgttcctcatataacactgtatcactaaacagagcaaaaattgatgtgataacgacacccctgaaaattaagaaaagttaatttacattgtgatttagaatcagaagtcttaggtttcgttcctaattcactactactggttgtgtgatccttggaaaatgagatgggtcactaagatttatcatccttgaaacatggatataataataccacctaactcatagctttgttggagaaactaaacgagatattttatatggtaaaaatgctgtgaactacaaagcactataaatttgttggttagatattatgcgctgctcaatgaagcaaaacagaagatattcaagaaaagttctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtataatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaatttaagcagtgctcaatagaaatctgtaaaaggtaacaatttgcaatacatgttaatcatctataagcaaatttaaggaaatcaaataagtacttaaatcccaacttatttaaatagcgtatcagtgggataatagttatcaagtcctattcttgactacatctccataattttaaaactttgaatatgctaactaaattgcaggtccaaggttttccgcacaagagctccaaactcaacagagtgaattcgtgttctaccaaaatggataaactttgggaattcttttgtttgtaaatggaaaaatcagatttattataggtgacttttgcagctgagcattattctccattgtatatactttgcttgaaaatattcattaaatgttaagacaactatatcaaactatgaaatttctgctttatgaagaacaggaattagttacaagaaaaagtgatttctgaatatagctttccttttaaaatttaaaatggataaatatttaaggtgatagatactgcaatcactctgatttgatcattatatattatatgcttgtatcaaaatatcacttgtggtaaaaggacggaaaaagatactccatgcaaatgggaaccaaaagcaagcaggagtagctattcttatatcagacaaaatgggctttaaagcaataaccgtaaataaaagataaagaaagacattgtataatgataaaaggattagtccaacaagaagatatttactacagtactcaatttatatgcacctaacactggtgctcctagctttataaaacaatagtactagacctaagaaatgagatagacagcaatgcaataatagtgggggacttcaatactccatttacagcactagacaggtcactgaaacaaaaacttaacaaagaaacaatggacttaaattacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaaccaaggaaagaagagagaagattcaaataagctcaagtagaaatgaaactggaaacactacaacctacatcacaaaaatacaaaagatcattcactactactatgaacacctttatgcacacaaactagaaaatctagaggaaatggatacattcctggaaacacacaaccctcctagtttaaatcaagaagaaatagaaaccctgaacgctttggctgggcgcggtggctcacgtctgtgattttagcactttgggaggctgaggcaggtggatcactaggtcaggagttcgagacctgcctggccaacacagtgaaactccgactctactaaaaatacaaaaattagctgggcgtggtggtgggcacctgtaatctcagctacttgggaggctgaggcaggagaattacttgaaactggaaggtggaggttgcagtgagccaagatcatgccacagcactaaagcctaggtgaaagagcaaaactccatctcaaaaaaaaaaaaaaaaaagaaagaaaccctgaacataccagtaacgagcagcaaggttgaatatcagtaatttaaaaattgccaaaaaaaagtccaggaccagatggattcacagctgaattctaccagacattcaaagaagaattggtaccaattataatgaaactatttcaaaagataaagagggaatcctccctaaatcattctatgaagtcagtatcaccctaataccaaaaccagaaaaggaaataacaaaaaagaaagcagcagcacaaaaatagcagcacaatttgcaattgcaagatatggaaccaacccaagtgtccatcgaccaatgaatggataaagaaaatgtggtatctatataccatggaatattactcagccataaaaaagaatctcttttgcagcaacttgaatggagctggcagccactattccaagtaaagtaactcaggaacggaaaactaaataccatatgttctcactcgtaagtgggagctaagctatgaggatacaaagacatacggagtgatacaatggactttggggactctaagtggggagcttgggagtgaggtaagggataaaagactatttattgggtacagtatatagtactcaggaaatggatacataaaaaatttcagaattcgccactatagaactcatccatgtaaccaaaaaccacctatacccccaaaactactgaaattataaaaaataagcaaaatataacttgtaccgcacaaataaatatgtacaattatacacatataaaattaaaaataaaaaaaaattttttaattaagtttcctaaggtagctacaattgtggctgctttcttgcctcatattttttggatatttaaaaaatattaaatgatttttatgttttctatcattaagacaaggaaaaaagccttctagaaatagatattatttgatgtagaataagtaaggaaaaataatgtatttgtttaatacaatcataaaaaatcatttgtttaaaaaagtaaactagaatatagttttaaactctatttgagtttgagattttcaaaatttaaaaatatatcttgtgtcaatggttggcatgcaattaatatctactgaataaataaaggactctacctacggctgtatatatacaggcatacattcgaatattgtaactgaaacatctatgtctctttgtctctctctttaagtgtaactaatacaactgaggacaagaggtgaaattcaaatctctaaaatgcttccctaatttcagcatgagctactgagtacatgagacttttcactcaaatattctctcagaaaagaaagttggctcatattcaagactttatactatctcttatgtctcaattattttattcggaaccacaatgttgtatattagcctgaaataacctcaagagatgtgatgcttacataagtattctgacagaatttgcttaattaaaaagggaggcaaagaaagttgataaatctttagcaatcattcctaatgtatagcttcacaatcactcgtggcagagatcattgtaaacgagtctttcaaagaatttgttaaaaagccaaacaacttaaaaagcagaaagaatatgttagtctattgggaatttttaaaagatcacatctggctgggtgcagtggctcacgcctgtaatcccaggactttgggaggccgaggcagcctgatcacctgaggtcgggagttcgagaccagcttgaccaacgtggagaaaccccatctctactaaaaatacaaaattagctgggcatggtggtgggcgcctgtaatcccagctacttggaaggctgaggcaggagaatcgcttgaacctgggaggtgtaggttgcggtgagccgagatcgcgccaccgcactccagcctgggcaacaagagcgaaactccgtctcaaaaacaaacaaacaaccaaaatcatatctaagaaaaatgaaaaaaacagttttcctaatattttgtgaatgggtattgaagtttgggataaaaatttcagcgacagcattgagaacgtgaaaaatagctctgctgatagctggcagctggcagctagctaggccatgatggtcccagctggatgttaaaaaacactcatagaaataaactaggcagacacaaggccaccccatggccgtgtttgaaacaagacagagacaaggcctttctgctatcacagaaatgactaatatgaggcattgctgctcctttaccaacgacgtgtctagccctactttaatctcatcttctagataaacactaagatacctaatcactacattgactctgtttcttgaaagcatctaatccagaaatggcttctactttctgaattcctccttagaatcatgcagccagctgaactctgtaagaagctttttccaatgccctcttactgagatgcccacactctgaagtgttttacgctcttgctgcaataaggtaaatattcttaattttttgattacagatatgttgcttgtaatcttggccagagggctttcagagtattatgtagggattcaaacaatgccatattacaaataacttagcaaggtgatgagctctacaattctagaatatacatacgaagggtttgaatgaaattgtttcataaaatataaatgtgccaggtatttctaaatgagtgtgttattttataaaatgtaagactgcaaatatggaaatgctactcaattaagaaattgaatataattagacatttgacaatctcatccatatttctaaatgtttatgtttacaagttgcccaaaaatctattataaattttttctcttctcattgggaaagtgaagctctcctcaagtttatgcattgggattagcatttattcaacctcttatactccaagacttttttttcagttgtaaagcaaacttgtatttatttatttatttatgagatggagtctcactctgtcacccaggctggagtgcagtggcgtgatctcagctcactgcaagctctgcctcccgggttcatgccattctcctgcctcagcctcccgagtagctgggactacagatgcctgccaccaagcccggctaattttgtttttgtatttttagtagagatggggtttcaccatgttagccaggatggtctcgatctcctgactttgtgatccgcccaccttggcctcccaaagtgctggtattacaggcgcgagccaccgcgcccagtcgcaaacttgtaatttaaaaaaataaaatgttgctatgcatttacttataaattattaaatgcctctaatattgttatcttctttctagaagtcctctcccaacttattctggtgttattggcatggaaattgtgctcaataaatgagtcagtcaaaatagacttgttcatttcaggggacaatttttgtctgttatctctctattgatttctgttgctacaagtgaagttacaccaggtaaatgagattgtacgcatggcagatgatttatgaaatccaagtattgttttaagtgtaattatatttatttcggcaacatttcgaccaatgaaataccatttgacctgctataccgtggataaatcttgagatgcacatcttttgtgagtaatatattaaagattgttaggcaaaaaataaaccctaaggaagtttttaaaaatgttaagatgttgatgttggcagtagaacaaactcattgggagaaaaaaaaacagcttcatctagttaattaacaacaaaacagctgggaaaatgaatcatccctggttgtgactgactgtaattgaaaatgactaatgatgctgtcattttgcagttcatatctgaggaaatgatgcctggaagattataattgccctcttgaccatttgtctacagcaattattttgtgttaaaggttgggatggaacgctttggccaaatacagaaagttcctcacacctttttctgttacattgaaaaataattcaagagcagtaagtaaaacatattactaggtttgtgtaagtaacattttttgataatataaaaagttagcaaagcaaaccagctggcttcattttatcactttagaaagtaaccaagacatttaaaattccattaatgctctcagttctaatacatggcaggtgatgtaagcattgaaagtacataaacatatttttaaaagttaactgaaagtgtagttttccaacttaagttaaaaatgagtatgaatacaagaaaatggcacctaaatgcttaagctcaagacagttaaaaatacaattttataataaaaatcaaataacaaatggcttcttttgtagtttatattgttgttactgatagcagttgtttttgctgcttttaaactgctaaatggggtgctattgaggacctagttattactgtgtggaaaaatggaacacattaaagactatttcatctatggcattaatgtaatatattataccaaaactataactttagcaaaattttaaacaatttatataactcatatagtcagtcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctatacgtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgctccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgatatatggactcaaagtttaaaaaggctttgttcacgttctatcagagcaatggagtgtccttcagaaaaatcatctctaacctttaaaaataaatttttgatccatgcagagatttaaacagccctcacagctttctgccttgtattgctgggtgtcatgttcaaaactgtgaggtcattttttgagcctctaggtgtttcaggctaccgcaaaccccagctaatcttcagatgtttccaaggtcatggtccacagcaaaagttgtgcgtgagtcaactatttttttaaaccccataattctcaaatcattcttgcatttttgcccctatcaacttgatatatatatattttgagacggagtttcgctcgtgtcgcccaggctggagtgcaacagcgcgatctcggctcactgcaacttctgcctctcgggttcaagtgattctcctgcctcagcctcccaagtagctgggattacaggcgcctgccaccacagctggctcattttcatatttttagtagagacagggtttcaccatgttggccaggcaggtctcgaactcctgacctcaggtgatccgcctgcctcggcctcgcaaagtgctgggattataggcatgagccaccatgcccagccaacttgatatgttgatttttctccaaatccaagggagaaatgggaagacaggaataaattttcccttaagttcagcttctcccaatgtgtcaaattgagagaaaatagggaaacagggaaggagaaaaaaaaaaaggaaggaaaaaaacagtgctgtctgctacaaaaatggttttaagggttgtgaaagagaaggaaagcaacagctcctggttctttctttttatttcagaaaagtaattctccttttacatcactaatgcatcagcaggaagcagatatgctcaggcatggcagatcccagttctgatctccaagtggcccagtagttgagtgtgtgggtggaggtgcgataagttagcatcaagcatttggattgttttatacataatgaaagcaaaaattttctcagtggcttttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgaggaataaggaaaatctagttttacttactgaattccaaataggtccccagccactataaattcacccttgaataccgcatttgcaaaaaaacattttggtgtagtaaatggtgatatggtctcaaaatactttaagagaaaataaaatatattattctaaggaagtagagaaaagagcatatcttcagcaaggtaaaaatgatttaagaaaaggaaaaaaagtaactgaattttcaacctatacatttatcatttatgtataccataaattaccaggccaaatatacatgtacaatgtctaaattatacatttgaaattatatatgcattacacatataaactgacaagttaacttaaagcactgtcaccaccattcattttgtatgtgtttctctaagacaaagcactattttctatttattcactgacagctgggacttttcttgtgatagttattgatatagctaattactggtaatagacaatgttttctgattagcttcatcatagctgtagactatattattgatgatagcatagttaccattcgtataatgactactatttgccttccccaaccctgattccaacagattgccactttacagataagaaaatgaagcaagggtgggtgggatagtagtgacggtagtgacaatgatgtgaatagcttgcccacaacctcgtgggatgtgggagagttaatattcaaacacagctaggtctgaatccaaagtttatactattggcagtagtaacagctacgtcttcatatcttacaacaacttaataacatatccaaatgatttgatcaaattatgttatttctaagcattaagaaattttactttcaccatctgaatctgtttgatattatcacatatgctgaaaaacatgccctacctctctgataatagagaatcactatgggtcagagggagacaggcaacttaatgcaacagtcgtcattcccattcattggaatttttgaaaaatgatagcaaagaccattgttcccactgccaacctacagtcttatttaaactgttccaactcctttgcttcctccttcaaaacacatcacaattaatcacattatgtgtatatgtatagttttgaccattcctaaagaattatcctctatgagagtaagacccataactaccttgttcactcatatccctggaagtgcctaacacatagtaagtgctaaacaaaaaaccgttgaacgggcaaataaatactgttgcaactttgagcctatgggaattgagttaagagtgtgtattactagagacatttgttcacgcagacagtcgaaaggttcatggcatagactattttctttctaaataatctgctagagttaaatacagagtctactcttctgcttttggatttcccgtaatgattttttttgcaaaattttacatcttcacgttattgattacaacaatgtctcagaaaactcatttctatgacaaattaaaatgggattattttatacttaattaatcctttcattgacttcctttaaactaaaattccatttatcccacatttttcttcttagctgaatttgtataatttaatctccatctagcaatccaagagaacatcacaaatacaaatgttttagcatttatatgatttagcatgaatattttatataaccaacatctgaatgtgggacctctaatcaggtactttataactattgcacttgaagcatagtaaacatttattagttttgatttgtaattccagtagaagagtaaacttggaaaggctggaggatcatatttcctatacaaatctaaaaacttctatgagtattaaaacctgtgatgtactagcatggaaaagctcatctttcctttcaaacactcccacttcacttttctttttcactcatcgagcataggaagtcaatattctcctcatattcccttaaatttaatgtgtccctctgtcccccaatacagatcatttgtatttgatacatttgatctaacttttgttttcatagtatttatacattaaaaccttttgcactgaacaccaaactacttatattattccaacctttaaaaaagatttatatttctaaaattggagtgcgtattcaaaagatacctgctgcatcatctattcaatatatttataagctagagattgggatacagcactagaaaattttcaatttacaatatgaatatatgtgtgtgatatacatgtatatacatatatgtgtattagatatgataaatacacatatcaacatatatgtataatatgcacatataatacacatacacatatgtgtgagtggatatatagacacatgtatgtatatgtacaggtatacctcattttactgagttttgccttattggctctgcagatactgctttttttttttttttttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctctccttgggcctccctattctgagacacaacaatattgaaattatgccagttaataaccgtactatggcctctaaatgttcaagggaaaacaagagttgcatgtctctcactttaaatcaaaagctagaaatgattaagcttggttaggaaggcatgtcgaaagccaagagaggctggaagctaggcctcttgtgcccgttagctaagttgtgaatgcaaaggaaaaattcttgaagaaaattaaaagtgccagtctagtgaacatgcaaatgataacaaagcagaacagccttattgttaatatggagaatgtcttagtggtctggacagaagatcaaaacagccacaacattctcctaagccaaagcctaatccagagcaaggcccaattctgttcagttgtatgaatgctgagagaggtgaggaaattgtagaagaaaagttggaagccagcagaggtttgttcatgaggctttaggacgaagccctctccgtaacataaaagtgaaaggtggagcaacaagtgctgatggagaagctgcagcaaactatccagaagatcaagctaatatctaagatgatgaaggtagctacactaaacaacagattttcagtgtagatgaagcagtcttctattggaaaaagatgccatctaggactttcatagctagagagaagtcaatgcctggcttcgaaagttcaaaggacaggctgactctcttttgaggggctaatgcaattgatgactttcaattgaagacaatgctcatttactattccaaaaatcctagggcccttaagattatgctaatagactctgcctatgctctataaagggaacaacaaagcctggatgatagcacatctctttacagcatggtttacttactgaatattttaggcccactggccatacctattgcacagaagaaaaaatctctttcaatatattactgcttgttgataatgcacctggtcagccaagaggtctgatgaagatgtaccaagagattttgtttttatgcctgctaacacaacatccattctgcagtccttggacaaaggagtcatttcagctctcaagtcttattctttaaaaagtacattttgtaaggctatagctgccctaggtagcgattcctctgatggatctgggtaaactgaaaatcttctggaaaggactcaccattccagatgccattaagaaaatttgtgattcatagaaagaggtaaatatcaacattacaaggtgtttggaagaagtttattccaaccctcatgaatgcctatgagggtccaagactttagtaggggaagtcactggatgtggagaaaattgcaagagaactagaataaagtggagcctgaaggtgtaactgaatggccgtcatctcataatgaaacttcaatggatgaagagttgctacttatagatgagcaaaacaaagtgttttcatgagacagaatctactcctggtgaagacgctgtaaacaatgttgaaatgacaacaaagggtttagaatattctgtaaacttagttggtaaagcagcagcagggtatgagagccttgacctcatttttgaaagatctactgtgggtaaaatgttatcaaataacatcacacactacataaaaatcttttgtgaaaaaaatcaaccaacatagcaaacctcatggttgttttattctaagaaattggcatagtcactccaacctttcaacagttactactctgatcggtcagcagctatctccgtcaaggcaagaccctccatcagcaaaaagattaagactcattgaaggctcagatgactgctagcaagctttagcaacaaagtatttttttaaataatttcaactattgttttagatttaaggggtacatgtgcaggtttgttacatttatatatttattgggtgatactgaggtttggagtatgatggatcctgtcactgagatagtgcgcaccgtatctaatagttagtttttcaactcttgccccttccttatctcttcccctactagtttccagtatgtactgttgccatctttatgtccatgagtgcccaatgtttaggcccacttataagtgagaacaaagtggtatttggttttctgttcctactaattcatttacgataatggcctccagttgcatgcatgttgctacaaaggacataatttcattctttttaatggttgtgtagtatttcatattgtatgtgtaccacattttcttcatccagtccaccattgatggtcatctaggttgattccttggcttttctattgtgaatagtgctgcagtgaacatacaagtgcatgtgtctttttggtagaatgatttatttacttttggatatatactcagtaatgggattgctgggttgaatgacagtgcattttaagttgagaaatccccaaactgctttccacagtgggtgaactaatgtacactcccaccaacagcgtataatgttcccttttctctgcagcctcaccaacatctattgtgttttgagtttttgataataggcattctgactggtgtgagatggtatctcattgtggttttgatttgcatttctctaatgatgagtgatgtggagcattttttcatatctgttagccacccgtttgtcttcttttgagaagtatctatatattcatgtcttttgcccactttttacatggggttatctgcgttttgcttgttaagttccctatagattatggatattagatctttgtctgatggatagtttgtgtatattttctctcatcttgtgggttgtctgtttactctgttgatagtttcttttgctgtgtagaagctctttagtttaattagatcccacttgttaatttttggttttgttacatttgcttttaaggacttagtcatgaattctttctgaaggctgatgtccagaatagtatttcctaggttttcttctgcgattcttctagtttgagattttattgtattgtattgtatttatttagggacggagtctcgctctgttgtcaggctgaagtgcagtggcgcagtgcaatctgggctcactgcaacctccgactccctggctcaagcggttctcctgcctcagcctcccaagtagctgggattacagggatgcgccagcatgcccagctaatttttttgtatttttagtagagacggggtttcaccatgttggccaggatggtgtcaatctcctgacctcgtgatccacctgcttcagcctcccaaagtgctgggattacaggcgtgagccaccgcacctggctgagattttatttttttaaatctttaatccatcttgagttaatttttgtatatagtgaaaggtaggagtccagtttcattcctctggatacggttagccagctatcccagcaccgtttattgagtagggagtcctttccccattttttttttttttgtttactttgttaaagatcagatggctgtaggtatgcggctttatttctgagttctctattctgttctactggtccaagtttctgtttttgtagaagtcccattctctttgggtaactgtagccttatagtatagtttgaagttggttaatatcatgctttattcttttcacttagcattgtttttactcttcagactgttttttagattcatatgaattttaggatagttttttataattctgtgaaaaatgacattgctagtttgataggaatagcattgaatctgtagattgctttaagcagtatgtccattttaatgatattgattcttcctttccattaacatggaatgtttctccatttgtttgtgttatctatggtttctttcagcagtgttttgtagttagccctgtagagatctttcacttctttggttagatgtattcctagatattttattttttgtggttattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctccctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatcaccaagattttataacttgggagaaactgtctaggggtacagggaagacagaggagcctgtccctatatggaaggaataatgttttcaggttggagacatgagtcaagatgcctgtgattaacactgatgcaaatgtacagaaagtaattgcaaaaagaagcgtagtgtgcagattaggggtaaggctaagaatacaggtttggaggtaaaaatagtagttggacaatattgtcccagtgatacttgtagagtgactgaagaggatagagccagaattaggtattcgcctccacaggataagagaagaaagttgaaccaagaaaagatagaaagagcagaagagactgaaacaagaacatgtaaaaacccaaaatagaagtgaggagagaattatatgaaaaggggtgccaccatgttacatattacagataagcaaggaagctcaagaaataatacaaataataatactgaatatatccttcattggaggttaaatgaaataaggttttatatccaatgttctcggtttactttgtaaatactagctcgtggtcccccaaatttactacatgttcccatttttaaaattcagcaaacagatttaggtaacaacagtaaacttactagatatatcttacaatgggagcaactataacaaggtgagtaaaacaaatgaatgggaacgtttgctctggaaaatcaagaaatacacacacacacacacacacacacacacacacacacaatctttaaggatagttattaattatggaagaaacaaacctaaaattatgagagtattaattcatcctatatgataaaaattcttaacattttaaaaaagtcttgcaacactgtaacaaattcaaaaggctggatatttcttcctttaaaattgcttacaagtacaatccagtgaaaattctgtacctttagaaaatgaacagaaatagtcaaaaatttcatctgtgtttcttgtgtgcagccaaatgactagcatccttctctatccactccatattcttcaatcacccataaatagttccaaaaatcatgaagaatagataccactactcagaaggcactggcagatagataggatcaggagtctgctttgacaactacaaggaatttccttaagacatccacatacaaattttaattaataaaattgttattggcgaataaacagaaatggcaacaaggctggcatttgagtagtccaagtattacttagagctccaaagtactaagtgggtgcttgctacatgatggactgaagagcaggtggcatgccaaatgaaatgtccatatttttcacttgcaggaagtagaatattccctgttcaagtcaccaaaatagccctagatttagtcctctggtgaatgaacattgcatactcacatcatttccctctattgaaatgtttcctattaccgtgtccttctatcatcactattgtcatcttttcatccttcaatgacatagtacagattttaagtacccatatgagatttattctcagttctatagaaacagagcaatgggtgaaagaattcatttcagctctaaattctttgtggctacttttccttggcacatttttggagaactggacctctaattaaatgcacctttgatagatcactttagaaagaccattttgaagataaatttctacaatttacctcactacatttatttgcaggttgaatttattagttcaaagataggtcagttattaagggcaagatactattgcttgaagggtcaactgtagtaaatccaattaacttcactgaaaatattctttcgtacatattttcttcagtgagtataaggaaaataaactgtaagaaactgacaattatcctaaaaattaaagaatatgtgaaataaattgtaaaatttgttatttctccatgcaaataaaatgtgacatagaaaagctaaaaaacaaagcaagaaacaactccaaagaaaccacatgagatggaaagatcagaaaatgctactaaaattattagctgtgctgaaaatggcaactaactgctatagtgatattaactgctgtgataatattaacaagctacagttgctaaaacatttattatatgtcaaacactgtgcttttcatacacacatacactcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaatttggtgttcttagaaatagtacaaaaaggaaaaaattcttccttgttttcctttcttgtactcaatttctttaaattttcattttacctactaataaccttagaatatatgattatatatatattaagaatatatatctcaaagcacattataaggaggacataaacaacctttccatgtatgttcaaacatttatttatttatttatttatttatttgctcattcgacaaacatttattcagtgcttactatgtttcactggggtaggaatggggagtgcagacacacaaatatatactacatttagagcaggtcaggtataacaactagtaaagtgcaatgtataatggagcacagagcaggaactgatcacttttgtgtttgatagacaagaaggtcaggacagaaaggctgggagcagaaacagctcatgcacctcattataaggggatggacggcagagagaatgtattccaagagggaacatggaacatgcaaagacaggaagcagaagaagtacggagctatcacgtaggggaatgggaagtaatggagtagaaatagaaagcaaaagccagagaaaagaaggatcttgtataccaccctcagaactgtagtggagaagctacaagagttttaaataagggaatggcacttatgttttccaattgatcttctaaatatatatgaatatatatttataaatgaaggtatatgaatatgtgaataaatagacataagatctactattaatgcttggttttctaatcaaataagctgatctgaatgagatataaatattgctacagaaaaaagaaattcaagataaaaatgacaacttttttgtaaacattaagtgtccattcacttaattttttttaacttttattttaagtacacgtgcaagtttgttacataggtaaacttgtgtcatgagggcctgttgtacagattatgttgtcacccagatattaagcctagtacccattagttattttttctggttctctccctccgcccaacctccaccctctgataggccccattgtgtgttgttcccctgtatgtgtccatgtgttctcatcacttagctcccactcataacttacttacttataaggagtgccttctaccatttggctattttgtcaaccccacaattaacagtttttctatctaatctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaaaaaaaaacttagagatttatggatttcaaaaataatctgtccaaatatacaaagcataatgcagcattgatttttaaactggaaagtgttgtgaaactgtgaagatataatctactaagctgcatacttgaaatgttcaaggccagtgaaagagtgggcataggtgtgaccatcaagtaacatccagaagcctctatggaagctctccaccttaaagtgggggtttcaaagtctttttggcagaattcttttggcaaatgaaatattaccaaaactcttccaaaaaatcacttgagtcattccataaatattgacagattacttattgtctgctaaacattgtttgaggtactagatatgtaacagcgaataaaacagacaaactttttgtgtcctcataaaacttacattctaatggtgataatgtgtagtaaaagagaaattaaggtgctttggagagtgaaaagtgctaaagaacaaaatgtaaagcactggataggaataagagacttaggtatggggcaaagggaggtggcatgtggagagtttagaaagtgcctgcagggaaagcctcactgagtaggtggtatttaaataaagatctgaaggaagtgagggaacgattcaagtagctatctcaggaaagaacaatctgtgcagagacagcaagtgcaaaggccctggggcaggagtgtatgtgtatgttcaattaaaaaaaaaaggacaccagggtgagtggaatctagtgagcaaggggagagtagtaggaatgatagtcatagagttggggatggaggaggataggtcctgcatctttggaaggatcttggctgttatcctgagtgagattaggaagcataggagagttttcagcagaggagtgatgtgatctgacttatttttaaacagatcattctggctgctgtattaagattagactttaagaatgcagagaacagatggcagttaagaacagattcttaagggggtacaatctgcattgtttggatggaaggactttgtgaaaacctgaagccattattttggaaaactttatacatacagttcttaactaagggccaaagctctggtctggtttaatagcagcacaggacactgcttagaagaacattcatttaaactggtactcccaggtcttgctgccttcctaagtccttactggtgaagagtatgggctcttgagtctggttatctaggttccaatcctagcatgaattgactatttccaacagagaccaaatggcccatgaagcctcaaaaactgactgaaatttttctatttggccttttaaagaaaaaagttggccaacactgatgtagagaaacggttaggttcaggctctgtggctctaaaatccttcaagtatgcataattattccacaatgtaaacatatatcaaaacatcacattgtacctcataaatatatgtacttattatttgtcaattaaaataaaataaaaaatacaggggtatttttaataatcaaacattagaaacaaatgcttttctataaactccttatatagactcatagaaagagttaaacaatttataattagaatttatttgtttatttatttactattttgacacagtctcgctctgtcgcccaggctggagtgcagtggcatgatctcggctcactgcaacctctgcctccccagctcaagcggttcttgtgcctcagcctccagagtagctgagattacaggcatgcaccaccaagcctggctaatttttgtgtttttagtacagacggggttttgccatgttggccaggctcgtctcgaactcctggcctcaagtgatccacccatttcggcctctcaaagtgctgggattacaggtgtgagccactgcacctggccaatttgtaattatactttagagcagaggttagcaaacattttctataaaacaccatatagtaaatattttagactttgtgggccaaactcaaattctgccaatgtggcatgaaagtagtcaggtctaatacatgaacaaataaatgtggctgtgttccaataactctttatttctgaaaataggtggaggactaaatgtggcccttggaccatagtttgctgactcttgctttaggatattacagtgttgttggaaataatcagtctagaaataagaacatctgggttctaggcttattagcccatgagttggggcaagtcatttaactgctctaagtttcaggtttcagtatctttaaatataaaataaatgaaactaacagatattactgtgagtaaagggttaaaaacaccctttgtccatctgtatgagaatttgtactttgatcaactttctagctcccttctccctagaaaactgataaagttggaatgtcaaatgtgtgagcaggcaacattgcttcagattaaaaaaaaaaatgatggggactggtaaattacaccttggttaggtgttctacatatgaactataaatacctaatggaaaaccataattgtggggcgtccccaagtacaacaattcttgtaactaagcatgtcctttttgaggaccttggaaactatgttacaaggcattggcctctgggatgcataaggcttctaggccagggttgacccagcatctcgatttgtttccttcctgtgcacctgagatgtcatgagagagtggacaggtgctgcaaagtgaatagctcttggatggctccctgggtgcttcagagattgctacgcatactcatcctactaaagagagatacccgatgctaccttcctgctaagctatattcctatatccttctaagtgcctttgctactgaatgtggtcatagtattgttcagttgcacctaatcaaagaagacttactgttgtgttttacaataatcaattataagactcacattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatgatatgaatgtctttccttcctttctcttatatacaacattgtatgtaatgtcatctgttcatatactctttcagatgcacttttatcacgctatgtctcttaacattcatttgagtgtggttctgatgaattctaaccatcatggcatgtttcagtttctggctgaatgggtcctaatatctctggattatataccccaaaaggattagggaatacagtagatctaaggactagaaaggcacatattaaacaaaagtgattttgacatatctctgaatagtggccagtgatatttgcattattttaaaccaatatagagcatctctaagttattatccatatagtaattggacatggttctttaagtcttaacagaatatttacttaaatctgttattattaaacactagaagttgctttttaaagataaaacagccattaggctaattttcattaaaagcaaagaaaagagcaattcaattctgacttcatgactgacatgcactttaaataaaattaaagatgttttgtttttactattaggttctgtaccaaaatcatagtcattatctaaaacaactctttctaagtgctaccataactaataaactcaagcaatcaaatgggtaattgaattaaactcgtatttttttaaaaaaaaacagcaacaatatatctgcattctctcttctgaatactcttcctaaacatgtacaggaaacagcaaatatatgggtttctgaaatcaagaaaaaggacacattatgtaataaagccaattcctggtttactcaatatgtcagtcttcatctgtgataccaggtctttagactgttgcacttagcctttatacacttataactcatgatttccatatgttccactaagtagccattttcactagtctcctgaaaagtcaacgataagattttggataaggaattgtagacttatatattaggtgcatataatccagaactctactagaatctagaatatacagacaactcatattaatcggtaagagaaagtaaacaatccaacggaaaattggggtaaatatatgaagagtcaactcacagaaggaaaaatctgtccaacaaacttgaaaacttgttcaaccagggatatgcaaattaaaataataaattcctgccacttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaactgccaaatattcattgtgtcaagggggtcaccaaagtgttcagaatttggaaactgtagcttcagatgtattaaacatgcaaactctacttttttatatgtatcattttgaaattacagaacaaactgaatgcatttacactaagtaataattgaagcagttaacttggccctacggtgtttccttttcaaaatatatgtcagatatatacagagaagtgtttaatatcccctatatgcacagatacatatatcatatatatgatatatgaaatatataaggaatttaaattttctatatcatgaatcacatactgattcattcattcagtatgtgaatgcatgagtctaatcccactgacactattgctcaaaggagggtcaggaagaataggggggaaaatgatgtgaataggaaaacagtaagcatatggcaattttgaagtatttggaatacaaagttattataagttgagtacagctgacaaaaaaatgcatagtaacatcagctaactttgcctagtagatgataggggtacttatataaaatagaattgtatttgttaattagaatcataatatactcttcagtgatacagaacttaatatactaagtgaaatctcagtatatagaattgtatattcaagaggacatattgctatggcatttctaagccgtaaattcaacgcataaagtttggatgattacatcttcattggagagaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcatgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgacacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatggaaaatagaaattggaaccttttaatttctattgggtttgtttcttgtatgtcaagaggaatggtattctaactgcaaagaataaaacaaatagcagtgagagggaactggtgtccaagatgggtaaagagattagaaagcccccagctgctcagaattaactctcttgatgcagataaattacatctcagtatgctaatacaactggcaagtcaaatggcaaaccattgtggttactcatgaagactgggaaagtgcagttttgattttcacaaggaaaaataagtgtgggaataaaatgttaagcttccagatagttatttcagatttggctagaaaatgcaatgcaaagagaagccacaaaccttctttaggtaatgtattttgaaagaatgggagtcagttgacacaggctctttgcaaagacaaaccctgttctagccatcaatgtattgttagataaataagaaaatgaaagcaaatatttacatattagttaaaaattttttaaatctctacttgtgctacaatttgtcatcatgttgaacttctgtccaggattgatggctaagaagagcaaagaccattcctatgcaattcaaaggttagttttgatgttttcaggttataaccttaagactagaatctgtctgttgtagaaaacattcattaaaacctttatcatagaaaaccatgtttttacttcaagttgtaaactatatttgccttagtaagaaagagaccaataacccaaaagagaacattggcaaaaaacaaaaaagtagcaaacagtgcatagaaaaggaaataaaaatgattctgcaacacatgaaaaaattcaaattcactcacaaaatgaataaagaattcaaattaaaatgacagatatcaccatttttcttgtttagaagatcaaaaaggttgataacacactgagtgggcacgggtatggggaaaagaaacctttcctaatactgacgagatgttctatgaagagcaatttggcaaaatgtactaacaagacaaatgccagtttgacgcagccattcgacggctaggaatttatcacatagatatatttgcaacgtgtaaaatgatgtgcacaaagttatacattttcttatcttagccaaaagtcgaaacaaactaaaggctcactaattggagtgctgcttaagtgaattatggtatatccttagaacagaatagtatgcaactgtaaaaaaaaaaaaaaagagacagttctttaactactaatacagaaaataatcacctgtgtgtgtgtgtgtgtgtgtgtgtgtgtatatatatacacacacacacacagcattttactcttccctttcttataagggagggagaagagtgctatacacacacacacacacacacacacacacacacacaggcattttagtctttcctttcttatgaaggaggaagaagagtgcttttccttctgccctcgccaagccaaggaaaagggcttcaaaagaaccatcttttgaaggatgcagaaacagtatttatagtattctaacagctggctttattttaagaggacaagagtagaaaataatatacacacacacacacacacacacacacacacctacatcctattcttggaaggctacccaggaaactgaaaaccttggcagcacatggggagagaaactgtgtggctgaaagacaacaatgcaacagaggatttcaatgcttttgaattttgtactggaagaaagtatctattcaataaataaacaaaattattattattattattaaagatggagtcttgctctgtcacccaggctagagtgcagtggtgcaatctcggctcactgcaacctccgcctccaggttcaagggattctcctgcctcagcctcccgagtagctgggattagaggcactcaccaccatgcccagctaatttttgtatttttagtggagacggggtttcatcaccttggccaggctggtctggaactcctgacctcgtgatccacctgcctcagcctcccaaagtgctgggagtacaggtgtgagccattgcgcctggcctatttatattatctttaaagtctgttatacagggataaatttacccccaactttgtaataattaacccagtatgacatcactgatacagtactaattaactcattttctataaaactgtgcagattatcttaaaattcgaaacaaaaatgaagtacaatacaaatgataacaacagttccagaaaacaacacttaagcataccacacgtaacacaatgtaataacctgcgttatattctttggtaccctatgctatcttattctattttattttacccattaaatggatttcataactcatcagtgggttgtaagattctctcccgggcctgaaagcttaaggagatgagtaactcctcctttctcaggcccattcctaaggcacaaggctacttgcctgagcagcatgcaccggcgaaatagcagaagcaggaagagagccggccagaagacaagtacctctgaagatcgagaaagaggccatccgggtacaatgcagcagttacgtcaggccaggagacttcctgtttacaggagactataaaacctttgtccagtcctcacttggggctaacgccattttaggcctgaggctgcccgcacccaggcgctcattaaaacagcatgttgcggccgggtgaggtggctcacgcctgtaatcccagcactctgggaggccgaggcgggcagatcatgaggtcaggagatcgagaccatcctggctaacatggtgaaaccccgcctctactaaaaatacacaaaattagccgggcgtggtggcgggcgcctgtagtcccagctgctcgggaggatgacgcaggagaatggcgtgaacccaggaggcggagcttgcagtgagctgagatcacgccactgcactccagcctgggcgactgagcaagactccgtctcaaacaaacaaacaaaaaaaagatttgactggatttgttcctgtggtaggcacttcattccaattttcttgcccactttttggttaatgacagactttcttccgctttacaaaataaaagcacacctctctgacctatcccactggtgcattgtagtcaagatacatttatgccaaataaaagtacaattcaaaatattagcgactgaaatccttctttactcaaggtaccatcaaatacccatccatctcataatagattcattttcaataactatccactgagtatgtttaataattatttatcaaaaggtacatatatttaggttatttggttattactaagtgtatttattattaatactttaaatactactcaatctagagaattttaaaaatacttagagccttgtagtcacaggaaattgtttttaaaaattgaatttaagtccacataaatataattttataaagaattatgatagagtggctaataaaactttatagcataaatatgtatcacatatttatcacattagaatacaattcattggggaagttgaaaaatatgatttaaataaaaaggaataatataaaacttctatttattaaatatgagctttttcatgtatttttaagtatatgatggtagacattatattgcaatggtatttggattccacgggatacattctaaactgtactataaacccttttaaaatgtcaatatttactgtatcccaagggcagaaaatagatgtcatctttaaaatgtgcaagcagatattcaattttctaaaatatttttattttttataaatacaatggtctgaatgccactataatagaggttctttgaagccctcttccttggcttggcaaagaggaaaagcactcttctcccctccctcataagaaagggaacagtaaaagtcatagaagttttctcatgtccaacaaattgttagtcctatttgaatgatctgttccaggaattctcattcaagaaactgttctcaagtttatccttttccttatatgggcaagttaggttggtgaacgatgaaaatctcatgaccatctactcccttttttggagtgtttttctggtaccaacttgctgctgtaggggtattttgaaggccttttttttttttttttttttttttaaagaagtcttgctctattccccatgccggagtgcagtggtgtgatcttggctcactgcaacctccgcctcctgggttcaagcaattctcatgcctcagcctcccaggtagctgggactacaggtgcgtgccaccatgcctggctaattttttctatttttagtagagatggggttttgctatattgcccaggctgatctcaaactcccaagctcaggcaatccacctgctttggcctcccaaagtcctagggttacagacgtgagctaccatgcctggctgaaagcctaatttttattgttagtacctcttaccataactcctgatacaacaagaaaggtcccattcactgtctttttctacgccttaggaaatgtgttcccatcttagttttgccttatctaacagagtcccagggaaattcactcaatttttcatttttagtgaagaagaaggtcaggttaaaaagggtaagtgagttaaacaatatcgtaaagccagtaagtgtcagcactgggattcaaacttagtcttttgtttctttccccttattattctacttcaactcagcaatggtttttggagttgagtagaaaaaacaaaaagtaagaggaagattatggtacccagtgttcataaagagaagcagatgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaagtgatgaatactctaataaagacagacacaatacactacaaagtcatggagtctggagggcctctgtctcctggagaaagaatggagagacaggaggcaggagagaaggatgatttcacagaggatatctcatttgaattttctgttaattaatgggtaaactatcgaaagctattctgcgcagcccattaaaaggtactctgttggctcaagcttgacagtgtgtgaggaagaagaaagagatcttatgactagggttgccttataaaatacaggataccatttacattttgtataagcaatcgatacttttcagtattttttgttgtagtatttgggacatagttatgcttagaattctggatgtttcatatttttatttgctaattcttgggatcctagttatgactggaatgtggaagaaaacaataccagctgaatatgatttgaagagttttgtgtgccatgacatggagttttgaacttattctacagggataaacacttttgaaaagagtttatacaaagttgactttagaaggattagagtcaaagggggacttgaaaccattaagaagtcaagccccagtaatggcatgaacagagctcattctgctttccaaatatctaatctgcagtagatacttagtggctggaatcacctctgacatggctgacctgtgacagctatttcatctgcacattgccaatatctctgtgcttaggagattctctaaagcgcggcataatttttcttggatttcccctttcctgtttcattaaccctattctttcactcttacatttgaggatgaacttctctgcttccaatttcttgtcttacattctgttcttgagtgtatttaaactaacactttatccttttccatttcttccaaaaagtaaggataaatggtccttgatttatttgcaagctacttctttccctgaaaaagtttgggtgatccttagcatcagggtttagtatgactaaaagaaaaatatgtattagttattgtacaagataacttgaatgatcttttaaattttacagttcatatgtgaaagaaacttggcagggtcttcctaaattggacaataaattgtaataatttatgtgacatcaccaataataagttgaaaatgtaaaataaacttttctaaactatcaatgatagaagtcaaattttaatcaacaatgctgggggaaagagtaaattattttctgatgctctcacatgaagaggtgctgaaagaggatgcatccagaaagatagaaaaaattatttcagacactgtatattctagtattgcagagatggttcattattaagaaaacattctgcttatttttttcaatttttgtgatgtatgtggttatctgtcatctttttaaaaacgtataatttgttatgatttcctttctttctataatcatgttcatacctaattttatatttgtcctgttatattctttgacttaaagaaaactgccaaattagaatgtgcttcaagtttcagaaaaccagatctacctctgcttattcttttacctttattgagtatagaaaaccatttcattcagtatcctaaaataactaatttggtataggcattgcaaatctcttcttttactttgaagaccccatcgtttctaacagatgtaaaaacaaaaagaaaacaaaaataaaaaatgattttatctgacttataagtagtacattaaaactagttgagtttttgatctaaaatttaaaaataattagccgagtttctgatagaacaacattttacaatttctttgcttttttcttttttttttcttttattattgtactttaagttttagggtacatgtgcacattgtgcaggttagttacatatgtatacatgtgccatgctggcgcgctgcacccactaacttgtcatctagcattgggtatatctcccaatgctatccctccccccttcccccaccccacaacagtccccagagtgtgatgttccccttcctgtgtccatgtgttctcattgttcaattcccacctatgagtgagaacatgcggtgtttggttttttgttcttgcgacagtttactgagaacgatgatttccaatttcacccatgtgcctacaaaggacatgaactcatccttttttatggctgcatagtattgcatggtgtatatgtgccacattttcttaatccagtctatcattgttggacatttgggttggttccaagtctttgctattgtgaatagcgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttatcagatgagtaggttgcgaaaattttctcccattttgtaggttgcctgttcactctgatggtagtttcttttgctgtgcagaagctccttagtttaattagatcccatttgtcaattttggcttttgttgccattggttttggtgttttagacatgaagtccttgcccatgcctatgtcctgaatggtaatgcctcaagagaataaaatgcctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatatctacaactatctgatctttgacaaacctgagaaaaacaagcaatggggaaaggattccctatttaataaacggtgctgggaaaattggctagccatacgtagaaagctgaaactggatcccttccttacaccttatacaaaaatcaattcaagatggattaaagacttaaacgttagacctaaaaccataaaaaccctagaagataacctaggcattacaatttcttttcttaaggaatgatggtttgagtaatcctttagggttttaccctttacatgccattaaattgtcataattaatcatcatgcaacaggttgtaacatgtaaagtgacaatttagaggctgatacagaagaatagcgaataacaggggtttagtttttatgcatcatttcttcaggaaaacacatcatgaggggaaatagctttgaataagttcagtgaaggttgccatttagttaattaacttaaccattttcattagcagactcagtattgactttagaatactgtctgcttaatttcttccaaacaatgaatatgtatgaaacaccaccaaaggtaaagtgaaaatgaagacaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaacttaattcttaaaaatgagtccctcccctgtgagtggattatcagtatttgttgtatgtgcatatggggaaaggttacgctacccatgctcctctagacattctggtatattctcccatgtagacatacaaggcagagccaaggccttcctttatgaaccatttactgggggaaaataatgtatcggatcactttactccctgatatggactaatgctagaagcagttgaatctactgtctttaatgggacagagttgtgctcaaggatcattaaccacaaccaccgcccttactcagagataaagatttaagatctcttagcatggtggctaaaggttttcaaactcttgcccaaacataccttttcaatgtcaaacacaatcaccttgctctattcaggaggaatcctaccataatattttgtttacagtctctccacctataataatctttcctcttctcttgagtactgcaaattctacttcagaatagaacaatgtctacatgagggccttcttttgtggtccaaggccattttgcttctgctatagtttatttgagaaaataattgtctgtccttgggcaactcctgtactaccgtcctttgttgcaatctcaactttccacataattactttccaagctatactacgaggcaaagggaggattatgaagggtttagggttactctctcttccgcttcactgtaatttctattctttatttagaaacattctgtctattcctttattattttgtagtctataataatcatacaacatcttattaatatgacactatattttggatatgccctctattatattactaatatttacataaatgtaaacatttttatttccatgatcctagtgacttttaccgtttctaatgtatttatttttaaattaacacataacattgtatgtatttattgtgtacaacatgttttgaaatatgcatacactgtggaatggctaaattgagataattaacatatgcattaccccacattcttatcatttttttatggtgagaatgtttaaaatgtaatctcttggcaattttcaagaatacaatgcattgttattaactatagtaatctccattccttttaggtatctgcttaggctggtatcatacacataataaatgttcaattatttatggaatgaacaaacccaatgttttatttctttaatgaattagttcattctgaaaactaatacttctgtcaatcaacaacaatcaatcaaccaacttcaaagtaacttctcttcgttagagatgactagcagccttagtatcaaattggtgattattaagacggacaacatgataaaatattcaccccataactcccgctctccaaagtgaattctttaaatctcttttgatatgcaaagttcagtgagaagtgaacaccttctgtcacctagcaacgtgctgatcttaaacaaggccagttaacctcgctgaacctggatttctctttctgaacaaagaaagacaagatccacctcctataacttctgtgactcaaatgagctaatgtataggaaatactgtgcaacatatagtggtttataaaccataaaattctgaaaaaattagctgattgaaccagtgagtagagcgtaggcaaagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgattttttcccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaattttaatgttatattttctttaacttaaatagccaaattgttgtcacttcaacctgtactcaatataaaaagtaccaatgagatattttatttttttcatacttaggttttgtaatttggtgagtgttttatacttacagcacatttcagtggggactagccatatttcaaatgctcatatggtaggctgttgttaccacattggagagcactgatctcaaaggaaagttggacatttcgtccaagtttttgttcaaataaaaaactgattaaactttgagcaaatatgaattattcttatcagtctcttattgtttcttcctctcaaaaatattcgcaatattataaaaccagcaatgttaaacatactgaactcaccatttgaaaaagatggaagataagaatcattttcacaataaatgctgtaccatactatccccacaccaaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacgtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtactttttgaaatatgaaggaataaattcaatttcttaatatattactacacttaacagattatgacaaatacttctctaattatacaaaaaaattaggtttggagaatcccagagtattagctgcattttcaaatgccagcaggtgaagggaaataatccgtggtgggaagactctaaaatggcactcagtgatctctgtctcctagtatttgagtcctttaataatttcctccccttgagagtggtcaagacttttgacttgcttctgacaagcagaatatgtcaaagacaaaaggatatcacttctccaattaggctacataagattgggacttttgtcttgctagcaatttcactctttctctgtctctttcccccctcccccactttctctcactgattttgatgaggcaaattgccatgttagagaccgaaggaactaaacgtggccatcagccaacaagaaaaggaagactacagtccaataacccacatggaactgaaacttaccaacaacaggtgagtttggaagcaggtccttccaaggcaagctttcaaatgagaccctagccctggccaacacctagtgtgcagcctttgtgagagaccccgaagcaaagaatatggataatctatgcctagacttctgacccatatgtatcctgatactctaaagatacagttttaagcccctatctttgtagtaattgttatgcagcaatagacaactaatacataatattataatctttttaagaaacaaatatagtaacataaaaattaaataatggtgaagttgtagggttttcagtataggagtattgcaaatataagaacggaccatattttaacgagttactgaaaaatagtggcgaattttaaagtttcaatgtcagaaagaagaaatcaaatatatactcagatgaaatgataaaaccattaaggtttcatgcaccctctcacatttctaacattaattttcaaattttaagtagaacagtgataaagatgaataatattgtcaatcttctagttttattttagcaccttgcatttaaaacagacaatttatctttgagttgttggtacttcaaatagtttttttaaagtttccacaatttcacacagagacgaatgctaagaatctgttaagcttgcttttagggaaaaggatgcctcaaagtcacaaaactttttaaacttggttctttgggggtgaaaaagcaggcatatttttcaccaattttctaaattttacatgttaaattggaagtaagatttatgttaaactgtttattaaaacatattaaagataaaccatgtgagagaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatagcatgaaaatagagatgtagtgtactaacatgtaatatagagttgatgaagacatgttggaattaacttctgaaaattgttgatgaatgcacagtttagaaatgacgaataatagttctattccatttccatttaaaggataaaggcttcaaaatgcatgaaaaattataaagtgaatttttaaatggttcatgaaatctcagctttctgaaactaaattagcttcttttgtttttcagattcgaaactctatgatatggtttggctgtgtctgtaccaaaagctcatcttaagctgttgttcccataacccccacacgtcctgggagggatcaggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatgatctccttgtaagtacctgagtactgaagccaactgtcttgatttgggtctcccagtagcaaacccagaaataaaaatttgagctcaagtagttttgggatgtgattccaggacacatcaacagggtgagaagaagtgaaatagggaagatagccaataaagggtatattatcatgcaagtcatcaatgtgaacaactgaatcttaatactccctgttatccctaaaagaagatgtaggaaactaaggctactgtaaccaaaacagcatggtactggtaccaaaacagagatatagaccaatggaacagaacggaagcctcagaaataataccacacatctacaactatctgatctttgacaaacctgacaaaaaacaagaaatggggaaaggattccctatttaataaatggtgctgggaaaactggctagccatatgtagaaagctgaaactggatcccttccttacaccttatacaaaaattaattaattcaagatggattaaagacttacatgttagacctaaaaccataaaaccctagaagaaaacctaggcaataccattcaggacaaaggcatgggcaaggacttcatgatgaaaacaccaaaagcaatggcaacagaagccaaaattgacaaatgggatctaattaaacgaaagagcttctgcacagcaaaagaaagtaccatcagagtgaacaagcaacctacataatgggagaaaatttttgcaatctacccatctgacaaagggctaatatcgagaatctacaaagaacttaaacaaatttacaagaaaaaaaccaacctcatcgaaaagtcggccaaggataggaacagacacttctcaaaagaagacatttatgcagctaacagacacatgaaaaaatgctcatcatcactggtcatcagagaaatgcaaatcaaaaccacaatgagataccatctcactccagttagaatggtgatcattaaaaagtcaggaaacaacagatgctggagaggatgtggagaaacaggaacactttcacaccgttggtgggactgtaaactagttcaaccattgtggaagacagtgtggcgattcctcaaggatctagaactagaaataccatttgacccggccatcccattactgggtatatacccaaaggattataaatcatgctgctataaagacacatgcacacgtatgtttattgcggcactattcacaatagcaaagacttggaaccaacccaaatgtccatcagtgatagactggattaagaaaatgtggcacatacacaccatggaatactacgcaaccataaaaaaggatgagttgtttatgtcctttgaagggacatggatgaagctggaaaccaacattctgagcaaactatcacaaggacagaaaaccaaacaccgcatgtcctcactcataggtgggaattgaacaatgaaaacacttggacacagcgcaggcaacatcacacactggggcctgtcgtggggtggggggctggggagggatagcattaggagaaatagctaatgtaaatgacgagttaatgggtgcagcacaccagcatggcccacgcatacctatgtaacaaacctgcacgttgtgcacatgtaccctagaacttcaagtatatatatatacttatatatatacttatatgaaagatgtagggaattaagcttggagttattagatctgaagggcaagggggacagggtattgatctatcaactgctgctctacaggggcataactgctacatttctgctctctcccaagaatgagcagagatagccccaagcaaagagatgcaagtacaggaagttggaaattaagaagcacgtataaaaatggtaagtgctaaagggatatcggtggggcaccgacagtatctgctacaacacctcatacattttttccttaaatgatctccacaacctgcctacatttggaaagtattgttgtaatgtcaaaattaccattcagtttcattaattgactaaaaaatcaagtcaaagcaatgtgacagatattggttggttatcttttcctaattcatctatctattctgtctacctgtctgtttatcagtcaatcatctttcacccttacgttcctttgaggaactttgcacctacttctctacctttgttgtggtgcagctgtagagtttggttgagatttaatgacttttagctgtagaagtgaggtgtgatttagtacaggaatgagcatgtgacctaattcaggccagtcagtttcagagcagtctttcctggatgctttgggaaagaaggtccctaaagagatgattttcatcaaaagtaagtttgcagatgtgggttctgaaacggcttcaggccatttttgtcaccaagagggaagtcaggtgaagctgctaggtcaacacagaaaaatagaacccagagaaatgtgaaaaaaaaaaaaaaaaaacaagaaacaaaaaaccggaaccttgatcatatttattgtttaaatcagtttgagaccagttttctgtcacttacagcattaagagaaccaatagacgcattaagtcagttacttacaggcatattagttagaactaatcctccatgacacttcacagaaggtgaagattcatgcatttttaaaataattcattctatcattttacttgaatatcataaaaatctctcggttagtgttaacaaataatagttttctttcgtttttctaacacctaaaaccatatttcataatcccataatgtgaaatagtgtgaataatatgtaacagttcaaacattatgttccagaagagagagatttttattttttctttctattttttgaactccagagagagatttttaaatttgcagtttgagattagagctttccaacagctgaagtgtttactattttgagagaagacttgcgaaagcaaaggttaacctagtagtacctgctgtgccttcgttggcaaatgaaggaaaatcacacagatggtggcatttgcctgggagttgggtgccaggggtgtcctctcaaaggcacacaaaaagatagaatgaaatgtctctcttttcttaaatatgtggatgtggatttgttggaaaaaattactttacccacacttgaaaagtcatcaccactgtcaccaccaccacaatcaatcaatttaatagtgaacatgtattaatcctttagtatgtaccacattctcccttgccaggcaagcaaggaattcagctttgttctagactgctgtttggcacagtcttaggttattctccttctaacagtgcaaagcacttagaatacagtcgatacacagtaagttattaataaatattaactatcattacctaacacactgaggaatctttaactctcccaaggagtggggaggacttcaaaacaggaatcagttaaatttctccttggaccgtctagtgcaggcttggtgtagatataaaaagaaataaaatattggtacaaactaaatgcctgacacatctgaggtagaaactaacgaacgttgtaagtgaaatactgctgtgggctgaggataacaggaggccaagatggatcttgtttggagatgacaaggcaggctctatgggattagaaaggagaagtcagatttagagattggtggtattaagagagaaggaaaaaaggtagactttctaagtggaccaggcagggaatcagaggcgaggaagaaaacagaacaaatggaaagaacattgggtagtctcattttgatggcagcctgagtgaaaatgaccagtgggagaaaatatcagaagatttctatagctgaatgacacaggggttggaaacccagggctaaaggagaaatttatcaaggaactgtttcccttactaaatccacagcatcgcccacataggtacagacttgtttgtctaggattttgtgactacatggcagtttgccttatcaaagtgagtgaaaggatggggaaaagggaaagcaagacaggaagagaaaaagaaatagggagagtgaggctcttgtcacaatcaacttgtaattgctgaacagtgtgttggtgctttcatgtcagaggtaacatttacagaaatgacacattttaaggccctgaggggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcactttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcgaagctgatcctcttacaactacacgagaagttgccgaggaactcaatgtcaaccatttcacagttgttcagcatttgaagcaaattggaaaggcgaaaaaactcgataagtgggtgcctcataagcagagcgaaaataaaagtatcgtcattttgaagtgccatcttctcttattctacgccaacaacaacaaaccatttcttgatcggattgtaacgtgcaacaaaaagtggattttaaacgacaactggcgatgcccagttcagtggctggactgagaagaagctccaaagcactttccaaagccaaacttgtaccaaaagtcatggtcactgttcactggtctcctgctggcctgacccactaccgctttctgaatcccggcgaaaccactacatttgagaagtatgctcagtaaattgatgagatacatcaaaaactgccatgcctgcagccagcagtggtcaacagaaagggcccaattcttctctgtgacaacgcccgaccgcacgtcgcacaaccaacgcttcacaagttgaatgaatcgggctaggaagttttgcctcatctgccatatttacctgacctctcaaccaactgactaccacttcttcaagcatctcgacaactttttacagggaaaatgcttccacaactagcaggatgaagaaaatgctttccaagagttcattgaatcccaaagcatgaatttttatgctacaggaataaacacacttatttcttcttggcaaaaatgtgttgactgtaacggttcctactttgattaataaagatgtgcttgagcctagttataatgatttaaaattcacggtcccaaactgcaatttcttttgcaccaacctaatatatctcagtccatttttgtagggccatttttgttcctgtttccaggtgagaaaactgagaccacagagagatgacacagctagtaaggaatttgtggaaggcgattatttggcagccccacaattaatcacgcctcttggattcatgcctttgtgtagtcccttctcattttgattctgaacttggccatatgcctggctttggccaatgggatagtagcaagtgtgatacaaacagaagcttgataagtctttgaagattggtgcttgttcttttggaaggcttcttcacagaactcaaccaccaagctgtggggaagccaaaggagacacatggagaagacaatggaaacaaactgaggctcatggccaatagctttagctgagttctcagctggtaggcagcaccaactgccagtcatgtgagtgaggccattttggactttccagctttcccagtgtcttggttgatatcaggtgaagcagatgaatatcatagtcaactctcagaattatgagaaatcgtaaaactatcttattttaagccagtaacttttagagtggtttgttgcatagcatatataactggaacagagtgaaatcaaaatttgaaccaggcagagtagtaacatgtcgaactaactatacaggattaaaaaaaacagcttctcaaagtgaagcagaactttatctttatttgttttttgaaataaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaaggaaaaccttgcacactgttggtaggaatataaattagtacaaccactatagagaacagtttggaggttcctcaaaaaagtaaaaatagagcttccctatgatccagcaatcccactgctgggtatatacccaaagaaaggaaatcagtatattgacgaaatatctgcattcccatgtttattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggatagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaaaaaattttaaaaagagagaattggttgtggtaggagcagatagcataactttcactttataggtcactggaccatgaggaaccatatcttgatctgatggagaagacagtgcatcatccacagacaatggacttttagctggatgcagtaagtgaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacggctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaatacataggaatgcatcttaactgaataccttacttgtgagggggtgagaaacttaatagattgcaaggtgtggtagattgcactggtgacctctctgtatgcacatctttttgcaatgtgacttttaaagttgctaccatcaggagttgtaacctatttccctaatccctgaatatgggcctgccttgtgatttgctttggttaaaaaaatgtgttagaaatgagtgagccagctccaagcttaagcttcaagaagtcttgtttccttctctattagaatcctgtttcttgcatgagaataagcccaggagcgcttgccgaaggatgagagaccatatggagcagaggtgaatcatcctagctgcgcttatgctagataagccagcccctagcccacccattagctgactgaaaatgtatgagtgagccagaacaacacaacagctcacgggaccccacagactgtgtgcaattataaatggtgataattttaagtcaataagttttagggtgatttgttacataacactattgcaaattttacactattggagttattacttaactgatatataggggaaagccagaaatgggagtgaggcttggtacagttaagagttcttaaataataccagagtcctcaatcctaaaattactgattttgattttgaatgagtatctaaagtcaggctcaattctttgcaaagatgtctgaagagacattcatggcaaatcaatgggggtaaccactgaaaaagtgattttagaagatcattattagaagacctaataatagctagtattttttggccacttactctgtatcagctgttgcccaaagcagtgaaagagggaaagaaataccctgaaatctccccttctcctgctctccaatctcctgccaacgcctcccactggttaaatctatacagaagatagttgagaagaaagcctgaggaataaggtgagtggaggtgagcttcttgcaatatacaatatattgcacagaaagaggaaggaaattgagtgaatctgtgggaaagttatacttgggttatgaaccccacaacgatctatgtttcaaaggtataaatcatttgaatgtgttcatattttctgtcaaagttgatatgtatcttctgtggtcggatgaatgtgcttcataaatatcaagagacaaaatctttttgcaaaggcctttccagtatctcagaacacactgtatgcattccattgaatgggattggtggtcaactcctacacagactcttgatagccactctctacctccctaccatttaagaagtagagcaaggggaccagggaaccagcatcttgaaattagggggggaaatgcagaacctcaggtcctatgcaagagccattgaatcagtaacctgattttaacaagatctcaaggtgattcctgtttcagtaagtcatcaattaatgttgttgatagattctgggaaactgtgacttaggcaaaatgacatataatgaaaccaatcttaccataggctaattgataaacaagaattaagttcctactgcatacctgtgttcacaaaacatgatccaacatctaaataaagaccccaagcacttctaatattaaactcagaaataaatgtgagatatacatccactttagaaagattaataaaaaccaggaggaaaattatttacccagtttttggtgaatcagtgagtgacagtgtttgcagtggcggtggttcattcaaggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcgcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgctattagaattttatggtaacctactttgtaatagtaaccacaatttaactcctcgtaataaagtatgatagtatatattgtgtttttagttcctcactagacgctgggagatgggcaaacatgcttcataatgcatcactgttggacaaatgaggaactagaggcactaagagatttaaataagtggcccacagttatgagttagtgagtgttgaacctgggtctagactgagttatgaactgcaagtttagtgatctttccaggactgagatgaggcatggagaataagaaggtggaacggtggcactcattacacaaaccattagaatatttgaggccacgttgggaattaaccacacgcgaactgagaagctggaaaggggtatctttaagaaaactaatccttcacccgaagtagaaatgattatttaatcatactgcattctagtttcagcataaagacttgaacatgttaatgtcaacatctttttttttaatctttttttttttgtttgtttgagacagagtctcactcggttgcccaggctggaatgcagtggcgtgatctcctttcactgcaacctccgcctcctgggttcaaatgattctcctgcctcagcctcccaagtagctgtgattcaagtcatgtgccaccacgcccagctaatttttgtatttttagtagagacagggtttgacaatgttggccaggctggtcttgaactctgacctcaagtggcctgccctccttggcctcccaaagtgctgggattacaggcgtgagccaccgtgcccagcctcaacatctttcttaattattttagtaattaaaatagtttttgtctgctcccaaactatatgaaatcttacccatagagtgtcttttctattaattttcctgttttgtgtgttggcctttatttgttctcaatgaataagggcctatatagcacctgaatattaatttttttctcttccttaaccagcagctcagtgattctaacatcactgataaaatacacatcactgatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaaccatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaatttctccatcaggcccttatcagcccttttgttacccatacagtggtcttgccccgaaccataaggtggataaatgaggggaatgctgattttggcatccagcttactttcagataatctagctcatccttctcagctgacacgagacagaaataacatcaaagggtgataaactctttcttgcaaacctggggttccatggttcactggccccaggcctaatccaacaatccattttctacacaataaaaggtaagaaacccattacagatctgttataagccttggcaggtggtatacggcaaaaatggaatacacaaccaacccagcatttggtatcccttttctatggtttgaagcactaggggtcagctgacatgaatatagtagtcagcatttagtattaagttattttagctacataaataaactcacatcttgatgtatgagtataaagatttgacagaaaagttcatttttggtatgattctgatctttaataaaaatcaccctgttattttacttttgtatggcatattggctttgcaggtgatataataaatgaaactgggttagaatttacaatatgtggtcttaaatatggcctttaatctttgttccttatttaacctcagtttaaggagttggcatatgaaaacttccatttaatatcatttcacgattattaaattattagaaaggaaggaaactccctctagtctcagggttggtgctatgtaagtaaaagcattgcagaaacaaaaggaaagaaaaaacattttatattagcaaaatccccttttattatgtcatttcttctcctttctagaagtcattgcttcaggcaaacacctttgtgctaataaaggagttacttaaaaatgctacactgaagatgcagagttatgaaatttttctcctcctttctcttttcatcatcatttatactcttcatcattttaaatccatcatgaacggggaggagagattgctaagaatagtcgaatttgtttttagttgaaaattagcttaacttttaaataaaatctagggcacagcatacttaagtgacacatttacatgcttgatatacattttcagtatgtagatagtggcaacaatgaagtttcactatggaaattagttgttacacaagtatcagtgcttcacaatttatgctggatttttgttatattttttaaaacattattatattggaatgaacaaattatcttgtatttggtgaggtttcctaatagaaaattatctagcttcagtgtaaccttctacaaatgcttttcctttactttgccaaaatgagggaaactgatgtcaaaaataaaggtagggggaagggatggggaagcagtgtgaaagtttacttgctttctgcttggatttctgggttacaatcaggccaatagattgataaaaacgatgttcagaattaaaagtcctctgaattatgttcatactttaaaagtgagaatgctggtgtttgaaaacaatgctggctttgttgggcttcttaggcaataggaggagaaaaatctatcattttccaacacattttagctgaaatgctagttggtcatagaaaatgaaagtaatatcagcggaataggagagcagtggctgaaaatcctctgtgccttccacgagagccatttggttgtcttgctgcctctaactctcctctccttcacctgttgcattcataatagtagcacatagttcagctttctccccaagagccatatttacaactttgattaagaaggtgagacttttggagaatttggaggtgagaatcagagatgattttgtgcttgctctttgcatttttctattttagtattactcctactgtttttaatctaacattttttgagcaattacaatatgccagatactgtgttacacatttcccatttactacctcattgaattttcaccacaacctggggaagtgtcttcttttagtatttgaattttatggatgttataacttaggtatggacagagtaggtataagatcacatagctggtagcaagtggaatccataattcataatctcatcattaatgcctgcagtaaattacctcctcatcactcctgtttactttttccttgtttgtaaagtgtctgatccatattcttggcattgcctatatggtattatagtacatactggtttctatccaggttcctggctcataacacccatagcccttgttacagttttttgttataatgttggttgcgttgggtctcaggggcaggcctctgaccttctcctgctctcctttcactttaatgttccctcgcctttcagattataggtcttaaaaacctcctgttagagggtcccaccatatacccttggggaaggaatgctgatgtcatgaagcttccataaaaaacaaagaggacagagtccagtgagcttccgggtagctgaacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgtgcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatatactattgtcattaaagagtgattaattcggtaataatggcaatcagatttcttggataggccgaaattctcagctgaactaaagtattaggaaggtagatgatgatgacaaggacgatgatgctactaagaacaaaagcaatcatgataataatagttattgagcactggaccaagcctagctctaaaagcctgatgtttgttctcataactagagtgaccctctctatatattttatcttctaaagtggaatacttatgacaatgaaagagggagctattaaaaattatgataggataacaggcaaaaaccagaacagtcagagcaaattgagatgtactcatgacacacaacctagtaataaacctcatgtcagtgtgaaattataggaggcaaagtcaaggatgcttatgttataaactttaaattactactcccttcccccaaccctcagcttcaaactgtttagcaactataaattagagatatgaatatttataatgccaagccctataaaattatgcatgtcctttaaataagggaagggtgggaagtgattatgatatgcttagaacagaatgtggcacatagtagtcctttaatagatagctcttgaataaataatttaattacagctttgctgtaattattaactacataaagaaaacatccaaataatggatttccaggaacttacataaagaaaacattcaagataatgggtttctgggaactatcagactatatgcccaataaataggtgaacacccttttttttttttttttttttttgagatagagtcttgctctgtcgccaggctggagtatagcggcatgatcttggctcactgcaacctcctactccctggttcaagtgattctcctgcctcagcctcccaaatagctgggattacagacacatgccaccacgctcagctaatttttgtatttttaatagagacggagttttgccatgttggctgggatggtctcgatctcctgaccttgtgatctgcccgcctgggcctcccaaagtgctgggattacaggcgtgagccaccacacccggcccgttttcttatataatagcgttttagcacacagatttataaaattaaaaactgtgtgaactgtgttacaaatacacttcaagggagaaaatcatgagcacataaaagctccagtggaactatctggtccctgctaagacttccagctagagaaatgatttcctataatgattattatacttcctactatatattttacagcatttttttttccggggttccataaataccagtcaatatggtaacaatgccagtgaagattctattatttggttgaaaaaacatcacgttaagggcaggactgaatggtaactattagaacaatctattaatcgtcatcttgtgataggaaattgattggacaaagtgtccatttttgagcaaggagtcggaaagccaagctctagctttatttaattttctcctttttgctattcacatttatactgacgactaataatgactgtcattacatagcaaatacgtctggaaaaagactaaacattcatttaccttatacaaatgaaaataaatctgaaatgtttactcctcagatacatatttagaagcaacatgattagagattaatacaaaatgaaccagatttctggaaatttagatacagccaactgtatattgtggaagatagtttgtgctaggagttgcactgtatttttactttcataatttttatttggtgattttttgaaaataatacctgtattattatcaatattacaaaaattattcccatattaaaggtttgttatatatgttgtatttgtaaacctacctttttcctcggtaaagtgaataagatgcacttaactaaaattcactttccagccaaatttcttaattgttttccaaaatgcttttttctttatgtgcaccattttatactgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaaggttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagttaaaaaaatacccacatataacatatacaaagagcaatgaagaatgaggaaaggggacacaaaataaaaagacatgaaagagatgaaactgggattaacggggtcagggaaggagagcagaagagaatgtgttacataaacaactggggcagaaaaagagtggcaaatatgcaaatagaaaagtagattcatggccaggtgcggtggctcacgcctgtaatatcagcaatttgggaggccgaggtgggcagatcacctgaggtcgggagtttaagaccagcctgatcaacgtggtgaaaccccgtctctacttaaaatacaaaaattagccaggcgtggtggtgcatgcctgtaatcccagctactcgggaagctgaggcaggagaatcgcttgaacccaggagacagaggttgcagtgagtggagatcgtgccattgcactccagcctgggcgacagagcaaaactctgtctcaaaaaaaaaaaaaaaacaaaaagaagattcctaataaatatataaaaataaattcctataatatacgtgtcaattcatagatgaaaattagcctaaaagtgagaaacacagaggaagagagtgatgatgatggcgagagagcctcctacacccacatgcatgttcagagaaaatacaaagaaatatgaagagggataaatattaaaaacacctgagtcagaagtgtgggtgaagatcatagaatgagatgatcagagagaggaacacagaggctagctttaataacatccccactttgtggctcttacgggtatcattgttaaaggctgtaaaaggtcaagttatgtattagacaagaatgaggatatcatttcatgagccttcattgcatgaagctacccataaatttacgctaatggctatattcagtttaaagcaaccctgtccaccactcccttaaagaaatagctatattatcttcacctgctgttttctctcttcagtaatgaaatataaatgtacaggccgggcgcggtggctcacacctgtaatccccgcactttcggaggctgaggtgagcagatcatgaggtcaggagttcgagaccagcctggccgacatggcgaaccctccatctctactaaaaatacaaaaattagttgggtgtggtggtgcgcgcctgtagtcccagctactcgagaggctgaggcagaagaatcacttgaacccgggaggtggaggttgcagtgagctgagatcgtgccactgcactgcagcctggatgacaaagcgagactctgtctcaaaaaataaataaaaaaaaaaataaaataaaggtacaagagtaaggggtcagttggctcaatacgcagaatgcagcatattagagttagctgtggagaaagtcacctgccaactgattatgatattaggatatgtttggagatactatgtactaaggaattgacatattcatgtcacagtaactatgacccactagttccaattatatcacccactctaacctttggatgaagggtagggctggaggacacagggagggggtccgctttatttctaccctcctgtaataagtaagagcttgagatttaatgaagatcaagactgtctgccagtgttataagccattttcttttacttttaaaaaaacttgtgttatttacctaaatctggtactgatcatttgctttctatccctaaatctaaactaacagggatacagaggcatatggatggagaaaagatgattaaataattttaatatgactaatgaataaaattccaaatcctgtggcatttaatggcaaagacattgcattaaaattataattttggcataggaaacagatattatggatgctgtagtaatataagtctatacatgatggtgttcgtaacctcagttttaattttctatcataaaaatttgactttttattctgttgcaggacacataaaaccttgactctttcacaacccacaaagctgctattgtatattttagatagttctctcacatttcctacaattataatttttgttcttctttttgtcataagatgtactgagatattgtagaacattttgggtatccttcctccttgttctctttttatgagggatgatttcatttgtattgttatgtagctataaaatttaattgctgggacaccaccttccctccatacataaaagtctgtatctttacacagatgttttgcaatcattaaaggtagaaaccaagaagggatttttttttttcaaataactacctgcttgaaatagagacacttaagcgcacattatggttttaatgtcataaaattggtacttattttagttcctaaatattttatcagtcgtgtaaatgatctgttattagaatgtcagcatcaccaatttaaaaaatacaataaataacctgacacaattcaaaatgttcacaaattagatgactcagtatcgtaaagatgttgactgagctccagattcacaaaatttcaatcaatatcctggaaggctttatgtaaaaatagacaatatagttctaaaatttattcaaagaaccaaaagtagccaaggcaatcttgaataggaagaacaaagtggaaggtttacacaaccagatccaaaatgtttaaataaaatgattgcgtatatacatacaatggaatattattcagtcataaaaaggaatgaagttctgacacatgctacaacatagatgaaccttgaaaatattatgctgagggaagtaaggcagacacaaagtggcaaatatataattccaattatataaaagatctagaatagccaaattcatagaaacagaaagtagtccagaggctactagcggatgggaagagagagaaaggggaactattgcttaatggttacagactgtctggttggagtaataaaaaattttggaggctgggcgcggtggctcacgctgtaatcccaggactttgggagtccaaggtgggcggatcacctgaggtcaggagtttgagaccagcctggccaacatggcaaaaccccatctctactaaaaatacaaaaacttagctgggcatgctggcaggtgcctgtaatcccagctactagggaggctgaggcaggagaaccacttgaacctgggaggcggaagttgcagtgagccgagatcgcgccactgcactccagcctgagcgacacagcgagactctgtctccaaaaaagaaaaaaaaaaattgggggtggggcataaactgtggtgatggttgtaataaatgccactgagctggacacacgaaatgactaaaatgacaattttttatgttatatattttatcacaccttaaaaaagtaacaccgaaatacgattgaattgttcactttaaatgagtttaatggtatgtgaattatagctcggtaggattgttttaaaaaaaagattgtaattaagccagtgaagtactgttgttaaagtacagatttaatcaaatggaagaggatacagaatccagaagcagattcatacatacaagttctcttgatttatgacaaagatgccatgaaaatacagtggggaaatgattgtctttgaatgaatagtgctggatcaattgatgttgctttttactataaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgccatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctgcttgagcttattttcaagtttatcttgctcttctgggcttatgggagcacttacaagcacgggtcctccagtttcatttaattgtttgagaattccctggcgcaggggcaactcttccaccagtaactgaaacagacaaatgcaacaacgtttaaaatgaattacagcacaattccaactaccttgtctttgcttctattgattagtctatcaaaatgaagcgacttgaccgagggcccagtggtacctcaaataccaacagttttctatctgagcacagagctgattgactgaaacactcaccccctcagtagataaatctctgtagaaaataaacgattatattatccctcataaattttttaagagaaaaatgtgagatggtaaagcaacactccaaataaagttagtgtctgaaaacctatctctctatcagaaatagaacaatgtgaacaaattcatcagcctcttgggtatcatagcatgccatagcataccgtagcttgctgctgagaaattgcattatcatcttaagaggtaactgacattgagagtattgactctcaatatacacagtgccaggcactgtgctaaccttttcacatttattatcttagtttatcttcatattataataattatatcaggtagatccaattatcttcattttatatggaaggaaactgagacaaaggggttaaataccagctcccaggacacaaatctagcaagcaacaaaggtgtggttcaaatttgggtagtttcattctggagtcctcattttttacttcatatccctaaatttctcgaactcattcaccaccacatagtgtatgccctttcccaagacctccaaaatcaccatggtgttaacacttcatttttgtcaactaaagttactgtgtctgctacagtacccattagccatacaacgctattaacattcaagttaatcaaaattcactaaaataaaatctcaagttcctcagtcacacgaccaactctccaggtattcaaaaggcacaaatagctagtcgttacaaaaatggatgatgcagaatattttcatcatcacgggagttctatttgaaagcactgatctagattctttcaggagaaaatagactcatgcatattaattaataagaaaatgccactaaatatgtttcgaatgaattatcaattatattactatatatgacactcaatacatttgggaaagataaatttccaagaaaagactgagttcattgttctagggtataaccatcttcaaatgattcccactcttttctatttttgaatcccaaatacctagtaaaacatcggatgtatagtcagtgctccatatttgtttattgaattacgccatattttatttttatactttatttcttgttcaggtgtaaacctcttgtttcacagaaataaacgtttgacattggactctaatttacatgtgtaaagcacctgaatcattgataaaggaccaatttcatttccctttgattatgtgaccgtgtaaaatgaggataatagcaaccattgtcaaaatctgatatgaagattaaataaaatagtggctgtaaatgtatctaatacttggcacataacagggaatgattaaatattaatttctcttcccctttcaccttctgcttgacaactaaaatgaaatagatccaaaagagctgctttcctaaaactaaaaccatgaaagttaatccaattgcacaatcagagcatgtcagtcagccaagggaagtaatcagtaataagcagacatcacagtaggacggtatgaaaagccactggaataagctggatgtctattcaaccaaatggaatgtgaaccaacaccacgtcccacacccccagacaaatcagctaaaacaaaacattgcttcgggggaatataatgcctttaagtagaggctgaagtggtgagactgatctggcaatccagatcttccctaagaaaatggattcttctttttaaagactcttctcaaatctccaggtaggtaaccaggacagattaaaaaagtgattcccatttagatttagattttatgattccacaatctggtcttcagtttttaaaattatatgaagttgtgaagttctcaagtaaaatctaaaattaatttcaaatcaaagataaaaactgtgaattatatacatttagacatattgaatctatacatctatatgtgtagatgtatagatgcaatatgtgtgtgtgtatatataaatacacacacacacatatatacatatgttcttatgtgcactggttcagaactgcagggttaagaagaaataaagttgtgagaaaaacactttagcaaggaactatgaataacctaatgggcagaaaaccaatgattgaattaaaaaatagattcatatacttctttatgcaagcaggccctgggggatttgagaaaataaaattaccttgacttgctcaagcttttcttttagttgctgctcttttccaggttcaagtgggatactagcaatgttatctgcttcctccaaccataaaacaaattcatttaaatctctttgaaattctgacaagatattcttttgttcttctagcctggagaaagaagaataaaattgttatttttttttccaacatagttctcaaactatttgttaatgcaaactgggacacaaacatggcaatttaaaaataagcaatttaaaagatgttaaccatacataatttaagaaaattcattcactttgaacaaagtaatttcaatatttcaagaatctctaaatgataagagattaaaatcgaacaagaaaaattctgattcaaaaattcctggccaggcgcagtggctcatgcctgtaaccctagcgcttagggaggccgatgtgggcggatcacttgaggtcaggagtttgcgaccagcctggcaaatatggtgaaaccccgtctacactaaaaatacaaaaatttgccaggtttggtggcaggcgcctgtaatcccagctactagggaggctgaggcaggagaatcacttgaacgtggaaggcagaggctgcagtaagccgagatcgtgccactgcactccaccccgggcaacagagaaagactccatctcaaatacatacatacatacgtacgtacatacatacatacatacatacattaaaatgaataaaataaaaattctaacaacattatgtcattatatctgagcaaggtttctcaactttagcattactaacatttaggtttggaaaattctttgctgtgagcagctatcctctgcattgtagggtatttagcagtatccctggcctgttgaacacactggataccagtagtaacacctcgcccctgagctgtgacaaccaaatatgtttcaaggcactgccaaatatgctggggggttgggggtggggacaaaattgtccctggttgagaaccaactaaagtaagtatataacctaaagttacaagttttaaaatgtttaattaaagtatacttatggaaaatgagaggacaaaaatataaacaaggtttttgttttgtttaagtagcagccattttatctgcttcttattctgtgggtcaaggatttggatagggctcagttgagcagttctgctttatgtggcttcagcttggtttaaaataaaacactaaattattacatgctaaactgttttccgaattatgactcacaaccttatttgaggaaagagaaaaactgatttaaaatacttaacatatgttgtactcgtggaagttttaattatgaaaatgcatataactctatgctaattagccataaatttattcttacatattcgattgtaagacagctgaacaaaattgtttgtgcttaaaataattgaaaattttttgttttgttgtcttttgggaactatgtgtagcttccatggaagcttttaactgaagtgtaatatacgtacaggacactgcacaatttaactgtatagcccaatagtgttttaaaaattgaacacactgtacaaccagagaaggaaatagaatattatcagaatctcagaaatctcctcttatccctttgcagtcactgcctccaagtataaccagtaccctgtcaactttgattattttgccggtactgaatattatgaaaatggaattgtatggctttatactcctttgtgtctcgcctttttcattcaaaattatgtttacgataatccatgttgcatataattttagtctgttcattaacctggctgtatagcatttaattgtgtaaatatagtactttagatggacatttgtgataattcagttttttgaatgattagctatttttttttttttgcttcaaattaacaaatgtgtattgggagcttactaccttctaagagctcaattgggcattaggattaaagatatatacgttatataccttgtcttgaggatttcatagtcaatgagaagaaacaagcatgtaagccaaggattatgattaagtattataggaggagaagttatttctggggcagtgcttgggagacatcccagagaagataatgatctgagtcttgaagcatgaagatagatcagcatgttgcaggaataagacacagcctgttcaaagacagggccttgagagaactacagttgcgatcattctgtaaatcagaatctggttattggacttatgcttgcatatattcattcagttttcctatatgataagagcctgttcaaagtctgttctgggacacgtaaagttacattctcccctctgtctattctcttttaaattcatttatacatttattcgcttatttttacaaatgtttatgatttattgtttttaatttttgtagggacatagtaagtgtatgtacttgtagggtacgtgagatattttgatacacgcatgcaatgagaaataagcacatccactgttcattcctgggacactgggagcagggtctgtttttaacctatcccgaatataacatctgatctagaagtacttctgccttatctgactgggaagatgaatgctatttacttcagctgagagtatattttgttgtctcatatattttggggaaactactagtttaataaatcaagagatctggagctcggggagagaggaaagctggaaataaggactttagtcattagcaatcagttggcagagaaaacacggtaaactaacttttgaactaataattaacatttcatgtttgctattttctgagtccattctttcttcgttttatgaattttaatcattgacaattctctcttatttaaattgaaaaataggaaaagtcaatttcaaagccttttgttgatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctttttaatcttgcctgggacacggagtacagaggagattggaaattgcttggaatagagataataatccctgttgctttagagtaaaccctatggggaagtggctggtctcgattgctggcagtttgttttagaatgtggaacagcaccatttcccctcagattctgaccttagaatcaattgtggaagaagaaaacgtctagtatagtacaggcatcctttatttgtttaaatgttccaagcagatttaattccttgggtctagattttgagggtctatctcatctttttctctctctctgtttctactctgcaaatcattgcctccattactatttgactccagatgattttgcacagtgttctgaatacttttagttaagtaaaatcttgctaaaatctgattacatttgaaaaacctagacacattggcaaggcttttaaacattttcaactttcatctagaagcagacacgtttaaggaaaagaaaaccccaaaccccccaaacaaacaaaaatttaaggagcaggaaaaagtaatatcaaaccaaaaaaataataataaccctcaagtttagaaaattctaaatcaaacactcccctcttttcaaatatgtctcaaattatttactagcatatttttttctatcaagaatatccagtacagaggagagatgttgtgcttattcatcatagttgagatttatatgtattactgggttcaaaccctatattgtatgcttattttcttcatttattattctactatgtgtctctgtaggtcattaattacgctttaaaaacttgattttttaagatcctagtaataagatatataggggtaccctatatttcaccattattgtgttattaggaattttgtttgctttcattttttattataatgaataaccctacaataaacacatttatttatacattttgaatcatgtatctgctggaatgagaatgaaaagttaacaatgggaatcctaaggatttagatacacattgttgaatttctgtcaaggttggtactcagaacactcgtaaactcccaccaacagttacaaaatacttgtctcactacacttttgccactattgagcattataattgatataccaataaaacaaataaaaagcttgccatagatattttaagtattctactaataggaaagttgaaaatgttgtatgtgtgtacatgtttgtcatttatttagtttccactgtcaattatcggcaatgtctgttgcccatttttcctgtgttttcctatttttaagagctcttttcacattatctgaaacatagattaattgagactacgtttccagcttcctttttgccttttagtagttttttctaaataaaatttaacagtttatttctttgatattatgttcattgatagtatccttaaaattgtggccattttaccattgttcagatattctcatttattcttgatcctttactctttcatttgttaaaaaagaacaaccaaatatttaatccatcttaaatttatatagtgttgtttctaaccttgaagagtttttcagaaactgatattttttcccccagcaccatctcttctgaattgatttatggtgctttcttcatgatattttaagtttctgcttgttgatctactgtagatttttgtgacagtaatgcactatgtcaattattgcagctttaaaatatgtttaatttctggtaggttaacccgctctcccactttagttattctaacttatgtaatgtatcattcagtcaaattataaaacaattctcgctgaaaatttttaaatgggattgcattatatcaataagttaatttgtgaagaattactgcctttccaatataattctgctaaactttctgtatttacagtgttcttggacacagagtatctgggactcaatgggacactataaataattaagtacattttataattaaccttcagcatcaatttgaaagacagcatcttgcatatgattttatggatattaaccatatactaatttagaaaactcttaagaactctcagaataaatcatcacttaaacagtaaaagctttggctaagctttttgctgtctttctttttacacgatatttgtggaaaactttttttccagtgatttaattttttaaaaaaacagcatcttttaaatatgaaaacatttggtagtcatttcttatctagattttttttatactttgaaatataaaaaagatggtgacaaaatcccgttgggaccttgttataatctgcttttccaagcgcatgtgttttctgaaatttcaaaagcctcgatttgaagttttaaaagctgcaatttgaatttatgtattcagatgattgcagaaaagcaaagaaacacagttagcatttccaggcttgtctcttgacagaacagtttaaacgtgcttcatattggcattcatcacatgaagtgttatttctttgtttacctacttgcttaatgcttatgggaggatttattcagacaagtggtagtaataataatgagtgagatatttaacattacccatctgcaaataagtgctaaatattttacttttagaagcatttcaatacatttagacatttagctttttttagaaagaatggcttctgtttgaaatattggctctgttaccatttacattacaaatgttcccaatgaaattaaaggaagcacgtattacgatggtgagagatttgcataatcagaaaggaagcgctactcatgtgttgctaaattcaatgaatttaacattaactcttaatgaacattttctgtcgggctactcttacgctaagaggaatagactgccaaatcacatggcatgattttggtgaggggatctaacaagtgtttcaggtaaagtgctagatagtttcacagtggaatcttttaatattccatacatcctttggattgccttttatatgctttcaatgaagaaactgaagttctagagattgatacatcacatacccaaaggtgactatcccattttccaaatgagaagtccctctctccaagttttttgatcacctttaacatagaaactttagaaaatggagatacaatgatcacctgtttacatataatgtttaattcattaatttgattgtgtgtactactttaaaattatatagtacaaaatattatgtcattagatcacacttcttcattcatatttcatgcaacaattttgttcaaattcttcacaggcaccttcaacattgaaatttgcatcctcatggatgcacttgttgttgcctaactcagttttccagagggcatcatctttacttacatccatgtggcctgaggtatagtactgctgaatctagaggtaatgtttcactaggaattttactgcaagccacaagcacacatttacataacagaatacagttttatgttatgtaaagacagctttatcttttttctgtgccatatgtccatgagctacaccatgtaaccacttaatgagttacttttaacagtattctttccatagcttgtttacaatggcatccaactcttgcaattgtgatgtcatacaaccaaagtcaatccctaaactgtgttaaatttattttctcccagtgtgtgtgtgtctgtgtgtgtgtgtttttgccctcctctatcaggtttacttctacaagcctccaaaataagcataaattgagaataagtcaaggcaatacatctttcccggacagtactttgttgttttgattgaagtaaaataaatgaccatcttgtaatttgagaaacttcagaaggattcaagtataagttgacccttcccgagggaaaaccaaaacaaaacattgatttctacacacacctagtaacctcctcaggccataccctccgtaggtcattatcagaatcagaacccaagcatcaactttatttttaagccaacatgtctaccatacctggttggtgcttgagttgtacaagtagacatttgttcattttccctaaagtttgtgtcttgtcggaatgaagtgctcctgagggggataatatatcaagatttctcagtcatttatgcctcactattaaggaaatgattagcaacttttgagtagatgtggaaaacgatgagggaaaaacctgaaggttagcaatgcgaatatctgtatggaaagtaagtccaaatctaaatgctgccagttatcagctgagtacgtgaacacgggcgagttccttaatctctttagccctcagtttcctcgtcttaaaattagaacaataaacattttagagtgttgtgaggattaaagttttttttgcagaaacccaagatttagcctagtgcttcactaacagcactcaaaaaaaatggtagagaacataaaaggaggtacaaaaaagggaaaatatggatacagagctttctgttttaatcctagaattgtgtctaagcccacgtgcttacatagataaaagtatttataaaacattatgagtacacaggaggagtactcaaaattgaacttttgatgagccacctgacaactttatttctccctactgacaaactaccttgacaaattttgctggggaaaaaacaatagagaattaatgtcaatctatgagtaaatgtgccaccagatgagactacttctaggtgaagcatatatgtaatcacaatgcaacagccatttattgagggtctactagtgtccattgatatggccgtgaatatcggcagcaatccctgcctcatggaccttacatccgattgggaggaaggggaggcagacagtaaacaagataaagaaataaaatctatagattgtgatacagtaagtgttacagaggaaaaaaatgaagcatggaaaagggatggaaatattgaggggaagatggggagcagttgtgattttataaagggtgatcatagaaggttccatggagaaggagacatttgagcaaagtcctcgtggtagggactggctagctgctcattagacaagtctactcatttctcttaattgtgcagctagctgtcatttcccagtctcccttgccattagtttggctacatgactgagttcgagccaatggagtgtgagcaaaagtgatgctcatgaatatgaagcctggctcataaccccacctccaataaccaccaccacatatgtaatattccttgttctttttcattcttatgtacaagagcacagtgattttgaaatccgtatgttaaagacatcagagccacaaaagcgaagtgccctgggcccccctgatccaccatttggaggaaatctacttgttgaccagaaaatttttgtaaagtttgcatgaacggaaagtttctattatgttaagccactgaggtgtgggcttttttttttttatagcagctttaataaagataggtaatatagaaataaagaagcgagggaggaggccatgcaaatattgcgggaaagaacgccctaagcagagaaaacaagtacaaaggccttgaggcaggagtgtagtaagaacgtcctaaaaacagcgaagaagtgaacaagaagttcagaaatggagtgaggaaaggagattactagatgtggcccaaaagccttctattcagagattctatctggaatctgaaggcttttataatccctatcccacatcgaattcagtttctgggtaaaaataaattatagagcaatatgtttgggaaatctcagactgaactgtgttctccaatgctactttaatagatccaatcaactaactgagccctaggacttccccccagatttttgtgtgtgctgtctacacagttgctgaaacaggcttcgggaaaatctgaggatgctttggatcttcatctgtcagaggcagagttacatcacctatcagtaaagcctgtcacaaagccattaccatccgatagaaaatgcaattaagagggtatgacttcaaaccgttttttctgatttgaatcccagttcagtttttcccttcgcagacattcaaacaccatcatcttcctgcctaaacgtgctcctctgtcaagttcaatggatgactccaccagctcccggttttttaagctgaaagtgtagaagtcatccttgattcttctctctccctcactcccagagcgtatcaataagcatgtcctcataagtccacttgagaaatctctcttgaatctgcccacttctctccatcctcctgtcgctgtctccttcgctccttctcattctgatttcaacttttatttttgatccaggtagtatacgtacaggtttgttacctgagtatgttgtgtgatgccaaggtttagggtaaaaatgatcccaccacacacaggtagtgagcatagtacccgataggtagtttttcaacccttgcccctctccttcctcccccttctagtagtccccaatgtctattgttttcacctttataatgagtacccaatgtttagcttctaactatcttcggttttctgttcctgcattaattcacttaggataatgacctccagctgcatccatgttcctacaaaaggcgtgactgtatgctttttatgactgtgtagtattccatggtgcatgtataccacgtttatttcattcaatccaccactggtgggcacctaggttgattccatgtctttgttactgtatagtgctgcgacgaacatgtgagtacatgtgtctctttggtagaaagattcgtgttcttttaaatatataccaagtaatgagattgctgggttgaatggcagctctcttttaagttctttgagaaattttcaaactgctctccacagtgcctaaactcatttacattcccataaacagtgtataagcattcccttttctctgaagcctcaccatcatctgttgttttttgactttttaataatagccattctgttctgatttctaacagcctctctgagactgctttctaattagctcgtgcctcctaccttgtctccttcttatccactctttacacttcagaataagagatctttctaaaatatgttgctgatcatgtcctcatatactcaacaacatcctagtgccaatgggataaaatataacttctctaacatggtcaaaaagccctttgtgatctggtctctacttctatttcttcatctttctttgcactgtatagttcatggaacaacttactcttccttaaaatccagcactatatccatatcaggattcatcatacaatgttccctctgcctgggatgtccttccatacatcttcatctaggtagctccaggttgacctttccaatctcaggttagacatcacttcctctacaaagctttccttgattaattagacatccccaacccaggtataggtcacaggtcctgttatgtagtcccacagcccctcataatgtttccatcacaggaaatactgtaatttcccatgttcatcaaactattgcagattttctatctattgtgatcgcaccctatcctcagtacttagcatatagtatttgcttagttcctatattaataatctcctaatgacatcatcttaattgtatatctccaagtaataacattatttcatagtagtctggggagattttccatgaagaacaaagtgtgtgtgtatgggaggcaggttctgtataaaattaacgaaattcaaccagggaaagctatacagcaagtgtttgtaaactatggctcatgaaccaagttgtgctcaccacctgtttttgtaaataaagttttactggaacagagctacactcattcatttacatattgtctatggttactttcatgctacaatagcagagttgagtagttgcagcaaagattgaatggcccacaaagccaaaggcatttagtatctggcactttactcaagtttaccaccatctgctatgtgataaatctccttcttagacatctactagggaattaaagatacgagagttctgatataagaaaatctgtataatctctataaaccagtggtatgcgaagtcatgaaaatatctatgataattagaactactcctcaccccttgaaacaatcatgagcactttacacaattattatttcacaggacaaatagaaaaactagacattgcatctgattataaacattaattctgtttaaattcacgaacatttccaactatgagaaactatatctacttaccttagaatcaaacatggaaaatagtcaaaagacctatgcctctgcctcacttttcttgtcttggcttttacattatgccagtttctttatatttctctttcttcctaacccacaaccaactttatcatttattttataatttcacctcttttttgttactcagttttataatttcacctcctattttgttactcaatttttttcccctctgggctttatggtgatttttattactgtgtctgtattttgaattcctcgtggtagtaattctttccacccccagaaaaaatgtcatctgttttctcaaactatgtatgtttccagtggaatatgaatacattatatagagacggaaacccgaagttccccagagagtgagagagagagagagagagagagagagagagagagagagagagagagagaaaagggaacattttgatcatcactttcatactcgagcagaaaggcaaagggtatttccgtttcacttatttaaactctgcacataattgcagctaagttcctcagaaacagaggttactattctttaaaagaatatagccacaggaggtacaaaaatagttatattccctgaaacagtatttccttaaatgtggtctggggacccctgggagtccctgagacccatgcagtggttctgtgaggtccaaattattttcgtaataatactaagatgttatttgactttttcctctctcattctattatgagtttttcagaggctacatgatgcgagatatgacagcacattcaatgcagaaacagatataagaaccagctgccttctcttaagctaacttttaaagagatttgcaaaaatgtaaaacaagatcactcttctcactatattgtttctgttgtagaagagatagtttaaaaactaaacatttattttttatttcaacatgcaattttaaaatgaattaataagtaaatattttgaacaattaccacttttttttttttttttgagacggagtctcactctgtcgcccggctggagtgcagtggtgcgatctcggctcactgcaacctctgcctcccgggttcgagcaattcttctgcttcagcctcccgagtagctgggactacaggcgcccgccaccactcctgtttgtttgttttgttttgttctgcttttttttttttttttttgtatttttaacagagacagggtttcaccatgttcaccaggatggtctcgatctcttgacctcgtgatccgcccgcctcggcctcccagagtgctgggattacaggcgtgaggcaccgcgcctggccaagataattttttttgtagaaaaataatatgtccttgtcaactggcataagtaatgacagcttatcatgcatgccgagtttgtcattataaagacctcagacaagtaaataatacaatgtaaaatgaaaattgaaataatccattaggtatgaagaaatccaccacaaacattccagttggagttcagaaatttgccaatgaatttattagagacagagggaggtgaataatgtaggccaatgactatgagggtcaacttttagagttaatgaactgcctaaatatttactgggaatctctgtgatatgctaggctaagtagggcaccttcaaatgatatacacactgctcacttacagattatatttcactgaggcaagctcgcctgtcattaacttactgtattttatcaacaaatatttgagcatctaccacataccaggtactgattttgctacttgatgaggtagttaacaaaatgttgacaggctagtcagtgatacagatacatgaatgggtctccttttttttattgtttttattttttgagatggagtctcgctctgtcacccaggctggggtgcagtggcgcgatcttggctcacagcaacctccacctcctgggttcaaacgattctcctgcctcagcctccgagtagctgggattaaaatgcgataagcattgaagtgtagctatgcattcaccaaacatttattacacatctaccaagggccaggcactatactatttttgctggatattcaggagtgaacaaaacagagccagtccatacacgtagcttatggtgtcatgggtgacatcaacattaaaccactaatcatacaaaagagtttaatgcaaaccatacatatatatagaaaaaaattaagattgttaggagagtactccttttttacaaactttcactttcagaactttcataggtatgttgctcctaaaggcaaatatgcatcaaattttactttccatgaataaatggggtcactggtcagctatagttattatagtttttggtatcatgtctaactttagactaagatgtgtctcctctgtgtgtatttttgaaatgttttctaaacattattaatctcattatgtgccatgagtacaaaagcaaagcaaatttgttgagagtcctgggaaaacatagaaaagaagcaataataacaataataatcaaggtcctcaacatttataattttctcaaagggcttaactgaatatctatcggtcttttgaatggagacatatgttctaagaacaaaagcacttacagtcatttggaatataacctgtttctaagaagagcagtggatcttacttagattgaaaaggctgtggtggttgtaacagtgagtccctctgagtaagtaacattgaaattgagccctgaaaactatgtcaatatcagccggaatacagatggtacaagacaaaggaattagcttttatcaaggtagaagaaatacttagcgagtcagaggaattgaaactaggaattcagtgtggctaaagtttagagagaaaaatggagagttgcaggagctaagtccagagaaatggacaggtaatatcttctacattacctctgggcattaaaatttgattctgcatgaactttattagtgtattatttattttacatccatgtcaattactaaattcattaaaaatttggtacaaggtacagatgaacttagggagtctacctaacagattactcaagattggttttgatccttgaagtagaccacttcacttagctaagcatccgttttaaaatactagaatccaaagggtatcttcaaggatttcttttttaaacagacctagccatgtacaatagagtcaaggcagtgtaaactaaaatatgtgttttctggttctcagatcaataggacatacagcagactgacatagcacttaggagaaaatttctctgtatgtttacgaaaactgaagggagtttttttttttttctccactgggagctgaccatcattaccttccagctgaatctatgagagaattctgttcccattctcctgaattaatagttgctaagaaaatgccacataatttatttgctatatgacttaaaaggcaaagcataatgaaaatgagagtaaaataaaaggccattaacgagaaaatattgcatatataaatttgtgtcatatatatagtaaatttgcatcataccaatatcagggagaaaagtaagattaccttgtcaagcatcaagcacaagtagctaaaccttaaatacagtggataatgaggaacactgagataccaatattttttaaagcttctatttatttattttgagacagggtctcctggggtgtggtagcatgattatagctcactgtaacctccaactcctgggctcaagaaattctcccaactcagcctcccgagcatctaggactacaggcttgcatcaccacagtcggctacatttttaattttatgtagagatggaatgttgctatgtgcccaagctggtcttgaactcctggcctcaagcaatcctcttgccttggcctcccaaagcactgagatgacaggcatgagccatgtgcccagtcaacttttaattttcatttaacagctttattaagtatttaaggtgtacacgatgggtccataattaacaaacagatcttccccgactgactacgatggtttgacttacaattttgaagttcaccatggtgcaaaagcgatacacatttagtataatcctggactgaggatggggttatatctggatatactcactgtaagttgaaaatatcattaattgaaaatgtacttttgactcataacattttcaatttatgatgggtttatcaggacacaatcccatcctaaggtgaggagcatctgtatacaatgtgatgaattgggatataagcatacaaccatgaaaccatccccataatcaaggtaaccaagtatatgcatcaactccaaaagtttgctcatgcccccttcattttttctttcttcttcttcactttctccttctccttcttcttcttcttcttatggtaggaacacttaagacatatcctcttaataataatttaagtgcacagtacaggcactatgttgtacagcagatctttagaacttatttacattatataactgaaactttatactcattgaacagcaactcccagttcccccttcgcccagcccctggttactatcattctactctctggttctacgagtttgactgtctcagacacctcatataaatggaatcattcagtatttgccctttggtgactggcttatttcacttagcataatgccttccaggttcatacatattgtcaaatatggcaggacgtccttcccttttaaggccaaataatattccctgtatgaatacaccacattttctttatccatgcattcttccatgcacagctatgctgtattgatatcttggctactgtgaataatgcttcagagaagatgagagtgcagatatctttttgagattctggttttaattctttgggatatatacccaggagtgaggttgctggatcatatggtagttctatttttaactttttcaagaacctttctactgtgttctatagcagctgcatcatttttccattaccacctatggtgtactagcgttccgatttcctcacatcctcaacaacatttcttatctcttgtttttggtttgtttttatagtagccatcctaacaggggtgagatgatagtgttcatctcacagaggttttgatttgcatttccctgatgactagtgatgctgagcaccttttcacatacctgttggccatttctatgtcttctttggagaaatatatatttaaatattttaaaaatcaagttatttgcctttttcctgttgagttgtattaacaatcagctctgtttctgtacactaacaataagctacccaataataagcttttcttctattggattatcttgtcacctttgtcatatattgattgaccataaatataagagtttattgctggactatcgagtctcttccattgtcaacattaggagtgcagttagtagatttaagaaaaaaatatgaataggtttgtttcctaaacctacaggtgatctataagcctgtccttatgacagtaccacactgtcttcatcattgcagatttacatcaagatttgaaatcaggtaatgtcctgatttcaaagtcctctaacttttttcttctttttcacaattgttttggctatttggtacatttgaattgctatatataaattgtgggatcaatttttcaatttgtgccaagattgtgcaatttttcaatttgtgccaacatctgctaagatgtcgatggagattgcattaaatctatagaacaagttggggagaatcactaccttatcagtattgagtcttccaattcatgaacatggaatatggtcccatttatttagatttttaatttctctcagcaatgtattacagttttcagagtacaggtttagtacttatattttcaaatttatgaccatttaatctattttatgctacaaagaatgaaattattttcttagtatcattttcaattttttattgctagtacacaggaatgtaatttattcttgtatattgattatcttgcaagcttcatgaacttatcagatctagcagttattttgtggatatcagatttttctacatacaggattgtattgtctgtgaataaagagagtttcatttcttcttctatactgtggatgcctcggattcctatctttctcctggacctgggtttttttgttggaaaattttaaattactaattcagtttctgtgtttgtgttaggtctattcatatgtctatttttttcttgaatcagttttgttaatttatgtctttctaagaattttttcatttaatatgttttgcagaaattgttgacaatgttgttcatgttattacattctagtctttctaatttctgtagggttggtagtaattacccctttttcctttatgattttggtaattcttttttttttggtcagtctagctaaagcttctccatgtaaaaaatattttcaaagattaatgtatggtttcattgatttttctttcttcttcttctattttattgacttctgctctaacccccgttatttccttccttatgcttccttcgagcttactgtgttcttctttttctagtttcttatggcgaaagcttgagttaatgatttaagaattttattcttttctaaaataggtatttaaaactagaagtttccctgtaagcactgctttagttacatcctataaatcttgacatgttgtgcttttatttttattcagttcaaaatattttataatttcctatgtgatttagtttttaaccaatggatttagaagttgttgaatttcaaaatattttgatatcttccaaatttccttctgttgaattccaatttaattctgacatattaagagaacataatttttatgaattcaagcctgttgagtgtattgagatttgttttttgacctagcatagaatctatcccagagaaaatttcatgtgcactttaaaataatatgtattctgctttcatttggtggcgtctcctataaatgttagttaggtcaagctggttgatagtgttggtgaattcttctatattgttgctatttttctgtctaattggcctgccagctattgagagtagggtttgaagtctccaataataattgttgaattgtctagttctcctttgaattctgtcaatttctgcatcatagaatttgggactttcctattaattatatacgtttataattgttatattttctgcttaattgaccccttatataattaaaaatgtctttttctcttgttacatattttgtcataaagtctattttgtctgacattagtattgtcacttcattttttatatgtaaacaatttgcatagtacctcttttttctttgaaattatatggttttggctctaatacatttctcttttaaacaaactatggttggatattttaaataatcctgtctgaaatctctgcctataattggaatgcttagttcactcccatttactataactattgatatgtaggttgagtatcccatatccaaaatgcttgggattggaagtgttttggattttggatttctttagattttgtaatatttgcatatacctaatatcttggagataggacctaagtttaaacacacatactatatatatacatatatatatatatatatgtgtatatatatatatatgtatatatatatatatgtatatatatatatcttaatagatatcttatacatataacctggaggtaattttataaagtatcttaaataattttttgcatgaaacaaagttttggctgtgttttgactgtgactcattacaggtcaggtgtgaaattttccacttgtggtattatatcaaccttcagaaagtttcacattttagagcatttcaaatttcagatttttttaatgggaattctcaacttttagttgcaattacatgtgccatattgtattttttcacatcttattcatgtcttttttgttcctgtttctcctttactgcactgtcttgttagttatttttagtgtgtaattttaaattttgtttttaactatttattttcttagtgcttgctctaaagattacatatgcatcttaattgatcataatttacttaagttcaaactaatttaacacagtaaaatttagatatttttctctgctaagctccatttttgctcctcctgcttataaacacaataacacaatgttataatttttatgcaatcttaggtcttttaaagaagttaaaagaagaaaaacatatatctatatttgtacagtcttttatatgtatctacatatttatcagttctgtgattctttatctcttcatttgggttcgagttactgaatatcacttcttttcagcctgaatgactttatttagttttttcttgtaagtcaggtcagctagcaagaaatattctcattctcaacttggtaatatatttattttacctatatttttgaaggatagttttgttttatgcggaattcttggttggcaattttgtgttctctgagaactctgaatatgtcatttcaatacctctggcctctattgtttatgatgagaaattaactatcaatcatgtgatccctgtacatgaggagtcatttttttctggttgttttaaagactttcccatttgtctttcaataatttcaaatgaaactatttcaatagtttgactcttatgttttagggtattgatctcttcgtgtttattctatttggggtttgttgagcttaaccgtatttgtgaagtgtttggccattatttcttcaaataatttttctgcctctttaacaacattctctttttttctggaactcttgtaacatctacattgatatgctcaatgttttgacacaaagctatgactcatgttcgttttttatactgttttacctctgacattcagattggataatttttatttatctattttcaaatttactgatttttttttttttctgtcttactatctgctcttgagccccattagtgatttttttaaattttggttattctactttccaattctagaattttcatttggttcttttatatagtgtgtatcttttagttgagattctctatttgtagttattgttaccatactttcatttaattatttaaacatgcttttcttcagttgtttgaaggtatttatagtaggagcctttaagtctctatctgccaatacctgggccaattcagagacaacttttgttgactgcttttccccatgagaatgggtcacagttgaacgtatcgtaaatttttcttgaaaatttgacattttaaataacatattaaaggagccccaaattctgatgttccttcttatgcccagcgttttttaaattgaagttttaataacttgcctagatgaaatctgtggaatctgtttccccacagtgtgtggctgttgatattctttctctgtcaaacaacagaaacaaactgtatgcctagtttcctagaggtaagcatagcttaatttgcattagtcaatagttggccagcagttgatcttaaatacctcaagccagtaagacttccaagttttgctaaaggttctttatatgtgttaaagggtatattcaacatgcaggcacattttaagttttcatgaaggagacacaaggagtccttactgaggcctattacggctgcctcattttgcagatatgctggttaaattaaatttctggccagtctgccagtcagttacttgttccaatcaagactgcaactttaggccagctgagttgctattctgcctttttgtttgccgcctaggtctccaccgttactgacaatgcttctggacatggagttttaaacttctgcttcaaataaaatcagtccctgtggtgatgaagctgcttatttccatggcttgttctaccttgatagaactattatgcttgaccaagctgggagtggggactgggggcaatacaggcaaatacaccacaaattcatattgttcatatacaaagtttagtactttttataaataatcactttttaatttagcatatgccgttggttgatatccagggtcataagatgttttctccagtgtgtcccattttactgattcttggggagatttatcgagctactcactttatcatccccagaagtcatgtacccagacactaacttctaagcacctactcatgtgctgggcatagagctagccaatttatttacattacctcttactcttacaacatctctataaatatgtactattatctttatttttggattagtaaaaggaagctcagataatttaagtagctggtgcaagagaaaaaagaacaaattaaaaatataaacgcaaagataccatgttacatacttccaaaggtaataaacacaggtgggaagataggtgattattacccagcatttagttgccaggtttatgtaatggccaacctgaagtccaagtactctgatttactactgcctagtataaaggctaattagcaagaaaacaccaaataagtcagtaggagaaacaagctgtttttgtcatggatagactctaatcattaaaaaaacaatcattatattggctcataaagttagaatttgattcgcacatgtaattctaataaaatccagggtcccacgtgacccatattcgttaaagagttacaccaacagagaatcagcccagcaaaaatagatcatcaaaaaataattataatctcaatttacattttaaaattaatatagggaactcatctacaatttacagaacattccagaactttcatttcttctcctcctcacttttttttatacccatccagttcttcacaatctttcaacctctgaaacactccagaaaccgtatccacattcacagattctcttgttatctttatggggtagataaaccttgcttttgtagatactttccttttacacaatcgtcatttttccttaagtattctccaaattccacaccatttaaaatttataggatgaatggataaagaaaatgtgatatatatatatgcaccatgggatattattcagccatacaaagggtgaaatcctgtcatttgcagcaacgtggatagaactggaggtaattattttaagtaaggtaaaccaggcacagaaagacaaatattatgtgttgtcactcacatgtgggagctaaaaacatggatctcatgaaagtagacactaccttggtggttaccagagatcagaaataggagtagggagaggggacaaaggggaaaaataacataaatttacttattaccactgaactgtatacttaaaaatggtaaaggtatatttacttttatttatatagaggtatattttacctcaataaaattaaatttaaaaaattcaggccaatcacattggctcatgcctgtaatccccgcactttgggaggctgaggtgggtggatcacttgacctcaggagtttgagaccaggtgggcaacacagtgaaatcctgcctctaccaaaaaaaaaaaaaaaaaaaagaaatagctgggtgtagtagcccgtgtctgtggtcccagctactcaggaggctgaggttggaggatcgcttgaacctgggagatcaaggctgcagtgaactgtgatcatgccactgcattccagcctgagtgacagagccagaaccccatctcaaaaaagaaagttcataaaagcatatcaaatatagtacttttccttagacataagaggaagcacatatctgagaagacacaggcttgaagctgttaaactggcaaataatcataaatgtagtggggaatattcactttcttatttgttctaccctgtcgtcactattagctgctttgttcacatagctagatatggtcatatgtaacaataagggaaaaggcacagatctgggtctaaatcactgacttttagttctcgatccttctataactttggttagccttggacatatatcttgttttttcttgtgcttaatgtggtaatttgtaaaatggacataagaatgctgccatgctttgcttatgatctcgaagagtcaggtgagatgatggacgtataaaatctctataactgagatattgcgacaattaagtgggaaacatttgtaaaactcttatcaaagtcctgttcatagagtaaatgcacaaaacttagtgtcattaatactagctcttgtaacttccaaatttatagtttgggtacatgaatagatagtgatatcacccacagtagattttgggagaggaatataacatgttgagttttggatatactgactttgagatggctttgagacatagaagaggaaatggtccatttgaagctacatatgtaggtctaatctgaaactatatattgggccaaatattagacttaggccataaaatgaaatcggtgactttggtagagactgcttagctgcttagcccatgatccattccactacattttgaatgcccattgcagtttggcattgtcatgagaataaattctggccaatgacatacaagctaaagtgttgtgtagatcttccatgaagtccctttaaaagggtagaggtatcccttttttgtccacttcctacaccttgcagcctttgaaaagcagttgtgatagatagagagctgatagtcatcttgatccatgagtgtaaggacctcaccaaaggatggcagatctgtgagacagaagggatctggatcttcaacatcatagagcaatgataccaacctcggactacctactggcagattccttctacaagaagatgaatatatttctactttgtttcagttactataattcttttttaatctccctagatattattctaattgatacagtgaaagctacatttgttgctatggataacaatcagggaaaccgtatagaatgagaagaagggagggttcagaacatgtcctagagaaacatcaggatgtaaggggcaggtaaagcaaggagtgtcatcaatatagtaaggaattacatagagaggtaagaataaattcagataagattagtgacttggaagataagataggaccaagtgctaatacggaaagtgttcagttaatggcacatggcctacggataataggactaagatatgtccagtggatttaactacaagaaatcattgttgttattggcaataatggtttctgagcagtggtttggatcaaaagcaaacagcaaaagagaggagagggaaatgtgataatagagaatgtgtgtttaagtaacagtgactaactatgaagaagattcaaatgggaataataacaagaaaggggaagtaagagacatttgttaactttggttgcccagaatctgaatgccctgattatgtcgaacaaaatccccaaatacaaatggaatctgatgggggaagttcagtttttgaatctggaatgagtgacagaattataaggcactatctagaattctttccagtagcaatgacattcttcacccagtgtctgcagtggtagagtggtgcatggcaacgtttacatctagtgtatgggggccagacgtcgtggcacatgcctgtaatcccagcactgtgggaggctaagatgagtggatcgcttgagtccaagagttcgagatccaatctagggtatgatttggactatagttcttggagctgagcctcttttttgagttctgcccattttgagctggttttctatccctttgtttaggaatgggaacaggtctgtatctttctcctaaagtccgtttccgcttctatcaacaaaaactgggttctgttattcacagctatgaactctgacaagtacagtggaatgaatgcatttggaaaggaatgtctgaatatatttatattgtaatctaggagctaaaaacattcacctgatcagggatagtgaggcagcagaaaaagggtaaagatatgcttgtgtttgtgtgcattcaagagacagaataattaaccggggcaagattcctctgaaatgagagataaggctttctgctgaatataaggattgttatacattcaccatcataatggtaaatgataaattgttagattggcagcttacacaaatatagtactttcattttacaaacgatttttaaaaacatttatcatagtagagagagataaaataaaatattttaattcaaattaacctttgtagaaaaaatcacattataataaatttagacttatattaatggtcaaactatgacaacatataattagtaaaacaaaagagaattttaaagggaacatgataatagacttattatacatatctaagacatccattaactatattaaaccaaggtaaggaatcaataaaatgatcaacacatttttctcttaggactttgggttttcttttgtaaacaaaggtaggacactcacctgaggatagtgtattccttttttggagtgttatgatttgtgattctaacataaaaagaactttgtaaataagtgtttctaattataaaatgtgtctcaaaggacaggctttgagggtagacaattcaagtttcttcagcaacaaggaaaataaatgcagaatgccatttggcctgttttttttttttttttttttttttaaaaatggtacagtcttggtgcagctgctgttgggtccaatcaacagatagactttaaatgcaataaccttaaagggagagagaatttacagcaacccaagtaaggagtctgactggggcatgtatttctttgtgtttccttttcatgttatgggctctgtagctacccttgtattgaccatttgcagtatattcaaataaatgctgtattcatactttaaatatacatatgggcatctactctttccctagggtgccccaaataaaaagggctcatttcttatctgcaatctgtaggatgaaatctttgaacttattttcctgtatgttgtggtaggttttccctgatttatccccaatattttgtttgtcaacccttctgatttgtgatagtttacagtggtactctgtggccccataaagatcacccatatcactttggttcatttgtcaccactagtgctcatctgccacgttggcttcctgacacctgaactccttttccacagcagtgcttaatggttaatgtgtactctgggaattctggtttgtttactggttagcaaattaatgacttgagaaaggtaccttattgagaagcagttagttcaatggagattgccaccatctctacattgacagcaaaatggctcagtgtcttcagcccttgtcttcctcctgatgttcagacttacctattcaaatgcgtgttttctgatcaccttattttcaatgttccaagagctccttaagactattatatcccaagttgagctctgtatgtctgatttgctttcctctttccattcagttactctcctttgtatttcctatcctgactaacagccttccatgcagccagttcccccaagcaaaaaacctggaaaagggatcatcctagaattgtcccttcattcccctcatcatcccatctacttaacgactaaattgttccactttcatcaagtatttcttgaatctgtcaggtttttaaagttctattctgcttactcattgtctctaacttgagtcaccctgccactagtttcactctctttttttcactctgagctcaactgtcaaagggacatatgaggatgcaaatctaaagcatataaaaacgtcccaacatccttatattctaccctggaaaaaattctttgagatttcaaatcttccatgacctggtccatcttgacaatttcatttgtcatggcgtcatttttcagccttcctacatataaaaggaagtccccttatcaaacttgattagggtaagtggataggcggtttttggaaaaatattgtaaaattggagggattatataaatgtgtttacacatcttcaaacattttatttttcttagaatatacaagtggtcactcatttacttctcatttggtatggggtccgagacttttcctggagtaaaagcccacaggttgaagttaagcatattactttttgcataaaacacttctacatttcataatctgtgacttttagtttggtttctttgaattacagtcagatttggagatgctgaaaataatctcaatgcaaaatacctccattttttggggattctatccctcatacccaatcttaaacagttgtcttacctacatctaattcaacagcaccgtggttttttttttttttttttttttcctcactctgtcacccaggctggagtgcaatggcatgatcttgtctcactgcaacctccgcctcccgggttcgagcaactctcccacctcagactcccatgtagctgggactacaggcccacgtctggctaagttttgtattttcttagtagcgatgtggtttcgccatgttggccaggctggtctcgaaatcctgacctcaggtgatccacccatctcggcctcccaaagtgctgggattataggtgtgagccaccgcatctggccttttttttttttctaatcacctttatcaagtcttccaaagcattcaatttagtattcatagaaaccacaattctcttatcttttcatttctatttcattagttttcatgatatttaattaaataggacaattttaataataagaataacttgcatagccaggtcaggaaccacagactgttgcctcttggagaacatactctcaaatggtgggagccaaggtacatggtaccagaaaggatacttgaacacctttcaaaaacatcaataggttactaatatccatcaataggtttggagtgggaattgggcagtttatatgtagaaaatgaagagtttagggtaagtcaatggtgcttgcttaacagagcctttttatactgaactgtgtatagtccttcaatgtaggccattttttcttgcttcagtgattttgctcctgtcactttttctctctggcatgtccatttactcttcatttgcctcttctcatcctttaagacccatcccagagatcacgttccctaacaaactctccctaactcctactttcccaggcacataaagttcatggaaggccacaaataaagtacattcacttgtatatctccacacagtggtatcatcattaccagccaatgcaacaacatatttggtgccagctagtctgtttcactagaactagccaagttgaaaaaataaaatatgacataaaacaattaactatgaagctgatttttcatagtcttttgatgaagaattatgaatgcccttgaaagcttttcaagagtcatcagagaacagatgggaagagaccagcttttccattgacacctgtgaataataatatctgtatgattctctctgatcaatctaaaaatagctctttggtgatatggattgcatctaaaacatcttgtggctatatgtaggatgaggctaaaacattcagtttcagggctaattcctgcttaattcacttaaaaggtattagttgagatacagtgagagtaggataaacaaatgtacaaaatgtttgaatcaaagagctgctttttgccataactagctaaataaattgaagttacttgtctcttaaatgtactaaattctgaagaatacctaaaatattattaaccaaactccttccatttttttaagactagaagggatcaaggtcaatttctagaattgcaaacgtatccatggaaatgtgataacatgataaaaacagaaaaattggtctggctctttagatctatttttaatctatataataatgtcaagtgtaaagatttaaatcttcagtttaatctgaatgtgaataaaattcttacgatttaaattaagaaagtacttactggccatctacaatatatcaggctttctggtaagtactgtgggttatagagataacaataagagagtcctctgccctcatgaagcttttaatcttgctgggggaaaagcatatgtaaataggtatgatacatgatatatacatacaatattacatgagtgttataaaaaggggcaagaaaaccttaagagaataaactgcttatgtttgagaagagcaggtcacaattcattgaggtaatagcagttaagatgagtcttaagggatgtgtaagattttgggaaaaaaaataaggggaaagagaattcaaccaaaggaagcggtttttttttttttttgtcttgttttttgttctttgtttttttttttttgcaaaagctgaagaacagaaaacttcaggtcattcaaagcttcagacataaacagaaatagtggaaattatgaaaaacagggttggaaagataggtcagaacagattctatgttcaattcttttgctactacgtgtggccatcaaaggtaaggagaaggttggtaggaagaaattgcaagtgtataccagagaatcctgatggacaaaactgggataaataatgcaaaatctgatctagagtaaggactccggaggcagactgcgggactgcatcctggttcaaatacttgctggctgtgcaatcttgggcaaagagttttatcagtctgtgccttcgttgccctcctgtaaaattaaaaggagaatagcaactatttcatagagttgttataagtattgagctacgtaaaacacttggaacagtgcatggcaatattaagtgttatcaccatcacttccatcaccaccctaaccgtcatcatcatacaaaggtctgcatgaggtactataaaatcaaatatctatggaaaagcaattaatataaatgagcaaagtgggacaggtgctgcaaactgaggacaaagcttgcttaccccaggcaatgcttctcaaactttaatgtgcccatgaatcacttggaaacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatcatcaatggatactaaagccattagatgatttattaattgcgaagaaaaaatgtgacattataatgcaagatctgtcagtcaccacctgaagcaagtaataaaactttgcagcatttagtgagactacttcatatgatgcacctcctgatgtgacgtaatacaaaatacacagcatctcatatgaagtattctcgccaaacatgtttgacatgcatctcttgaagtcttatttagacctaacttccagtttactagaaattcagagactacagaacaagttaaatcatcccatcaggggaaaaaaaataaaacaaatcctgaaagatgagacattttttgaggctagcgtcctggacattttcaaatttcaatatcggtgaaaaaaatgtggaagggctattttagactaagaaggatgaaaaataataataaccaaatgtaatgcatgagccatgataagatattggtactaactcccctgcaaaatataaaagacatttttgaactattaaggaaatatgaatatggaatggatattaacaataatgcagtattatatttaatttggaggagagcataataaacaggcatggttatatatggcatgtctgtatttcaaagcgacacatgctgaattatttaggggtaaaatataatggtatttataacttatttgcaaaaatgttaaaaagtgtgtgtgtgtgtgtgtgtgtgtgtgtgtgatgccctatatatgagagatacagaaagagggtagagaaagcgagagaaaaaaagcatatatggcaaaatgttaacaattgttgactctaagaatttagggggaggaaaacagtgtaaatgggcatatgttttgcaattgtttcaatttttctatatgtttgaaatttttcacaaaaagacttggggaaggaaaaaattcaaaattattttcattaaggtaacacttaaattaaaaccactattccttaatgcatattagtagaataattgccttatctgtgatatgggataagcaatatcagacttgtctaaaagaagaaagaattataatgttttgaaatcttaattattattgctaaggattatgattcagaggttcctcaatttaggaattccacttcccactgccttgcttccgtctcccattcaaacttttatcaactgacattattctaagtaaaatcctcttcattatgttgtcagcaatccattgcttgaaggcctggctccccagaacccctcgactggtatgtcttctcctagaatactccagaagaaaaggagtgtatgaagatagtgactgcacattaaaatgactgaaaccatagtaaattaggatgagattctgggcagataaacagacagctggctaggatcatttttttatgccttggacttctttggcaatctgttgaagcctgacattcctcagaataatgttttaaagcccaacaataagaccctgtagcacatataataagtactgcagttttgaagtagtgataagcataaatgatattttgatatatttattataactgtaatgagatgtgtacatatctgtgacttcataggtactgattgtactactgtgatttttttgcctactttcaaaatgaaaaggaatgcttaatttcagttagaggttagtaaagacaaataggtaattttcttctccagtgaagagcatggcgccccttgctattcatggacgcttgcttaaagacttgtacacaggcttgctttgtatcaacctatgacttccccttacagccgatgataggtttttatttgcacctccttcgtgtacaaagacagttttggtggctacgccatcattaaactcattattatcatgcttaagcctatagatgtatccagttcttctgttacataattgaagctgtagtgaattgtctatcttaaactgcatcgctaactgactacatttcacacttcatttgcttccaacatagactaaccttcttggatgtccactattatttgaacttttgagattttttttcctatttctaatatcttaaaatttcagaagacttaaagttttgcaactacagggctccatatagacatctagcttgaatttatacactttctttcattgatgtccctggactaaaaaatgttaaatatttctaaccgctgtacttaaagtccattacaaacgaagactactgttgttaagttgaataggcatcttatatatttttcaccggtgcaataaataacttctattcccttctaacatctgcttgcgttgcactgagagtacactattgattagcaataggttcgtgattacagcccttctataattaattgttaggttaacatattattcataaaatattattttattaatttttacttgatttgctactggatgcttagaaatagctatgagtatattggtagaaccagtacttatattttattacatttttacatttcataaaatttaagtgatataaaaatcctgaggaagtatgccacaaaagtggtctcagtggaaatttaaatatgttaacatttatttttaaaatgtagcgtgaaatagacaactttaaaagctcagcttaaaaaaaaaactcaaggaagctgaacttgactttttaaagcactgaagtgcaatatttaatgtaggtcaacatgtttaaatgggaaaatttttttcctaattacagccaaatccctagctgtaattaacttaaaatttgtatactatttcacaacagagtcagcatataccactttcttataaaattagaaagatctaaaattttagagcttatttggtgaaacaggcatattgctacatctttgtttataaattataatgtgcctttagagcccaataacagataacaagattttgaaaattcaggtgaattagagttatcagagggaatgttaatacactctattcaaatactatatgagtaagacatttaaaataggaaacaatactttatatattatagaaaaataatcttccagtcgatttaatccactttatgaattctctccgtatatatatatttatagtatggtattcaatttttttaattttctcatttcttaccatcttaatttggattagattgagcctagttcagaaatgacattatacaggtttatacctgttcatagtataagcacatcagttatctaaataataaaatacttgtatgattaagagaagaatttcaatctgggaaaaaagtatatgacttacctaaggaagtagtttaactacaaagtttagttctttattttatctatctataatcaagaagattttcaaaaccaagacttaattattcaaaatatcttttgatgaggctataattctttaactttggcaaggggtgtgtgtgtgtgtgtgtgtgtgtgtgtgtgtgtgtgtgtgtgtgtgtgtgtgtgtgtttaggtcaactaatgtgtttattttgtacaaaatatgaattgtatctactttctgaataatgtaacatgaataaagagggaaagaggaggtgggcaaagacaactgacataattccaaaatcttctttttaatacatcttaacgaaagatattcatcaatgagttgttctagcttcctgaatattaaaatccacctattatgtggatgatgggtgggatgcaagagcttggcaaaagaacgaagttttcattgttcataacaatagtctcatttggtaaataaaggccaagtcttcctttacgaaacaagacacattaacatcaacaactggaagcataatacaaaatcccatttataaactctctaggctttccaactgcagcagcacgcatttggctttctgtgccttcaatacattccaagggaaatttaaatgatgattgaatttgacagtaacctttttgaggttttgttttccccattaaacttgtacctctttggctcaagttccccttcaagaatgtattcacaaatgtggtgaaactagaggtaagtgacactatcactttttttagcttcatagtcatattcatagctatttttaaaactaagcaaagatctgtctttcctacaaaacaatcatttataattgctttctaaaatcttcttgaaaaacaactgagattcagcttgttgaagttaaaatatattgaagatattcacctttaagcaatcatgggtgatttttaaagcaaacttcaagtttaaaatagcagaaaaccactaactagccacaagtatatattttagtatatgaaaaaaagaaataaaaaatttctttactgctgttgattaatggttgataggttctttaatgttagtgcctttcaccctgcttataatctctcatgaaatattcttctaaagaaagcttaaaaagtctgctaaaatgttttcattcctattagatctgtcgccctacctcttttttctgtctgacagctgtttgcagacctcctgccaccgcagattcaggcttcccaatttttcctgtagaatactggcatctgtttttgaggattgctgaattatttcttccccagttgcattcaatgttctgacaacagtttgccgctgcccaatgccatcctggagttcctgtaagataccaaaaaggcaaaacaaaaatgaagccccatgtctttttatttgagaaaagattaaacagtgtgctaccacatgcagttgtactggcaaagaaagaaatacaaaagctccatgtgaaaatttccctatgaaactgacatgcccatatccaaaggatacaagacagaaagacaccttttatgtgtcagggaaaaaagcaccctctcggttagctccagtttttatttttgtaagcttgtcagctagaggatgttataatgtcctacaaatcaattagttggaaaccttttcaagagcaaattcgatttcttgtccccacaaggatgttccatgtttaatagtctatgaaatgttgtaaaatttaaacatgaacaaagtatttgggtttcttagtgatcgtggatacgagaggtgaaaaagaacaaacataggttagtcacagtattaaaaaaaaactctagagatatttaaataaaattaattgctatattagaagaaaattcatttcaaattctgtctgcgtcaatgtattttgcattagaagccacaaaaaactgagaattaattgctttcaggagcatcccatcaagatatccctaagctacagtaataaattttaaaataatctatagtcaccagagcatttttatgattgtcaagcttaaatattgtttacttttttcctgaatgaaattttaagagtaaagtatcagaaaaatagctcaattgaaaaggagaatattacaaccaagtacacacaaaaacaaaaatgctttttaccattaaataaaaatggcaattacgttctatttaactttttaaaaaagataatctagaatttgtaaggccattaaaataacatattaactaaatacgaaccttagaaaatgaaataatatctgagaacttgaggtacctaccgtatttaaatctgaatgactcaaatccttatgtcactgacagaataatgtgcgtatgtagaaaactctcctaatagatgtgattcatattctctaatatttttgtattctcctactccttgacacaatagcaagctgacagtagaccccagtacatgcttcctaaatgaaggaaggaatgcatgttttctgagactgaggtaaagctcccttagactctcgtttcacatacatttcttggcttttttctttttctacattcaagcaaaattattttcgaatactggaaattttggtagcatacagttagcaattaaaatactctgtaaatcagcaaaccggtgacacggtgcctcacaatgaatataaaactatgcacagttactgaactattcacaagctgtcctggccatactctcttgaatgcccatgagatgtgctctagtaaacatgtgatatttccttgtaactagttggctttgctccattgcttacatctcactctttaccacctgttcagatcagcgttgcatgtgacagtcattgcttagtaatagagacaccagtcataacaaactgtgtctatatattaggttggtgcaaaagtaatcacggtttatgccattacttttatatcataaattctttgaggtcagatattgtgtcttattcatgatagtttcctattgtttagtacaatgtctgatgcatggaaggtttcagtaagcatttgctgagtgaacgcatgaatctatgaataagggaagtggggaagaagcggagggaggaagagaggaaggaatggaggaagaaaagaagggaggaaaggagagaggtagaaagaaaggaagggaggaagttcaggctcatcatcaccatggagtcattagtattaatacccattactgatcctcctagagattcaaataaataagcacaattttctaggtcttaggcagtacataatctagttgaaaaaataagacacagttgcaagtgataatttgttatactacatacagtaggataaaaaaaaagcaaggtgatcaacaaatggtaggccagaagagggatgatctcagtgaaaaggatgagcggaggagacttctgggtcaatttggaatttaaagaatcgtagaacttaggcatatggagggttagaggcagtgagagtacggcagaagttaaagcctgtggtgtgcaatctccatgatgtgaccaagagcataaaactgggctctatgccactgtatgagagcaggcgttaggggaggagtacagccctcggtgtatattggggcctgggcagagaacttgaggcaacgtaaattattaaggcaacatgaactattacatgagaatcaccattgttttggaataaactgcatcgtgcaagcatcagtgactactgaaatgggaaaaaaattttgcctaaaacatagatgtcagggaggtatttagagagtaaagaccatggctcttatttgttccttcaagagtgtccaatacttacaactattacttcatacttttaaaaaatgcatgggcacacatcagatgtataccatagcggtgcttcctagactttaatgcgcatacaaatctcctggagatcttactaaactgcaagttctgctgcattaggtccgtggaggcaccaaaattctgcatttcctacaaacttcaaaaaaatgccaatactgctggtccaggaatacctctttgagttgtaaggtaatggagtaaatgccttttgagtctttgttaagcaatcaaggaattcttattgctgcttataatgctataaactaatgctgcagcatttttatctcagcctctttgctttgtagttttgatcttggcacttttgcttcatggctgatggctacggtgacttttacaacctaattgtggaatcagcaatggttttattatttcggtttcccaaataagagatagaattgaacagctaagagtgaagcaataatttaaaattgttagatctaaatctcatttgtatagaatcgcaaatcagggctttcaggtttttttaattttgtgaaagaagagctcattacacagtctactgcatttgtatgagaaggttttgcaaccaggagaaatatttacagtgcatggcctgctcaaggagagttttcagtgataaagcataagaaagaaaaataagggatcaaaacagaaagtagtagcttgtatgtggtgttttctgagctggaaaagataacactgggtttacaaaattaaatgtaaaatctcaatcaactttattcacacagtgaacaacattaattaattttaattctatagcttctaaatattttaagtactgaattattcattaccaataaaatttccaagctttgatatcatattaatgtactgctgtcataggcattcttatctatttctctggcaattaacatctagtcttggttctggacaaaaagaaaatcataattaaatctgttggattattcatcatagttagaaagcttattgtgttttgattccaatattaagcattcattcttaataagaagtgcatatctaactcccgtggggagcttttcaaaatataaaagcccagaattccattctaagtctactgaatcagaatttctggggacaaaggtatatgaaagagatacactaaaaaagaaaggggaggttacaaacatgtgcagagagttgggaagcaggaaggacatgtagaattactatattattttcaacttctcttctgctttttaagtcaaaagctgttcctaaattatagaaaataacactgttacatatctaagtccttcaagtctggtcaaattgggggaaggaaagaggaaacataggcaaagaaagaactgctacatttttatttttatacagggaaggatataagaaaaagaaaccactaccttttctatgaaaacattacgtacatttttttaaaagtctatttgtaaaactttccaaaactgcatgaaaacacaatagatgaaaaatagaatgtgacaaatgaagaaaaggaataagctaagaagcagttataagaaattgtacaatgacagattggatgaattatgtaggaaataaaaaattggcaaaaaatcacaaactagggagcaagataaaaaaacagaagagataaaatgcaactggaagaaaagataaatacagggaaatagagggaagaaaaaggaaacttcattgaacaaggagatgtttcaagaatccaatactgagatttacttgtaattttgttcatgaattattttgagacaggtaaatcattaaccgagtttactgattggtcaagagaaaagatgtaataaaatgaaatttgggagagttgtgaaacagacttttatggtgcaatttcctacaaatatggtgctttatcttgtttttttatcctaaggtcattctcattgtgtctcttcgtcagtgccaagaattcaggagtttgatatacagtttctgatacttttttcaatgataaataaagcaagttaaccagtcatgctaattattagaaaatatagccaatactgttttcagagattttaatgtgcttcagcaagtttctttcaacttctatcggatgatggatttttgtaaagaagcaaaataaatgcacaaatactcaaggcatatgctaagcacagcaccaggacccattcaacttagcctgtccatagactgagggattccgtcttggtggaaggtctgataaccttgtgggagcacctgaggatagtcagaacaattgaaagatggctaaaattggggaaatctagcagttaggaaaatggagagaagggcaaaatagtatagaaaaaaaaaagagtggaaaaatagtatagaaaagcaactaggaaggataagaaaacagtgaaaaatggctgaaataaatggcctttttttgagtaaagaaagaatgaaagttataggaggtaagaatcaaggtcaaggagagctcagaatgagaaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcctctgaacacattaaatgtttcatcgtggaacatattgcacgtaactcaaaaaacactgtctcaggacgtgatattcgaaaggaagcataggtcattttaaaatttctaatttctcttctctctagaggtattatcaatttggagccacataaatacttcttcaaaagccatttggcgggtagagggtgatacaatatgtatgtgtgcatatagaaaaagccaacaaaattgtttttcaaaaataagacaatgtgcaagtcaacttgattatacactgtaaatatttgatggaagtatctaatgtcattggttctaaaaccctgtagttctctactggtatttgccatgcctatattttcactctgtaagtcaattattgattggatacctcctattagccagacactgtggaaggtgctagtcatcattctctgctggaggatgaatggattggaggagcccgggaatagaagtaaggagaccaagcaggagatatcatggtagttaaagtgaggaaagatggtcgcttggattgaggaggagtcagtggcagaaatggagagaagtgcatggaaccaagtggcatttggaaagtaaatacacaggacttaatgcattggagacagaaatgaaggagagagtatcaatcagacagttgaagatactggtctggaactcagaggaaatattaggactgaaaatataactgagagcattattggcagagctatgtctaaaatttatgatgtgagttttgctccaaatgtgtttgagtcccttatttttattgaaacgattctgggcaaactcaaagctagcaatcataatccaaacatattttgggaatccctgagtatctgcatgatgactaattttgtcattattgacatttgctacatctaatatgtattattttcatttgctggcagagagattaatatcataattagcataatgtagaaaattgagaggccgtatgattccccacaaatttgaagaaaatagaatatcgttttgatgaagctgcttgtgttttcctaccctaactcccacccacctattagttaaaaaaaatggtcaaaggtgatttcaaaatatgttttgagaaagtgttgtgctttaagagaacagaattaagcttgttccttaatacacttctattctgtgttcacaagaattccatgggcctttgctgtggcatagtctttaaatgctgtctaatgtaggtaaattgttcaatgcagtaagtgttctctttagtgtgactgactccaacaaatatttaatttagggtaactactaggtgtctcaagttttacaatgataaataagcttgtattttcttgtcaacactctcaacttaatggggacaccctagaaaatgctgtgttacaatataactatggcgattgctttgagaacaagatagatcaatgaatttggcgaaatggtaaggaaaagaaacagacaagttgaggtaattactattataaaggccttaaagacagtcttttccccatttcctatatcaccaagtacagcgctgagcactgctcagcttaataattgcttaagaaatatttgttgataaattgagcagaaaactaagcaagatattataatcttcttgattgctttctcattctggaaagggtcaaaagtaactttttgaaatacatacaacagcctagagtgaaaaagagacatttaaaaataattgtgtttttatcaaagtttcatctcctaccacaaataacaagttattaaggaaagctgtcgtttctcaggctcttgagaatgggaaggcctagaaatacgataaagagggatcaaagcagatctctgtgtctaacatcaattaattgattttgagcatttagcttagattacagaacccccaagacatcaactaacaatccacatctaagcacatgttgggcatcactaagccttatatgtccctcttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacctctacttatgtaatcctttcattccagttgactagaccatgagatccatgagagcaggaactgtaatcttttctcactctagtgcctagtaacgtgttgctacctggcagtgctcaaaacatgtttgttaaatggataaaggtgtgccccaaatactaactctattgtgaatacattttcaagcaaaagttatctatcctataaattgggaatacattttcaagcaaaagttatctatcctataaaatcatactgtacttgaactgtatctacataatggtttttcacagtctataaaaattaaattttgttattattagagacaaggactcattctgtcatgcaagtttgagtgcagtggtacaatcatagctcactgtagtctccaacccctgagctctggtgatcctccacctcagcctcttgagtagctgagaccaccggtgcataccaccacacccagataatttttaaaatttttttgtggagacagggtctcacttttttgctgaggctggtcttgaactcctggcctcaaacaatcctcccaccttagccttccaaagtgctaggatcataggcatgagccaccatgcccagcctaaatttcattattttgattgaaaatttatgattgtctttatttcagggacattgtcttctttacctttgaggtctccactatgctcatcagttaatttgttctttttactaaatggctaaatgagtgactgagtttcttttactggtatgtggtgaaactgcagaatttttatgcacgttgaaagaatctctaagagcatagcacatttggtaaaaagcatgattaaattctatttctgtacttttaaatacctactaggggtctagcaaaaaaaaaaaatagtgctgatgctgaagctggtcaaagacaattcaaatgttctgcacttcatattagtggtggggttgccaaggaacagagcttttacaaagctaatgccctgctgctcaggcagcaacactgcattctagtagactcttcagataaagtaaaaagaaaagaaacaaaacaggaaaatgtctgtcattcccagtcttcaagttatatgaatgacctcaaaatgatactattttcacccaataatcataaaggtaataatcttcaacacacataatctatatgaatgtccaataaatccatgaaaagatgcttaatagtgctagtaatcagaggaatataagttaaaaccacaacaatatacctacatattctgtaagatagcaaaaattaaaatgactgacaagaccaaatattgacaaagatgtagagtaactggaactctccatcatcactggtggcattgcaaaatggcacaaccactttagaaaactgtttaggtgctgtttgacaatatctcataaatttaaacatttcacccagccattccacttctacagagttactcaaactaaatgaaaacatatgctcacaaatggcttgtacacaaatgtccacagcatcttattcataacagccaaaaactgaaaaccacctgaatgtccatcaaaaggagaatagataaataaattgtggtatatctatacaatagaatattaatcatcaataaaggaatgaacagctgatacacttacatggatgaatctcaaaagtagtatgctgatcaaaatagtacattttgtatgatttcatttatacaaatttttaaaaagacaaaactaatctatggtgatataaatcagaagaataggtgcctattggggctgggaattgactggaaggtagcatgaaaaagctttctgaggtaatggaaatttttattttattgaggtgtcactttatcagtgggaccacttcacaaaagttaacagattgagcatttaatatctttactaacttatacacctgccacagtataagttactgtcacacccagtaagaaagcgtggaaaatatattagatggcagaatctgaatattatacaaagtatcttgacagattgaagttctcaactaaatatgacaggttgaaatgttatgtaagaacaaactcttcctcctctcccaaataagtctgtttcatcttatataaaattttacctcaattaagaaataaaaacaatatcatttttaactgctctccttacttacacaataccttagccatgctaacaatcagggcatccagcaaatctaagtactttctctctcttacttcacacagtacatatggacccttcttatgcaagaaaacaactaactgaaataggctgattgccaaacctcagtcatttgcagacagaatttaaaagagttcagaagactaatcaggttatacaggaacagacttcgtgaaccatcagggatattatacaattcacccttttatccccacacacaatgatcaatttagacaatctataagacgagtcaagtggcatctgtctttcaggaacacacgtgtgtatgtgggggtgtatgtttattagattaagaaggaaaaagcgtagagattcaacgatcttgaatttcaagagaaaatggctcaagaaagcctgtaaaagctctttagaataaaattttgacaatataatggcaaatcatcccagtgagtataaaacaaagatgtgtgccactgtatggacaacctcaaaggtgctcagattctaatagagtatgaacatgggaagaaacgagggacagagaactgagggcaaatattagaagaacaatatagaactgtataaacagtgaggaaaagctgagcttggaatgaattgaggctcgtgataatggtaaagacaacattcagggcctttttacttccatttggaggaagaagaaccagaaagacgaaggttcactgattggggcagaagggagaaggttagggatagagacgacacagaaagcagcagtgtgcagctccttttgcttgtctgctctgtcaaggagaatgttcatcagactggaaaaggcataaccgtataagggaaatgaagcccaaaataggtgagggaattttaaaagagcaccttgctgctctaaatgagctaaaatctctggccctggaccaattatattctagggaaatgagagaacttgcgcaatacagtcctaccccactgtcagtggtctttgaggaactatgttaacactgcagatgggcaaatgtcatctcgatttttaaagacaggaagaggtcactgcgactgtgttccatcaattcctgctaaagagcatttctgaatgatggaacaaggagcaaacaaacacttgttaacaaagacaacgtggaggcagctaatttgggtttgtatgacaactcgttcttacaccagacatgtgtgcctgtgtttgcagttgaatctcttttgcagtatgaaaattgaatttcacatttctaaacaacttaaaaaccacttctttttttttccagctaatgaaagttaaattttcttaaaatgaaataaccatataaataatgaattgtgttctgttgtacaaggagcagcatgacatccagttgcccaccacctgaaaaagtttgaggtcctctggcaaataatggacagagacaatgatcttatacgtgcaccattttgtgttatttgacatggtgacaatgggtctcctttctacaagaacagaacaagaggaaataagattgcagagtagttggggaacctacacaggagggagtcttccgaaaagagatttagactgtatcaatatccagaaaaatgtcgaaggtgatttttggaaaatggcatcattgtttacatttattcttttggttttcttctatcacttttagtggatttttataatgaagagacatacgtttatgatcagaaaaaaataaccctctacccatttgggaaataaattgatataatcttaccaaaacaaggtatttttttctggatttttttattcaagagtgagagaatagataaaatagtctttcccagtactgtatattaattatttaaatatgatattttaaaataaagttatcatactttatctactatggtatcagcacctgtagacataatttactaccatatttgcattagtacatattactaaagtttttcagagatatggccatatatagtgggtaaaagataccaaaaatcataaataacattttattctttctcaagtaacattattcagctcctctaatataatttcagagcttttgttaatggtatttttctacatactagttttgaataaattcatgtctaccatgaactatctagggagaaatgttgttaaaaatgctgttacaagttccataaacttagtttacttgatatcttataaacatgctgccttttgcaaaatacagattactactgaaatcaggaaagcttagaattattaagacagacgtattgtagggaaataagggaaaattgctctaattttgttctgacattcagaatataaagataataggtattatcatgatgtcaacatgctccatcaaaactcccattcaataccattctttttccatatatacttactttttttttcctcatccttggccttaatacaaaactcaatatttcatttatagtttgaaattttgttacatactaccctaatcctatgtggattgaagaagggtataaatcaataaaacttaaaactgaattttctcctttaagcagtttagatattttaattagtaaacacaaacaaataaggttagctatgtattgcacatttaaagaaatatcacactgtcaatgtgaaaagaaatttgtaaggaaaaaaaagaacaaagatcagtctgggacatctgcaatacattccagattcaggaacaacaagttaagtatctacctactcatcttttctggcatgatcttctgttaaaacaaggaaaggcagttaccatacagaaatgttgattttgtcagacagataaagacatcactaatactatgccaaagaataattgcaattatcttattgtgataatttattgctttcatatacttcataaagtgctatcagatgattgttccatttgagatccacgtgaagtatgaggtcagaaaaatgtgttattattcctagggtaaagacgaggaattgggggtctaaatatttgtccaagttgtcctgcagataaaggtcccaggaccaggccccagattgttatcacatttcagtgagattcccattattcggtactggctcttttctgactcaaatacttagatattaaagagatatatgcgagacatgaaaagtagaaagtacaaaaaaatcggcaagttgtacacttttaaattattgtgaaaataattaaccaaatacttcataattatagatgtttttggtagaaaaaagatgattcgatactcactttcctattaaacatctattttgtctttcactttgataatgctgttatcttcagttaaatataatcattatgtgaataaacaatgtggatcaaaaaagaatgagaaatatcaacccagaatatgtttgaagctgatttaaagaggacaacagcatccctagattagattacatgtttttgtaaagctgctatattagaatgtcatgctgacatgattcttgataatgtatttaatgggtaaagtatgcatagtgaacatttgtgtagagttcatcacatctaattttctgttttcttttgatacacgaaggtgaatgatgcaattgtggtatttctgctgttgaacttaatgaaaattctgtccactatcaatcaaatagatcttttctcttgtttgttgtccaaacaaatatgttcaaaagtaattcatttttattgaaaagtcttgtactcacatgatgaaaaaaacacaaacaaggctttaatttatttcacatgcacttgcttgcaagctatacactggagaagaggggaagtttagttttatatttatgtaattcaagttatgtagatagaccaggtgttatataaatggacagatttttaaactagtatgtttcaataaataatatgagccaatcttcagaaatgaatataaacatgtggcatccttctctataaaaacacaaggttgaatggggctcatctgaagtgttgctgcaacagtgtgatgtctgtcctggccgagagtatgtgggatgatttatctcaatatgtttttgcagtaacaggtcatactgaaacaatgatgggacaacaaatcacaatgtatgccatacaaagaaatgatatgggaagaataatttcattcccaagtatttaaaattgatactctattttgaagatcaccatagaattagaaacaatgtaaaagaatagacctggtaataataactataatttctttcaaaaagagaattcataaacatagaaaccaaggactcagagaagaaccacttataaacattagaatattaccttctgccattcctaatttagcatataaaggtaactttttaaaatctctgcttttcataactgagagccagaaacaaaacgtctgcatgatgattaggtgttctttgtatatagcaacagtatccccttgccaattttaacaatattaagaaacatatgccccactctccagaataaatagctgtgtagaagaaaatgctttgaaacattcattgtcttcttaaaatatgaaaatcaacatttaggaaaatatttatgtcgcttctacataatagcctttgggtaagtacagattaacttgacagaggtctttcacgcttaaacatcgacatttaaattttgattgacaaccaacagtaacgagtaacgctttcattttagatatttaaatatacagaagtaccatttgcctgcaagactgagcaaatgaattaatttgttcagtaaatatttattgagcgcattgcatcctgcatcagacagttcctgaccttaggcatttcattgcaggtatagacaaacaataaacaaacaaagatgtacatacacggaataaacacatattgtggtaatagggacaaaagaaaatcacgggatgctttcacagagaataatggagaataatgataacggagactaataatgctcaatagttgaggatttgcaagattatggtgtaactttagataaagtgacctggaaaggctttggagatgaagttactgaaacgggagatgcacaaagaagaacagaattaactacttatccagatggagaaaacagcatgtatgacgctcccgagtcaggaaggaactttatatgcctggatataaagaagctgaaagaaaacgagaatggttggagccccttgaatgaaggggagtgtggaatgaaatcaacttcaacatacagattcatgtacaaggatgttcactgcagtgaccaaaatgtggaagcagtcccaatgcccaataatgggagaataattaattatttacaatcacatctgggagtttactatattgtattgcattttaaaatgacatataaaatttaaaataattctaattattaaacatcaataaaatattaaataaaagatgataaaattttttttgtacaatactacttgctaatgggacagaactcaagaaaacatcaaaaggtgtaaaacccattaagaaggcaacctatgggagaaagactataggtgcttttttgtttgtttgttttgttttttttctgagacagagtctcgctctgtcaccaggctggaatacagtggtgtgatcccggctcactgcaacctctgcctcccgggttcaagcgattctcctgcctcagcctcccgagtagctgggactacaggcacacaccaccatgctcagctaatttttgtatttttagtagagacgggattcaccatgttggccaggatggtgtcgatctcttgacctcgtgatccacccaccttggcctcccgaagtgctgggattacaggcgtgagccactgtgcccagctgtcttaatttaatacttttgtgtattttcaaacttttctacactgagctttaaaaagtataagcaaaaatgaaaaacaaagtgaaaccgccatattgcctttgtcctgaaatattaaaaaacgaactaaaatgggcacagaacaaaaactataatattcctatatgcatgttcacattgagaaaaatagtgagacaaaatgtctgaatcctggtaactatgatagaaatggagtgtgcctatatgcacgtgtgtgaagggaaaggtattctctctcgattatctatatttatctatttatcatttatctgtcatctattagttatctatcagttatctatctatcatctatctgtttaccatctagctgtaggtcataaatagaagacattttaattaatatttgctattgacctattctcaaaaatcactactgaattgtttacaaaactcagcatgctttgccaaataattaagacctttatttgtattcatgagtcttaattgccaaacaattaagacctttacttgatcaaatcaagaaaattagcatatcacctcaaacatttaccatttatttggggtagaaaccttcaaaaccctctcttctagccgttttgagatacgcaataccttactgttgacaatagtctccatactatgcaacaggacaccagaactaattcttcctttctaatcgtgactttgtacccattgacaatcctctccccattctcgcttttcccctacttcccccattctttggtgaccaccgtccatttactgcttctatgagatcgatgtttttagattgtgcatatgaatgagaacaagctgcatttgtctttctgtgtttggcttagttaatacaacatatgaaaaaatgttcaacatcactatcaggaaaatgcaaatcaaaaccacaatgagatatcatctcattccagttagaatggctattatcaaaatacaaaagataaaaagtgttggcaagaatatggagaaaagggaacccttatgcactgttggtgggaatgtaaatgagtacatccattatggaggacggtatggaggttcctcgaaaacttaaaaatagaactaccatacgatacagcaattccactactggggacagagacaaagcaaataaaatcagtatgtcatagagatatctgcattcccatgtttattgcagcattattcacaatagccaagatatagaatcaacttaagtgtttaataatggatgaataaagaaaatattgcatatatatgcaatgggatattattgagtcatataaaagaataaaatcctgtcatttatgacaacatggatgaacctgaggatactatgttaagtgtctgaagttttgactcctgaaatgttataatgtcctcggtttaggatattagcttgagtagaatggcaacaaggtttgcacaaatatttaaaaagtgactcacaagaaaaagtgctatttaagccgggcatggtggctcatgcctgtaatcccagcactttgggaggccaaggtgggtggatcatgaggtcaggagatcgagaacaacctggctaacacggtgaaactccgtctctactaaaaaaatacaaaaaattacccggacgtggtggcggccgcctgtagtcccagctacttgggaggctgaggcaggagaatggcgtgaacccgggcagtggagcttgcagtgagccgagatcatgccactgcactccagcctgggcaacagagtgagactccatctcaaaaaaaaaaaaaaaaaaaaaaaaaaaggaaaagaaaaagtgctatttaaaaatagcaacactaagaataatacaatattaaattttcatagtattttaaagcctccatagcatattaatttattcaaataactttcaggacaccagaactaattcttcctttttaattgtgactttcatacattaactccatgaaaaattgaggtcaccttttataccaattttataactttgaagagtaaccagtgatatttagagaaattatattagggcactctcacactcacgttcttgtgctctcatttctctctctgtctctctctctctctctctcgaaaccagagagggagagacttattgtaataaattggctcattacgaatctggagaagtcccaagatttacagtcagcaagctggagacccaggaaagccaatgatgtagttcctgtctgagtccaaaggcatgagaaccaagaaagccaatgacgttaagttccagccccagaactggaggcttaagactcaagaagacccaaggtttcaattcaagctcaaaggcaggaaaagatgggtgttccagctttagctatcaggcaggagttccttttaatcaggctttttgattaggtcttcaatcgattggacttaggtcctcaattgattggatcagacccacccacacaagggagaacaatcggctttgctccctctactgattcaaatgtgaatctctccagaaacagcctcataaacacacccagaataatgtttgaccaaatgtctcggtaccctgcggcccagccaagttgacacatgaaattaaccatcacagaaattaagtaatttgttgaagttaaattgatagacttgagatttttaataacaatcggttccaaattctagcctgatgtgttttttccttttattatattaaatttattgcaaaatgttcttaaagcaaatttggaaaaggctagatttcttcaggtcagaaattctgccgtattcaatgcatgaagaaagctcaaatgaatctatttgacagacctggagcagttattttgtctgatgctaaggttttgatttacaagcgcaagaaaaaattgtctttgtgctttctgattgtggcagccaagttgagtggggaaaaacaggagaaaaacatgctaatacggggaaaaaaacataaagagaggatttttgcaactcagaaatgaacttatatacaatgaagagcctattttattcctaaaataataatctaaaattttattttaaaaatgagaaagcttgagaggtatttattagattatatactgatttcctttttttaatctctatttttaatgtagactcaggggtacatgtgttggtttgttacaagggtatactgcgtgatgctgaggtttgggcttctgttgattccatcacccagatagtgaacatagtacccaacaggaagttttgcagcacttgctcccctccctcccctcctcctttcggagtgcctaattcgtgttggaaatttgctttaatcttaggggaacattcatagaaaaaactgtacaaagggtttctttacgcattctcaatgatgaaaatcatgttgacattgttctgtcattagaagacatgtacaaaaatagtttttgataaactagcgcttaatgtcttcataacgtaagtggaagcgatgaaaatatactgcaagaaactatttttcaaagtcttcgacatttttactttttttcaactaaacacttcagtccttttgggtgagctctttatattatttaaaaggttcttttcctagatagtttatgtaaatgccttttcctggagtaacctttaaggcattatttggaaataacatagtttctcctaaagtatgtctgtttttatccacaacagtagagtagtaggaaagtgtgtgctaagaaagtacaatattctctttgtcactgtacattattgtagttaccatatgagctaagagactatgctagtgttaaggttgcctttatagtatgattatacctgttattttccttgctctaagtttgttggcatttcacaagaaataatacgtacaaccacaaagttaacttgagctgtgattatgagaaaatggtacaataagttaagcaacacatttaaaacaaatagttcaattactcaatttcatgcggtacagttttaacattgctagtacatcctcagattaaatatacgaaaacattaataactcacgtaagcaaggtgtaaggcagttacacatcctaccacgtgtaaagtatgctactaaatctgaattaaaataaatataagattaaactattactttctagtaggttaacactccgtgaggaaacaagatgtaagcatataaaaagtcaaataaagttttaattaatgttcaagacaatagaagacatgtcatatttcaatacctgatgaatttccaaattgattatacagacaaaatattgtagttcagagagagatcttcaaagatgacaaacaaaaggtctacaaaagaataatttatgagttttcctgaaaaccaatacaggttttgagagttgataagacatggttgatgagatgtataagaaataaaaagtgcaagaacacagggggatttatgacgcataatattgagattatattaaaacaggcattgaatatcaggaagggtgattttataccagatcttgtaaatagaggggatctactacaggttttaaggagacaaacgatatgataaatgttatttttatggctgatcacagtattataaatggattggaatggataatgtgattacaaatggaaaggaaagcaggcagaaagaccagaccagtggcaattacaacgtaaggtactatgacttttatctaagaacttggaaaaaaaagaggtactgagaaggaaaagtgtagcctgcaaaggaggagcaaaagtgggtttgaaccttaataggttggaaggaacaggaagtcaattgtggggatgactttggaggggagagcagggatgaatttgcaaagtcatatggaaactgcggtcatacggagatatccacatgtcatgtccaggtagtagggctagaaatacaggttggaacagagataaaaaacaggatagccaaagccagaagatgagatgtaaacaaaggtgaggtcagagtgagaaagagaaaacaataagcctcaactgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataacctaattatttatttctgtaattttgcacttgatatttttttcaatttatatagtcatatatacttttgtagagcagagggtgagaagagatggatataaatgaaaatgaaactagaaataaattaaaattctttaccaaggtaaaaataaatcttattggtcttatgataatgcattgtcctctgtgatcaccaaaaatctacaatacaaagccagccaatctcttgggagagtgtagaaagtttagggaaatgtaattatattttatttgcagaaggaatcaatatggcggtacttttcaagttcaattcaatcacaaatgtaaagaacagatttgcatttacatctaagcagaagcgtggtggattaaaaagatttcaataacatttagtcatctctttgtcaaaatagggcattcattgaacataatgacactcaaggccatccttccaataaattaccctataaaacttccattcaaaatttaatatggtacaggttggggaatataggtaattaaatgtgtcgtagaggtagaaagaagaccctgggtaaaggaaaagatggtaattaagatttgaaagaataatactgaaataaataggttattctaggaaaatcttatcagtatgctaatcactttaggtcccttatcataggaaagaatcttaaacaggtgcttgggacaatggtggtcaaccccttagcggtttcaaatgctaggagtctcatgacacacaggctctaaaccttgattacctttctacaagaacattgttgcttgttgatctccaatctttttaatacgctaatgtcagatggaaacaaattcgactcctggatggcaagcaagctgcactgggattgggtaaggctagaagccatcatctgcaacacagagataagcgaggctgaattctctgtggccttttgagactgtattatgtgaaatgaagaatttacaagcagaaacagtagctaaaaatctcattattaatgacttttgagcagccacggtttctggtttttcatgtgaatctgtaagagacttaacaaagacaaaaatgtgggcacaaaaaatgtagcaaataaacagaatctgggactaaaatagaaaaatgtaactgtgtctcaaaagtgtttacatactggctgaaagagtgaactgtacagggtttgtttaaacaaaagttatgtaaatctttgctcagctggttgctcaggaaagtaaatggaagcaaacagaggaaaacagaccacgggctggaagagtttgtcaagaatgataacgggcattgaagcatcaggatttaaaatgatagcccagcctctgtaaataatgcaagctcttcaggatgcactagagacccaactcgacagcatgataattttagctaaaaacctgctattccctccacaagactccataaactaaagaagaaagctgagggattgtatacacccaaaacgccaactgttagaagcgtgggaaacctggcacctttaaatctctgattttatcccttagttgcccatgacattgcctgggagattttgcagcacttaaactgggataagttagacaattaaagcatctcagtttttgtctaaccatgctaaaaataagagtgacaggtctgaagcaaacattttgtgcctttgtatgcaaacaaaattcagttgacaaaacacaaagtacaatgactacgaatgagctaaagatacaaaattaagttaggcaaaattcccatgaacgctgtcccttccccgctaaatattttacttccgccactgaaaccctctaacaccaatgaaataaacataagttggtaggacaggtgagaaaaatcttcttaaggagctcaaactaataaccctacgtatcatctggaaaacagtctggcaagaggccttcttttcgcattaaccttctgtgggctccgcacctgacaaagcatggggctgctccccgagaaatgggactcccagtgacacagactaactggagaaaaattggcctgaagttatacatcagtcatttgcagaacaagacttgaggatcatcagcctttggaaatggttttattccaagttatacaggagtaggcacctgctttatatctgcccttagcactccggattaatcgcacatatatagggaaatgaatttctccctgttgatctcttcattgcaatcttgtgcccacaaaatctcaatggaactgcgctaacaggtttaaaagaccaagtcaggaaattcacttgtcacttggttctcaaagtgaacgcgaaagaaactgaagaattcaaaggggtcatggatatttcttcaaagctccaaatagttgtttggtagagatgacgaattttgagccatctgggcaatacgagaaggctcccctgattatccttccttacgtgcttatcaactcacttgcggccctagggagaggatggcatttccgaagttccaaattctctctgtgtgtatctgtgtgcttgagcgcataagttattacatttgtatttacttacttaaatatttattcatttactgaaaaagggcaagaggtagtaaagtaagtccacagagtgaaaaatgagtaggcaaatttgaaagtcaccagtgattactctattggttgaaaagatgcattatcataatgaatgcattagagataacaaacatatgtacaagtgtcaataggtttgtaggattatggctgattttattcgtcttccgtgcaacttcctatatttttcaaattctataatgagcacttattacctttataataagaaaaaagaaaatgcaaaccaaaattgaaaagttttacattttgtggataatttatggcacatctttggaaattttatgttagaggctttcactggctaatcagaaattgctttatctatttttctttgttgaatggaaagggaggagggagggagaggggaataagcaagggagaaataatagggcaaataactggttccactcaagagcaaattaactttccctcatgggtagtcagtacatgttaattgatgataattaagaaaaatgagttttcttttttgtgagcaccaccacacaattccatattttcatattagctaaaggttaaagtcaaactgatccagtacaactttgcagttggatgttaactacttttcatagaaggggccacattcatggtgaatctcaagacctcgtttatttgttaaatgcatctttgcaactattttctatttctccctataccattaatgacacccacaatagtacacaggacatttgatcactatttcttgcatgtctgcatttcctttgctgagaaatagagaaatacataaagaacaaaaaagggctctaagtcccattcaaaaatctacaaacgtgactgctgaacgccttaacaaaagcacccatgaatcggccatggctttatagctgcgaagggacaacacataggcatggagagaaattggaaaaaaagaaaataacgtgaattagaattctgccaatagtattagtgctaatgtaatcaacatgacataagtatgaatctttgaaataccaaaacttcgagtaggtaaagtggttctcaacaatatctttcttctcagggtaatcatagtgaatatgaggatacatcgacagggaaaagaacagtaggtaatttgagggaattttgcagcactaatttagtctccaaacactgattattcagtggtcattattccaaactgcgagggacagtaatgaatccaaacactattcgaaaggcaaactattacagagaatgttacacccttcctaagttgtgagtggcacagatttatgtaatggcaactgggaacaaaaacagccaaggtcagtggaaacctaattgtagtactttatctagttgaataaaaatccacatttttttagcactgaattttcagtaattgaaaacaaaaaaagtggggcttcaattttatatcagctatgataaaagacagtaactcaaaggcttgataccttaaacttcagggttgtttcctgttcattgtaatatcctcagccttacgtagcgttgcaggcatataaccggtccaaaacaataaaaaccatgttgaattaattagtgagtgagtgaacaatgaatgtagaagtagataataagccaggataataagtgatgaactgtgtcagaaccaagatcaacaacaagaaaccaccaacctaactacaccaatgcaatgatgtcatctatgggaagggaagaggaaagggcagtatgctttcatgaatattaatcatttataacgtgtaaactgtatatcttccattccacaatgtgggttcagctcttttcaattaagctttttctttttgcccatataatgatccaatcagaagaaccttagtcaagtgctgctgcaaagaggtgcctgaactgggtgaaccctaaagaaaattctgctgcctgcattggcaagaatccacaagccactctgtatactgcatcttatgtgaatcttctatcatttgtatattcaatcttgaataaatcaatttgccctcttgggtcttatgatcttcgtctataaaatcaggataggtgattgctaggttctgcataatatgaggtttaccttaaggcaacctaggtggcacactagaatcactagggaagctttaaaaaaattcctattctcaggtctcgcaccagaaaaatcaaatcagaatttctgcaggtgggaactaggcatctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagcccagacggcctgacagatgaagttaattttaatattatctcaagaaaagcattaattatatgcatgcctgttaatacgttctggtggagaaaaagatagaaggatgggagtacataatagttagaaaggctgatttgtaaacaaaaataaaaacaacacttcagtacctcttccctattttaaatcacagtccacagttcagcttttccactgggatcacgtcgtaacctgacctgatttccctaacctggtcagattttcttcagaataaaattaataaaagaattcacagaaggcttacaatttcattaaaatagataaaatagttccaacttcataaaaattgtattggcacattcaaagacataaaagaatacttataaattctacaatgcataatctgtgaaatctttttatttgaaaaacaaagtatttagcaaatagcactgtctctccacatagtcacaccatgctgacagaagataaacataaggtcagtaggtcttcctcaaagacatccatccatacactggagacatgatcaattcatctcatcactttcatagtaggggaataactagcggatactttttgcctaaaagcagatttgactctgatgattatcagtacaaatttaaaacgtcaagtcaatttggagaagtgcaagcaaaggcaccaacaaatcaatagtaagattctttgatgttcatcttttaagattctcctttgtactaactcttgactcatactttcccatttaaagtaactgtttattaattgaacattgaattacttgaaatttataataccagctaataactggataagctcttaagggtgtttccttacctgtacccaacgtacagttgaaaattgtggattatttcacgggaaatttatcctgactgaaattgatagcaatgccatacgaaactttcatgaaatttaaatacatagcattgcataaaattaaagcaaaataataccatttgaatttagttttagccttttgagtttggctaatcttaatcactggatgaccactggcttcaacatagaagaaccatataaaaggaaaagtgtacaaattattttaaagtaaatgactgataatttcttacatatcttataaggactattaccttactgttgttgactctacctttctagacatgcctagggactaattggattactttgaaacaatctcttttactgcaaaaggaaagaatttacaaaggcaaagctctatagccaatgagttaagaagttacttactgaattccagagggtgttccatattatactgtggtagtgaacgtggcagtggttgaagtgggttcttagtggatgaaaagtggttctgaagtcgtttagggatcatatgggctaaaattaccatgatagcttcattagcaacaccacctgaagtagaaactgtctctgtataatttcactcagaaccaagttacttttcaactggtctctccccaggatgtgttcctattagctgcaaattcttacaacaaccttatggctaatgaggattcagaatccagaaatggagaatttgttcctctgaagaaagttagaattttaaataaatactgcaacttctggagacttctcaatttaatgtgactccatagtgatcatagtgaccacatgggtgaaacctcttcaaattgataaataaaatggaatttccaattgtgtatcttggacaatccatgcacaattagaaacagatgtaacaatggctttagatgcatgacggataaactataagggccacagttgcatagtactctgactctataagtgtacattttaaacaccttcaatgccttctaaaacataagaacaaaaattgttctggtaactttgatgacttctacttaatcgttgtctttctcagaacaaataggttgaacataaatgcaatgctgtttgataattttgttaaaatgttcaaataaaaaacagtgatttattaggtcccatcgaaaattgcctatttatgtatacaataagcatgagaaatccaaaggaaagcttcatgaaattaccttaaatgctagtttttaacctcctttgaatgagccaatgtgtgttcccttgagaaggaaactttctcaggtctgtgactatttaaaggatttatttttctattgtaagttttcttttcacataacaccagtgaccctggtgatagtaaagctttagcacttggttaaactcctgcgttataatgtatcatattatcatattgtatagaagctgtactttccagtgggatagtcattagccacatgtggctatataaatttaaattaattgaaattaaataaagttaaaacttcagttcttcattcccactaagcacatttcaagttctcaatggccacattatactgcatttctaacattgaagaatgttctataagataggggtgatagagagacggcttctttgtctatctctgccactagtttatccctggtgaggagggcaggggttgagcataatgggttgcatacaacgggcacatataagtgctcaaaaatacagtgaaccaatgaataaatcttgttattattaccactgacactgccatacattaaatacctttcagattaaaagtgcttttacctatcagtggtttccaggggctggggtggggcaggagactgactgcaacgggagtacaaggaaactttttgaagtgataaaaatatttcctattctgatcacggacgtggttgtaggactgcatatgtttgtcaaaactcatcaaactgtacactttaaaaaggcgatttttttgtgcatgtaaattatacctcaataaaacaaaaaggaattggaaagagagaaagtaggcacttttatttgcattttaaaatttcatccttgacttttagagtgactaaaccagatgattactaccgagaaacaacaataaaaatatttagaaatgtaggatgcatcaagtgtgctttggatgtcaagcaacttaggggcacagatttctaaaattgtcttgggttaacatactgctcagggaagacgctagcgggtctcactgggaagacctctcccctccaatctcacccccaccccactgattctctaatcacttttgattttaccatctgttcctcctggcacaacaaaggttcagcaagaaaagtgacagcttcaacaaccttgtcttcaatgatatttttgaaattattggaggtaaaaatcaaatcggtcgatttaatccactatttattgagtgcctattcatgaagtataaattcatggctataccagtctgacatgatttcactaatattatatgaatctaaaacagtggccggaaaaacgtgtgaccaattctgatttccacattgcacaaaagttgacagtgatgcactgactgttctgagaaactttgagggttaactaggaattaggatcatgatttcttgatcacattccctggaaagtaaaccttgtgatagaatatgccaagcaatttggtatgtgcaaagaaatgtaagatttctgtaagccgttcctttctgggtgcagcaggaacttgattggggatttccattagaaaaatctcctgctcatcatgatggtcaaagcctgacccagcttgttaatcttcagagcagaatgcaacgcacaactgtttgcactatccttttactttcacaaattccagtcgctgttgcctctatggtgtcttttaattcaatgtcattacttcgtgtttgttctctatggtgatgtttattacaaagagcacaaagggaacaatttatgcactaaaggtatgtctctgcttatcagaataaattacccgtataagtgtctgcaaaaataatcccatctacttttcttggtgaatattgagtaaaccgttaacagggcagtgaagcatttgattatcttctcaagagaatgaagaccttcatggtcatcctccttctaggactgagagaaatgctaatttctcctcaccaaggttatgaaggtagcatatcatctttacacctagcattagctaagtttctcaatctcaaaattgaagaagtgtttcagtttgttaagcccatgatgaaagcttgtctttttctctcacattctagtctataagtagcacagctatgtctggggtcttagtttttttttagaataaggatgatagctctgtctgtcttcgatgagggcctgagctctaggcctctggatagaaacagaagaggtaatctgtcctacatgtgaattaatgtgaggaaggaatgagaaagcagatataaagtacctagtcactatgatcataatatacaatttataagtgagagctccgatatcagtaatattgttactagtataactcgctgtctttcaactggtttattcatttagctttctccatatatatggtaagccccaaagcatttttttgttctcctctttctcaagcctttctggtcctatggaaagtgttggagtttattgctacagaaattatttctttagtttattgtgatccatagtttggaagttaagtctatttttatagctgtttttctccttcagagcatattttcaatttaacttagcaaacaggcactgtttttaattccaaaacaaagtaatgcataaacaaaaactctaaccccaagaggttcttgatttagctctgctactgtgtatcctcaaccagatagttaaatttaagaaatggaacttaatgtctttgtctgctaggtgaagcagttgaactgcatgacacctaatgtctctgccatctctaatgctactgtttactattcagtgattttagttagccaaataacaaagtttttaagcaattttagcaccctaggcaaatacacccacagagtgaggattttggcaaactattttaatgttacaatggacagtgctggaaaatacgggctcctcaaaacaaaatcttaccttgcctattttagacccagctttttgagagcaaacaatcaagttttgtttttgttagtttcttctcaagacttatcccagggcttttcttataataagtgggtggtaaataattgctgaataaattatggggactcttagagctataaaagatagaatttgggattacctgtgttgcttattagaaaagtttttaaattaactaaatcattttgtgaggatatatatgaactcagttggcctcacatttgccttgaagttttatgttcctgcacttaaatcaacagtgctttttctcattattttcatttcttcagacttttttcccctaacatagttgataaaattccttctgcccacactgaatctttaaaaacacagagtagttggaaaaaacttgtgttttgctatatgtgtataattagtattctgtataaagaaatgaccgtagttctcttgaatccagatgctgcgtgggggttaaattttacagattcagccatttgctaagaaaaataaggtcaaaattttagggtaagaaaataatgagaatgatttaaacttgtatagtacatttcagtttataaatttctttctaaaagtttctttctaatatagtattttatttaattttgacaacaaaactgtgatgtggataggtgtgccactttatagaaaaaagctaaacaaactaagattcaggaagctaagtaacttatttaaggtcacacacctagtttttggcagagacatatgttctggcttcaagttcaaaatcctttccactatactacaattacccctactttacatctaaaaacacttcctagaaatgcgtaagataaaggtagtttttgttttattcctaaaatagattaatcatgtatatcagagatattacaagttgagaattagcaggatgaaattttgacagaaccaacaagatgcaaactgagatagttttataataacagtatgtcttttaataaattacagagtgaatagtttaccaaatgttgggttaaagcaaactttcagccacaagattgaatctgctgttttatccacagatatgtggtttttattgatcttatacttccattttattttaaaatgtacattttatgttaccatcctgggatcaaagtaacttgaaataataggaccttaggtaaataaatccttctgttgggataaggatgaacatgtccatcagagttgtctctttttcctttgctttttaacttgtgttaggcaagtgacagaatatgtttttgttgttctctgatcccagttttattctttgtcactttttttttctgccaaacagatgcagtatgtttcaacagaaagagtgctccaaatctttaatcattatgaaaaacacagtaccttgaccttgtattttaaagttaaatggagtggcattataaaaattaaattggttcttgctcatttccataatatcctctaaaaagccttgcctaacctagagtggatgtcctatttctttatctttcttgatgatctctcatgcctgcaagtcagctcgtttttctttgctgaagactgcaccccactgctgcatgcactctaaaagttccattaaaatctagggcatcatcactcattcttatctgcagcaggctgctgagcagtgccataccagcaactgcatgcaaactagcctcaaaggacaatattagctatatacattgtcattctgtaaagagaagattccacctggatcttaccttatctcccagagcatatctagcctttccaacatggctcccagtgtcagcgctatgaatgggtctcttgcaacagcaaggattacttaaaaagcaatttaccagcaagaaattagctttttataggacaccctttattaaacttggtgtgagatgagctagcatcctgaatttcccccttgagcccactgagaccacgcgggccaaaagctgtttcattttaaatactgtactataaaaaattatacgtattcctctctgatcttgatgaattctttcttgggatggatgtgttattaggataataaggcttgagagttgaacaatgggctaggatttggcactgttcctgttgtcctgaaatgtgaagaaatgttgatgtaacttactcaatgagatgttccctaaccactgggaatagttcactgcctggggacaccagaggagaactacagagatgggggagattggtgaaagagctggggtataaagatacaaaaaataaagaatattaccaccttttccttctttattatatcaaatatcatttttctaaaccaataacagagtacttctgtgggaacgaataaaaaagataatgataatatcaaatatcattattgtcaaacttgatgacttatttctccattttatataacttgtagtaccatcattaagtagtattaaataagatacccatatacatggtactataaataatttcctgacaagtattttacttcttgtctaatgaagtgaagtgaagcactttaatgaagtggtgggtgtaccagtctcagaaacattccgaagactgatttcctaagtcttccaataaactttagctttagacggtgggtggggtgcaggtggttagattgtcagtaaaagcacctaagccctgggtaaattctccagacataataagactgactctgaaagatctttgttgaaaggtgctggataccactctgccatatctatgtaatagtatccattcttccaacagctatatatctagaatcaactctgcaatatttcacatgaaagactctttttcttagagatttagtttccattgttatttcctgtagctgtctggatggtgtcaaccaaggtgaactttggtctaaatgatttttcctcagttattaagtagtgtgaagacaaaaaataataaaataaatgttgggaaattgagaggtatgctgcttcagttatggaatctatttcacataaaatagttattccaagtctaaaaataataataaatccaaaaccaaaatatcggatgtgtagttttaatcaagcaaataaatgttttatagggccttttgattaagagctcacagtgagactttttagtaatttataaccgtgaatactttccacactaatttatcagaagcctttattactacattttccagaattttcaagggggatgtggtgggatgaatagtttcccctgaatagtcacatgtccctgaaaccttgaatgtcaccagatttggaaatagggtctttgaagatgtaattagttaagaatttcaaaatgacatcaccatgaatttagggtgggctctaaatccaaagactggtgtccttttgcggcactattcacaatagcaaagacttggaaccaacccaaatgtccaacaatgatagactggattaagaaaatgtggcacatatacaccatggaatactatgcagccataaaaaaatgatgagttcatgttctttgtagagacatggatgaaattggaaatcatcattctcagtaaactatcgcaagaacaaaaaaccaaacactgcatactctcactcacaggtgggaattgaacaatgagaacacatggacacaggaatgggaacatcacactctggggactgttgtggggtggggggagggggggagggatagcattaggagatatacctaatgctaaatgatgagctaatgggtgcagcacaccagcatggcacatgcatacatatgtaactaacctgcacattgtgcacatgtaccctaaaacttaaagtataataataataataataataataataataataataaagaaaagagtggacacagaaagacacacaaagaagagggttatgtgaggtcaggagcagatgttgaacttgtgctgcttgaaatcaaggaacacctggggctaccagaagctggaagaggcaaggaagaattcttccccagagccttcagagggataattgaccttgattttggacacctagcttccagatttgtgagagaataaatgtctattaagccacccagcttgtggtaatttgttacatctgtgttaggaaacaattgcagggagtatggttgttattatcctatattgccaagtgcatacgaaatttggtttagcatctattggtctcccagagacacgtcaatcttaaaggatgctaaaagctggtaggctttaggtccaaagattgactagaagtaaagatttcaggccaaatacacagcagcacaggtttggggggacgtggtggggagaaatcttgtaaagtcaacaatccattttctagttactgtctagtcacgcattataaatgacacaaacagctcacccttgaagtcttaacattatgaacctcataaattttaaaaatcagaataaagtctctgaatattcagctaacagtaaagtctttaatctaaatggatgatgaaaatggagagaatttatgttagctagaaaattaagactactgaataatttttctttcagctagtgttccatataatggtgatattttggcatatatgtaagataacacttactaaaaaagaaattatctgatgcatgtgaaaatttagagacaggtcattactaccgatcaagatgatttgctactgcccatttgagagtataaggggacagtgggctccggtgtgactatgaacatatgccctcagtaagcagggcagcttgcatccctgagaagtaaatgagtatagatgtgctctcctcaaaagctttcccttcccaccaggagtgtttgtaaatgttgaggctaggtggaaagagttggaataggatacatttttgcaaatgatataaagagggtgatatgaatacagaattgtggagctttgaagagaaagggaataatgattagcatttactgagtaccgattttgtgccaaatcttgttgagcatttttaatacactcatttatttaattccaacaagagttctgcagtatgagtagtacctattttacaggtgaggtaattgaggatcataggattaaaaaaaattacctgaatttacacagtatgtgtggatgtaaacaacgtgctttgccattctcttgtattcttggacctaaaagacctaacggtgtggttgtataagcaaaatggatagacttgaaagttttagtatgaataagagactgtggtagaaaaacattttttaaaactgtagatttaattaagtctcaaaaatgctgcatgaaaaataagtgctataggaggtaagaggtgggagaatcatttaactgttcacagaggagtgtggctgtgagctgaagatggaggattaaaagagaagcaggatatcatagtctatgtggagtctacatagaggaagaggcaggagaacttctggcttgaaacatgagcatgatggaacctgagggtcctcctaagtaggtataagagggaaagttgaaaagtttgcatgaacccagaatatgaaagtcagaatatgcagattaacttgagcctgtgaggactagaaagccactgatacgttttgagctggtaactaatgtaatgaacctgatatatttctcaggaagattaataacatagcggtatagtgagagattggtaatggggagatgggaaggaagctaatcctatattcaaacatgattatttttagaaacaaatagaaacagaggaaatagaaaataacaagaggaaggaagagatatccacaagattgcacatgactagaaaggcacaggaagaggtcaaaagtgtctgaaggataactgaaaataaagggagtcagtcaatcttttagctgctattgctgggggtctctgtaaataagttgctttccaagttcatggcctttgaagcacccttcattacaatcagtgcgtttttctgtaacacacaacgttatcataattttgttttatgaggcatagggcaaagaggcaatatgcatttttaagttcttgaaatctatgcatgtctttaagttagtagacataaataatttttaaaatccttcacgattgaattgaagtaattatgttgactacatattcaatgaaaattacttcattattctctaaagaaaatggacagagattactatttttatttggagaaagaaacacttaagtctatgggcctgaaagggttaatacaattaatgcatttttaaaagtctatattactctcagatgataactaattcacttgaagaacttagtttgatacatttagaggctccttggagttcttcaaaagaggttgctacagagttccagggtattataatcattattaattgcagtattttaaagttcacaccagatgagcttccaagaaaaatgacccaaatttatttgaaaggtcacatatatttattttacttatccaaccacatggtgataaaaatagggaaaccatgataaaatccagctcaactaggtaggtagtatggtatagcagaaacgagtccctggatttaaaatctgagagctgatttcctctttgattccttcatgtaccaattgtgtgattttaactatactgcttaatcctcatatgtcttaatttctcagctgtaaaatgggcataataatgtttgtcttacctcagtgaggacaaattttttttttcagtgctgtaattccagcagctagaactgcgtttggcacagagcagaggctcagaaatgtttgttaaattaacacgtgaatgaatggataatgaatgttgtgcgcattcagtaacatgaagcacatgaatgtacatatatttaaattttgcatccatatctattaaataccatctggatattttatctattatatctgggtaatgaaaataactatacaatgctgtgctactgcccgtttctttccaattctgcattcaatgacgtcacactggtagcttgaaattggctatgctggagcatttgtgcaacaaaatttgccaaatgctgcaaatcagacactctctctccccgccaagagcctcttgttaaacatttaccagcaaaccactgttccaggtcctcattatctggcctctgcttatactttgttgtcttctatcttctctacaacttttgctgaagtcattctgaaatactagcagtcaccaaaataatccaggctctgggcgtcactgcacaatctccaccttgccttgaaaatttccctcctagaaatacgtatcatgtcttagctaacacttactcggatatccttgaaagcagtctctgactaccccaagttagacttgggtacctcttccatgtgtttggctatcactcagtggttatcaccatgacggtattatcctaacgtatgataataattgcttgtttacttgtgtgcctcccctgagagctctttgaagtacagggactgtcttattcctaattagagtttctgtatcttgcttctacaggagctacccaataaatgatagttccatgaacaactaaaaaaccccaatctggttttgtacatgttggcaattcaggaaggctaagtgtgttattagtccaagaaatgtagtgaatagacacaaccactcttacataggcactctgtgcttgacatgatttcctgaatgttagtgggggaatccgttacactaatccacacaagtagtcgtaatgctgctggcaatttcccagacattaacaatgaagatcgttggcttaatgcaaatcattgacgcctgtgacagatcaagtcaatattaattcctgtctgatacttttcttgtgacatttgaagtcatctctgttttgtctaaaaatcttattcgtaggacagccacctacagggccacccagaatggctcattaagccaacacatttcttttgcatctttgtgcatgaagggatctagagaaaaactatattattcctgttttttccctcctgcctcacacaggtcagttgttgcaccagtcattgtctatttcccttaagatcatgtccccctgggaactacatttcccagactcatatgccaatggacttctctggatggaatacgtcaatgtgtggcaatagcagggaactaaatggcagggaaaatacggaattcagggtatttctccttctctctgctctggaaggtattttgtggcttatggctgaatcccctcttgtgttccaactttctgcttgacgcatcctcctcctgtggttgcaggtcctgccgaacaggacaggccccacctgatcctagctgcctccagacgacttcaaattctgaaatctcatgtcaccttgtgcttaaagccccagccataagtgagaacagcttcctgcgactgccaatccctgggttgttttgatcttttctcgtttggcttctcaggactctcatcacctacggaattaatttcctctattaaactccctcccttggtactatttggaggagttctctttattattattgttttttaaccattttttcttcatagtactactatcttatttggtgatgaaaatcaaaatcaaaatattctgaattatctttggcttcctattttatctgactcctcaagtctaaacagttgtcaagcccccccagtcctttcaactttcattatcttctttcatttctattctcattcctgggacaacaatgtgatggccattgccttttccctgaaatattgcaatagcctactaattggggcctttgccttcagtctctttcccttctctgtttactaggaatatggatcatagactttacttaagccagcttggatggatagaaagatagaagggattattgtaaggtttgaggtgagacgataagggagtctctggggaattcaataacagcatctgtcataactctgagcatgacaaagaatgaacatataggtggtcctggattcaaggcaacagtagaaatctcatcagtaagagttcaagcaatttcactgcacttctcttccattattgtgcctcagtcaccccctaggtgtctccctcatttgtttctgcatttacccggctgctactgtttcttcaatttcttctccctcataattctgaattgtacatagctttcaaggctacaactctgtcatgttattaaagctatacagcttctgtatctattctgaaattcttgggttttccaagaatagaaatctgattgttcagctaacttcttaatgccaagctctggtttcaatcaaccatgtagtggaggcagttacgaagggcccgaatgcacccttttactgggataggacacagggcagttcatttaggaacagagtgataatctattatccaaacaaggatatttttgagagcaaaaggaggcccaataaatgattacataggataaacaagtagaaagtgggattgttctgagtaaactgcaacttacagtcaacgtatagagtactccaggcaggcaagtattgtaaattgagtctatttccacttgttagtttctctactgctcttcatatatatactgaatatctctttctcagtgtagaatgtcattcattcttccctaacatcagcctgatcccactgctacgtcaagtgtgtgttgaaatatttttttctccatgaagccttccttgatttagctaacaggaaattaatcttttcttttctttcctttttttttttttgagatggaatcttgctgttgcccaggctggagtgcaatggccagatcttggctcactgcaacctccacctcccaggttcaaacaattctcctgcctcagcctgctaagtagctgggattacaggtgcataccaccaaacccggctaatttttgtatatttagtagagatagagtttcaccatgttggccaggatggtctcgaactcctgacctcgtgatctgcccaccttggcctcccaaagtgctgggattacaggcgtgagccaccgtgcccagccaattcatctttctttttataataaatgcaaatcgtacttcaactgtgcattctagggcttgtatttattttctattatacattataatttttatgcatgtactttgtctaataggtgtaagttcttagggagaatgagccatatttaatacatttttgtataccccacatggcctagccaatactttgcttatagttggtaggcaatgaatatttattaaacgaatgattgctgagttttctgaaaacatcattcttgccattgttgttttgagctcactcaattattctggatcctgatgtctatgaaatgcaaaaagataagatattgatcacgtctaaattagaagagtggtgagataaacagaaataagaggattggaagttaacttatttacataatctgaagaatgtttaactggaaataaaacggacagaagacattttgcttctgaagagataaacaaggaatcctagataattgaaagaaaaggaatacatttatttctcaatgagtatttgttcaatccatacatgatttatttagacaaatatctaatttgaacatccccttggtttctataatttataacatcatttacaagttcaatttaatgtatatggaaatcatagtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgatatgtatgattgtatgatacataataggtttttagcatttttaatacaactctacatatccaggaatccaagcattggaaattgaccccttgggcctcgaccaaatcaagtacgtgagacaaatatgagccttcggtacaactagagtagatttattttattccaaccattatgctccctttagctgtcacatattatgacctgggaaaagttgctaacttctctatagtacagttttctcacctgataagcaaggaggatccctaccttctacctcccagagctgatgtgattattaaaagccagttagaatcttcacatagtaagtgttcaataaacacttgccattactattactagtaacacacgaagaaccctgaaagaacataagtgaaggtcagaagacaaggtggagactattatgaaaatgtttagaaaagttctagttgggtcagagattaaagattaaaacgtttagacccacttaattaaaagacaaattttaacatattagtaataagcctcatattagtactactaagcatactcaaaataggtaagactactgaaggtaaaatcaaagcagtaccagaatatctgaggcacattctccttttgcgaagatggtagttcttaacacccttgtgatttgcctaagatcttaacatactctcaaacacattaatcctttaatcctagaacagtgtttctcaaccttagctacactctgggatcattcaagaaatattttaaaatactgatgtctgggtcctgcctccatagattctgattcaattggtctagatgtgatctgggcccggaatagctcaactgtctccccaggtgattcagatacgcaatcaaagctgagaaccaacagttcgatcgacgcttttcaaattttgacatgaataagaatcacttggagaccttgttaacccacagttttcttggccctactcccaaaaactctgatttagtaggcttggggtggggccaagactttctagttctaacaagctttcaggtgatgccgagcatgatggcctgtgagtagcgttctgaaacttgaacatttggagtgtcagaaccccctggagagctggtcacaacaaagactgccgggctacaccccctagagttttcaagtgagatctggaatggggcccatgcaggtctaagttcccaagtgatgctaacgctgctgatcccgggacctccctttgagaactactactctagataaaaagtacttactctccatctgcatttttaaaaacatcactttaataatctactggctttcaagacattttcaccactaaacaccttatcatagcagcttccacggattgctgtgcctttggattagagaaacaagtacataaggcaaaggacatatatattctccctgtctacttggatgcacagctgcccagcacccagaaaccatctgataccattcaccaagctgatggattgtgtgttgttcattctgctccttatctaatagttcttttatttaactaatgactgtaattctcattagatgctgatagaacactaagttttttttgtggaacttggcaaaactactcatggcaggacatcagttggtgagcattacctaggcagcaacacccaaccctcccgctggcctgagcagcaggtgctggtgctgttagtaatgtcgacataaggaggcaatggtttctctggccatggaagatatgttgtgatttaattcaagaattccttcagtttagaggtctattaaatgaccttctgttatgcaatctgcagtcatgaaatcttaaagaagagaaaacacctttgttttagcctaatggagaacaatcccaaggatctgggaatactattatactctatttcaccttaatgtcctcgcacttgttgttctgaaagcccctccctttccctcctgcttccgggtcacccttactcatctatcacatctattttagcacccagactaagatagtaccacccgagtgaagtctttctcaaatgtcctatctctggtcatgctgcctagttcttggagtgcatttccgtcatggtactcattacactgcatgagaactgggattatcctactcacctccccacaaagcacaagcacataggacagaggcggtatctagcacatctttttctctccagcacttcctagcagtgcctggcacagagaaggtacatacgtaacatcttccacaagaagttctttgaagcaccaatcccaccatctgctatacttgctagtgtttccaagatacttctggatccctcggtatttcttccaaatgtagtgtttatgcctttgatcatcagtgatcatttcacaagtgtgtgtgctagccctgaccataagcaccatgagaatctattgtgttcacagttttatcatcagcatttttagaatatatggcacttgcaagttctcagtaaatatctgcctgatgaaacaaataagtttctgtaaaatgggctgttaaacacagatgaaaagtttttaaaaacatcagggcttcagttaagtaaatatttgggataagaagctgtaaatactaacgtcgagtgcaacaaatatgtcaacacaagaagtcattgagtagaagtattgtcataaaatgtgttgggagctttttatgctcccataaaatgcttggggagcaatccttttgcatttagagaccatttagtatttcttttggaaacggctttgtttgaattcccattccatttacgggcttcttccaaagaatttcttctcagatatgtctggaatctcctttttaccttttgattggttattgtttgggcaaacactcattgtcaactagcaactgataagtaaagggaaaaatacaattaccagtttttcaataattttgaagcatcaatagaaacggattaaatatcacattgccttcaaaaaggggccaaggtaagggagataaaagaggcaaatgggagtttggaagctctgctcaaagtattatgaatgttttacaatgtatttcaggtcaacaaacattggcatcgtcgttgcatttttcagaaaagaatgtaagctgggaaaaaagtttagaggcaaattaagacttgagagacagttctaagtggaaataagggggatgggaaaagaaccctgtattgaaacatcattgatttccttctcacccataaacctacactctgctaaaatgtgttaactgcagcaaaatgattaactcggtgagtctagcatgtgggaagtaaatgacatatgtaacgaggaactggcctggaggtagcgccagaagtatatccaagatggcaagatgaagcaagagtacaacaacttcctggtgtagtgcctttcagaaaatctccctctgttttgttgcacatgacttctttatcttactcaactcattgtgtaataaggtagaagtagaaagaacatccttcaaaattattggaaagtgacagaatgtttgagtggatggctttgcaaactgttgaaaatgtttcatcctcaataccaaatgacatttctgctagcataatgccatgcttttttcccccttctaatactatacaatattagattttgcatggaaatcactccatgcatccatttgacaatttatcgagtacctgtttcaagtgctatgtactgagaatgcgcccacgaacatgacagataatatatctgcacataatttacagtccagtaagaattacagcttagcttcttcctgtcttactccagataaagacccttttccctcattccaccctctcaaggtgcataacttaataagtcagcatgcttaatactgttcgatctaattgtcttgagaatgtcattttcttcccatcccacctttttcaaaagtatttaatgactcctttttgcacagaggttcacattcaagctcctcaggctaacaactcatcccactgtaaatttgtattaatcatattctaattgtcctcttttgtccctcaacatgggcctgccactctggtcactccttggctgctcaatataccacccgtgttctttgcgggggagctcaagtcatttgttttttcctttcatctgaagacacatttgggtgagacttggggatttgtatgtttaagcacccagagtgactctgacataccactactctatctataaactctgcttacaacctaaggccaattcagatcctactctttctagaaaacattcattaactgttacttctcatcatgatttcttcattctttatagtacaataacacttactgtctcatttatttcggcatatatagttccagagctatgtaattacgcctgtttcatagacacaggtcttatccctccaatgagaagacatgttctataggagaagcagctattatcttggacctgtattgaacttctcaaccgcacctagcatggctctaagtatacttgcagcatacattgtgtacttattttattttaacatcatgactcttctagcaacttttgtgagttgcatttaactttttcagtctctgtagggcttacttcacaataggtctcagtgaatgaattaacccttagagtgtccgtttcatctaaaggaggattgcctgtttttgcaagttccagcatctaatgtttcaccttgaaaaatattaaccctgatgtaggtcaaatatatgtaaagctgtattaactttgtttttcaaagacatcatcatttttttcttttttctctgtgagggcttttttttttcttttataaagtaaaaataatttcaaaaatcatattgttctcttgtgatgagaaagcacatacaaaattttatttaagcaacttgaacacgcatcaaattgttccctttgacaaaaagagaaaactacttgtctgggctcactagattaccatgtactatgtcacgacgaatatatttctaaagccaaacatgaaaatttaattatcttgagctacataattgttcttctttggcttcttgccgaattttataattttttcaatagatcgaactgaatttacaagataatctttgaatttaaaacaaagtacattactttttaagccagtaagttaaaattccaattctaaaatattacagtgcactcccaaagcattgtggtttaaaatattcaaaattatataatgataatctcagtgcttttcagttttaaggtattcatgttttagtcaaatgtgattatacttttattcgtatctttcttacacatgtttcaaagctcgtaaaataattatcttatttgttctaaaacttccttacgtatgctgtactttgtcccatctcaatgaaattacatgcagcaaatttgttcctaagtcttgtgttcaacactgagactgtaattcctgacgctgtcattctactttttgaaaattttacattcaaatagaatatctcaactctttctatttgtctgtcttcagataacttattttagtttgttaaatctcagaattttcaccctattcatggggctaagttgaattaattcttaaattgtgaggatttggagaaattatagatattaaagccctagcacaaattctgaaacatagcggcttttttgcaaatgttcattttgcctatggatccacctgcaaggtgggcaaggaaagggtttgtagttctattgcataaggctttgaaattcactagtagatcacgatcagtggattgaatctgctgccttactatctacgttaaagccagttatcagtcttgctggcacatcaacaaagcctgtctttctttcaattaaaagttgcaattacaacttgctttcttttaaacctctcgtagtgattcaacctacttgtccccaaagcgtatttgattgaaaatcatgctgggccggcccaacaaatttcacacttatgagaaattcaccaacccttctcatatcatcagcttattcccccatccaaaagacattcccagtaaagtaacattaactgtttagttaattaaagaccatcttcagaatatagaaactgttatggactgaagtaggtctcctcaaccccattcatatgttgaagttttaacccctgcaagtggaggtagggcctttaaaggggtaattaaggttaaatgagttcatatgggtaggaccttaatccaataagtctaatgtcctcataaaaggaagaacagctacaagggatgcacatacacagaggaaaggtcatgaaggagaaggcggctatctgcaagccaatgggggaggactcaccagaaaccaaccctgtcatcaccttaatcttagacgttcaacttccggaactgcaagaaatacatttctgttgcttaagccacccagtgggtgtttaccttgcttaagtcatggatattttgaaatttttatatacaaacaaaagtaatgccaattaataattatatctatttaacaactagctatatattttatatatccaaagttaatcaaccgaattgacccagtaagtgtaatctttgcttatgtaaacaatacaaacccttagctcatttagattggctccaataaaatattttttaaattcagttaaagtcttaaacatggatcacttacatagcaaatatgtgtgcactacaaattgcagctaatcaatcatttctatttatgtgtgcataccctatgacctgacaatactactagcgaatactgttgagaaatttttaaacatgcactataaaacatatacaagaacacatgtgtgttgtggtttgtgatgaacaaaaacataaaaacaacccaaatgtccatacgcatgtaaaatatatacattgtgttatatacatacaatgagttgcacattgatgaacgtaaatatgtaaaacatagtattgagagaaaagaattcacagagaagattagagatggggtggttcccttaatataaagttcaaatccaggcaaactaaaactagctactctttaaagatacaaatacaggtgttgaacatacgttttttaaaaaatgagcattgtttactagaaattcaagataatggttacttttggctctggggggaaggaaggtgattagcaaggggtaacatagggagcttctcccaaaatactgatggtgttcttcttatttgaaactcagaatgttggaacacagatgttcatattattctttaaacctgtgctgtccaacacggtagccattagccacctgtggctattgaacaattcaaatgtgactaatgcaaattgcaatgtgccataaatgtaaaatatacactagatttcagagacttactaaagaaaaaggttaaatacataattagtaatttttatattgattacatatttaaataattgtgatttggatatactaggctaaataaagtatcctattacattaatttctctgtttctttttctaatatggctagtagaaaattgaaaactacgtatttgactcacattatatttccattggacaacaccactttaaacactccctgtaaacgtttatattgtgatatatttcataataaaaaataaatatgtgttaattgtataataaaatccaggttttcacccttaaggataaaaggagtagttttcctttctaaatacaatataaaccagttcaatggaacttataaaactatggacaccttctaagtaagtcattttttttaaagtagtaggtatacattacctcaatcattcaaaagcaatgagatgtggttaatttcaacacatatacagaatcacttttttaaaatctgctctaaaaatccagaaaaggggcctggattttcccaaaggcaaatctgagtggtgagttgatatattgaattatcactgagaaagaaaccaaaattcaatgaaatcttaatatagcctacgtggacaagtatacaaaatttgagcatagcaacgatacaatttaaggattttgctctaaactaattcaataattagggaagctacagaatgcctatattaaaaattatctctcctttgtggaactcaatctgaccatacaatttgcaaagcagataaattacataatttagcattgaatacttcatctgaatagtaaggtatgaatatctaatggcctctctgttttctaaaatctgctagagtcagaatgtcatgtacaagttctaaagaatttttaagagaaaaagggaattaaaggttattgagactttgaaatctatttttatcagttgacactggaagagaaacgtgggtatacacacatacatatatcttctgtctttatagtttatatagattcaatggaaaataaattcagaatctgaaaatgaattttgatcaggccacaggatgtgtgatacacagaatggggaatgcaaacagggaaacaatgtcatatattgcaaaaaaggatttgtttgggcttggaatcaaagagaactcggtataatcctctttttttttttttttttttcttctgagacggagttttgctcttgtcgcccaggctggagtgcaatggcacgatctcggctcactgcaaactccgcctcccgggttcaagtgattctcctacctcagcctcccgagtagctgagattacaggtgcgtgccaccacgcccagctaattttactatttttagtaaagacggggtctcaccatgttggccaggatggtctcaatctcttgacctcatgatccgcccgcctcggcctcctgaagcgctgagattacaggcatgagctactgcgcccggccagaacttggtataattcttccattcactttctttgcaacttcggaaaaatttctaacttatgaacatcagttttctcaattactgtataataactatgctatcactttgaaggattcctaggagcattaaatgtagggtgcctgtcctactgcaggtatctaagacctggggggtattatcatcttagtttatcatcaaataatgctagagaaggaaaccagcattagttctgctgttctaccctcttcactaacagaatttgataatctacatttgagtgagacctctaaataatagaagacatgcagctagtcacaatatcgacgtgtatgtctcactctgtcaataaaactgcacttacaaaaacagaaaagcaaaaaatattttatttataatgttaaaggaagagaatggtgctcctaaaaagaaaagggacataaatatgttaaattgacataaatatgtcaagaggaaaatagcatttctctttgaatataccaaaaagtacatataacatcacagcactattcacaatggcaaagacatgcaatcaacctaggtgcccattaatggtggacaggataaagaatgtggcgcgtatacaccatggaatactacacagccataaaaactaacaaaatcatggcctgtgcaacaacatggatgcaattggaggccactatcctaagcacgttaacgcaggaacagacaacgagtactgcatgttctcgcttaaaagtgggagctaaacattgagtgcacatggacataaagacaggaacaatagacactggggactacagaggaaggagggaggaagggaacaggcaagggttgaagaactagtggttaccatgctcgctacctgggtggtgggatcattcatatagcaaacctcatcatcatgcactatatccagggaacatgtacccgctgaatctaaaataaaagttgaaattataaaaagaaaaaaagaaaacctcatactaacattctttggaaacagttaaatgaaattattaaaagtatgatgatcatgcatgtgtacttcgcttaaaatatttatgtatgggccgggtgtagtggctcatgcatgtaatcccagcactgtgggaggccaaggcgggcggactgccagagctgaggaactcgagaccagcctggtcaacatggtgaagccctgtctctactgaaaacacaaaaattagccaggcatggtggtgggcacctattatcccaggtacttcggaggctgaggcaggggaatcactcgaacctggtgggggcagaggttacagtcagctgagattgcgccacctcactccagcctgggcgaaagagcgaaactccctctcaaaaaaaaaaaaaaaaaaaaaagtatgaaacaaacaaagaatatattattttactattttagaagagaaaagctctaggataggcagcataacatatggtcagaagcagggacactagagccactgtcttggcagtatgaccttgggcaagtaacttaacctagttatatcatttgctagctaaataagtataataataaaacctgtcctgtgggattgttgtgatgattgcctgaattaatgtagagaaagtaatttgactaacgtctggctcagaagaagcattactacaacacttaggcatcatcatgattattatcatcatcgccatcatcattattactattgctgaaatgaatatgaacagaaattaagtctctgaaaagcaggaagccccactttatgagggatcatgtgtccaagaagaacagttgctttcaaatatctttttggttgcaaagtttttttcttcttcaataaatgcaacaggggatcccaatactacaattaaatcagagtgcatttagttgaacctggttggtagcctcaagtcctcatgtgtgtgtttctttccactatacttggtgttctctgaagcaagtcaatatcaagtagaacagaggcatttaatgttaaaataaaactagaataaggcaacaaagaacatgtataaggatgcatgaagattgtctctgggttgagagtactattaaaacagaaatcttgcatttgacttcgtatcacttaaaagcacttagaactattttaatttaaaaatcctactattaaaaataggtttagtatttaaagaggtaaattctaattttctataactgcagtatctgatgacaaccactagccgcatgcggcttttgaaatttaaacgttatttaatattaaataaaaatttagttccttagtgtccctggccatattaccattgctcagtagtcatgtgtatctagtggctgttgtattggacagcacagagacagaacatttttatcatcacacaaagttatattggacattgctgatttaggacattttgttacatggaaaattatgctgacaatattaggtgtgcagaatattaccataagcaatagcaaaatactacatgggtttgggaacacttttcctttctttatgcactgcagttaatgaaacaacttaaatgtaattctctggaggaatttattttcttaagtacttctcttaaagtgtctgcaatatgatttttacctgagaagtgtggcacagtaggaataaaaacacggtcagagttagcaccttcatgaccttgagaagtcaagaagtctccctaagacccaggggctccaggtaacagggataatgacagttgtccaccaaaccagtttacatgaagaacaagtgagaaagtgaatagaaaaacccttcgtaaactctgaaatcctaaacaaatgttacttattatgatcatttctacatgtatttttttcatctggatgaatgtgaatgaagtgtataatttctgtagaagtagtcgagctagtctaaagcaaaatgtcacagttaaagcatttgagataaggcacatttgtggtccaaagactccagggctactgattagagaaaaatgcatgtctggttaaatacatttatatgataattactagataatctggactttataattcagatataaaatattttgttaaatttgataaaatgttgcctcatctccatttcatcaactgagacatttattttgactttagctttagagataataagctaagagctgccacttagaagcatattaaaacttcacgaagttttacaacatgctaatttaatgctttattagcttatttcatttaagattacaaagaactaaaatgatcttggtgaagtgttgatccaatctcattccacaatgggacttaatttctgcctagaaggcaaacttagacatttaaatttggaaattaaaagaaagaaactgttatatatcagtgttactaaaccctgaagacaaaaacatatatagagaattgaaaattaatgtagttcagctgcctgagatttaatatgctgccaaaacaaaatattattcataaaacacttttcaattgtagagactaaattattttcctcctaaatatgtttctttctcccctttcaacgattaaaaaatgtatctattcctctttgtagcacatagctgtatgtatacgtaagaggttaatgccagtagctataacaaagagatcccacaattttagtggcttaagaaaagaaagaatactacaaaatgggcattcccatctgcaaacagcttttctctacccagtaattcagggactctgagtccttccattttaggctttttcatctcctaggtctttgggactcttttccataaggttagcaaatgggaagtaagaagatggaaaaggtatgcctgcaacataactcccactcacattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctccccttctgttaactcatttttctcccttaaacatgtagaagacaaagtaagtcctggcagagaaaaaaagcttggtgtaaagaagaaaggaattcttgaagttggggacactagagattatcagttgtttttatttttccctgcatcaaacctggattctttcctaataccccttggtttgtagttctcattatcagcatgaaatgaaagaggatgtaattcagggttatagccccaccataggaaccctgaactacagtcttaagaaagtttaagactgaaccctttagcctgttaccttacacaaagcactgtggagtcccttgaacttgagagatccctcagattaccgtggcagcctcttatttcacaaaagttatgtcatttgaaatacagaatcaatacatccatcttctcttgaggaataatgcgagtgctgtcaaatgcctactaaaggactgatgtagctatcctgactgcaaaatgtccttcttgacacaacaaagagcacatcagaccattcagtatttatacaacttgttctttcatctaccacagatttactgagcacctgctatgcgttaagccctaggccggaagttatggatacaaagacaaacatgagtgggtctttaagcaagggagttataaggtcatatttgcattaataaaagtcactatgaagagtagagaataaattgaaggagcaagaagagaggcaggagagggagggagagccagtggtgaagagactgctgaatcaatgcaggtagaaggtgcaggctacccaggtaaagaaatgactgttcaaatgaaaacaagtggataaattcaagagagtttattgtagatttggtaggacctgataaatgaacgtgccttactcgagtatggtggtgccattgtctgaaacaaagaagcaaaagaagaaccccgctcgatggtaggggaaagcttgtgagctgagtttttgatcttatagaaattaaaaggttggtcaagtgtatgaatggaagcagttgcatatacaagtctggaagaaagaagatgccaggatggagggaaaatgtagttggaatcacggaatggatgaggatgaccaaaggaaagtctgtaatatgaaaagtccaggaaaaatccaactttttgaggaatattaaagggagagatgccagaaaatgggctcaaaaaggagggattactaagacttaggcagtacatgttcattcaacaaggagattctggtactacagaagctaaattcccttaagaaggaaggcattttcacccacagcattttgctacagaatgctcgagtataatcagcactaaaaaacatttgtcaggtttggcaacaagaaagttgctgccgtccttcttgaagtgaactgaaggaaaggaggaaattgaaatttattgaacacaaaggaagtgtctgaggaagtgtcttattaatgagatcccaatgcggcatcataagcaagtgatggaagtctctgcatataccattttttttttgtgcagtgttataatgctatattatcaaacaaaacactttctttttcttcatcctcacatacacattttcattttagaaagtcaacgtgcttttacttagtactagtaaatatgtcttgccaaaaagctaaaattgtgtaaatcatcaaaagtctataataatattaatgctctgttttgaacatactgaagcccaggaattgccttatttcccccaacaaccctgcagcttttctgaagagaaacctgaggttcacggatagtaaattatatgccagagatcaagcaggtgggaagatgatagagatgaattttatcccagctctgctggttctttcctcctcatttaacgttccaccaccttattcctttaagctccaagtaccaatctagagatttttataattaattcctaatgtctgatgaaacctgaccgacctcatgcaaaaatattaaagaatacttattgaataaatcaatccaagatacaattgaaaatgtaatttaattaggtagaggtcaaacttcacaaaacagaatataacataaataatcaacaccataggcaataagatagacatcttattgcctcaatttctgcaggggataaattgggaaataaggaacacctaagaatcagaaatgaggtagaaatattgaaataaaaacttgatctagaagatcacagtaagttcttaaaacgcggtcctcctaggacccagcacaacacgtaataaatgctgcctggtttgaattgaacttaaggtagcattaacaagaacttgggaagtgctgacacaaaatggattctcttattctagacaattcttgtactgaatgaacttaatttctttcagttctggcatagtttggatgaatcttcctcataaccatctggttgtcttccttcaattctgtgctgctaaacaaacttctgtttttaatttgttttgctaagtaaacttagtcatgaggaaaatgttagtctatgtggatggtcgtgtaatattctccggtaacctttcccccattacaaataatcacattgacattgtgctcattatccactagtttgaacctatggggttcaatgaagaaatgcatttctatgtctacatgcttagcaaccagatcctggtctcagagataaaatgccaggaagaaatcactcgacgataaatccacgtctcagaatttgctctaagcctgagaggagatgacggagttatgaagtgctagatgttgaaactcttatgtgcagacttcttgagaatggagttaaaaaataaaaacagagaaaatcaaagtcaaagatataaaatgttgagaaatcaaacacctgacattagctatgagaaatgtttatggcaaacactgatcctcgctttctcccaacaagctgttatctaattgttatttgttgtgtgatctatatccaccatttcaatcaaagcatgagcaagacttatttcaatagccatagcattgctcccagacaaacttattcattcctcctccattcattatatttagctctgttacagcatcaactgtggaatcctgaaataattctcttacatgtctgcctccttcaccagattgtggagtctgtgaaggaaattatgtactctacaaatatttattgaacacctaatatggaccagagactgttttagatgataaggagatagcagtgatcaaacagtcaaaaatttctgtccatgtgaatcttacacttcaagtaatgggggatgatgtaaatttggcattgaagaggtttggcttgtaacttggaatcattattttctagctctatgaccttggtaaagtcacttgaccaaaacttgagctgtcttatttataaattgaggatcataataccttatagcatggctataagattttaatgaaatgatatcatatggcctaataaaaaagtagctaagctttactgtatacctgttttatagtagcactgttgtgctttaaatcttacaacaagtcttcaagataggtatgattataggaaggttaaattacttagatagtcacaagttagctagtggaagagctagaatttaaacaggcagtttaattgcaacatctgccctgttattcactgggctctactctgtatactgctttctttagtatcacaaagtgcctgccgtatagagggcagttgtgacagtgaggatgctattagttgctcataacataaagctgcactcaaattaatcaaaaacagtaaacaaagggattctactggttcacgtcattgaaaactgcagaagggggctgcaagtgaagttcaatcagggggtcctgctccatatctctcagtactcttaggtctccctcttgtgtctgtcagccttatttcaggttatcttctgtcatggtattacaaaggctgcagctctaactatcacatatgtatattacttagttcaacgcaagagaaaaagaatttcccagaaacctttgcagtaggtctccttgatttttattagtccacagtaggtcatgaggtcatctttgaacctgttactgtagattgcactggttcatctgggcctgaggtatatgctttattcctagagcaataccatttgcgctccagaggagagttcttaccaccgcaaaaatccacatattcaccaagggaatctctctcacacagtcaatatagtttagttgaattaattaatgtctcaaaaataaattaagcagttctcacatatttgtagacagtattttctaactactaaatgaaataacgaaagtaaaaagaaggcaaaagaagaaatactctttaagcaatctcatgtagtaatattcattcacgtaatcattcctggcatatttctgtttgaaattcagtcatctacatggaaacagcggaaggggagctcaggacaatatgccattaatatttcatacacaatctgtttaacactaaacaattcatttttataggagttttactcatctcccacaaattcaaatgtttgtcttgctaatttttcatatttaaaatttgcttttcagctagcattcattcactaaaaggtctttgtacacctaatacttcgagttcaagctcatgcagaactattttattattttctagtaggaagaacagataaacatttcgttgcaaatgtggtagagttctgtttttaacgccaatattatctgtgttcaatgcattatctcttatgagctacatatttttgggggggattatattttttagatgtacctatttagtgttccaattaggttaatgctgaccgaaagattttatacaactaaaataaaattaaattgattgaagatatattttattgtttatttgaaacaatacttcataagtgatatgattttagatttatactgtctccatttcacattttcatttttagagtactttattgttatttagtcactgaatcttttccacatccctcgtaagttcaatctggaatgtatatgctagtgatttgttaaacatgtaaaattaaagtattgatttttaaatataatgtgtatatatttatttatagtgatatataacagttgtatgtatatgggggctacatgtgatattttgatactttttagattgctcaatgatcaaatcagggtaattgagatgctgattttttattttgtaagaagtaacagaaatgggaaaagaagcacatggaaagcgcttagatgtaaactacttgagtgtcactgcctctgggttagcccaatttaggccatctacacataaaagctcgatgtggttatttcagaaaaaaaatttagaccttaacaagtagggtccttgcccttgggccccatgctttcaaaggcaaagctctgattaggagtctgtaggaccaagccaacatgctcactagaagccccgctcccatgatctggcattcagaatccctcaactccctgggcaaatgtttcaaagtcagttactgggtatggctaaggggtaaatctttgcatgaggtgagtgggaaaaacttgaacatgtgggtgggaaatggggcgaccagatctatgtgcacagagttcctcacagtgcaggatggagtaaaggaggtagggaaaaaaggcaacagattcacaatagctaagatgcagaaacaacctaaatgcccattggcagatgaatagataaatgtggtatatatacacaatggaatactattcagcctttataaaaggaaattctgcaatatgaaacaatatggatggaccttaagattacgctaagtgaaacaagacagacacagacaaatactgcatgattccacttacttgaaataaggtatctaaaacagtcaaactcataaaatcaaagactggactggtggttgccaggggctggggatagggcgaaataggaagttactaatcaacagacattacatttcagttaagtaggatgaattagctctagagatctgctgtccaacattctacctagagtcaataataatgtattgtgcatgtagtatttattaagatgatagatctcatgttaaatgtcattaacacagtaaaattttttttaagcttaagaaaagccaatgtatcctaaataacaggcttagggttagctctaaccaagctgcctcattccagtacaaaactctaaggaatttattttattgtatcaagtggtttgctatttgagttttttccaaattccttgccagggaataaactgcttgcactatttaaaaaaacaagacagacagacagacagaaagaaagaaagaaagaaagaaagaaagaaagaaagaaagaaagaaagaagaaagaaagaaagaaaggaaggaaagaaagaaagagaaagaaagaaagaagaaaaagaaaatgagagagagagaattctaaatcgaatctagatgtccatatcattatgattgtataattgtcaaggaaagcagataggatatatttaatagtctgttgactttataccttataaatattaaatatgtggcatgcaggcaaccatttgcacacttactataggccctgcaaaagttatggggcagttctaacctcatatgactatgcagaagactatgtgatacagattatcaaaagatgacaattttttaaattcccagaccaggatggtatgaggagtgagaagcttttttagacaccaatgcatagctcttacagctgggatgctctccgaaggcattattattcctttttcttaagggaatgaagccagacataacacaagttataagttacgagttagaagccatgacttgaacacattcaaaagcatttccctggcatacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaagatttaaaatggaaatgtaatgcattgaaatcaactcaaacataaatttcacacatattttgcttttttaacaaaagccagcgttactgcccaaaatgtaaatgttctggtaaaggaagatatgtacgctattttcaccaattaattttcataaaaagaagcctagtaaatagaacataaaataaatatttaacatccttaaatactaaaaaattaattatcttcctaaggaactgtgacaaaaagaaaaatgtgatttcttgctttgtaggtcaaaatactttatttgctacttaaattttcaattccattcaacaactatttactgacttgttcttatatgccagaccctgtgttagaactgtgtacacaaattaatgtgatattgtccatgttcatatccatagtccaacccatcttagggagtttaagaagcacttcatcttaagactaaagctattattttaggtgtgtttataatatctaaatcaaaattctgaaatacaattattttgcaaaagacgacaaaagcatcattttactcaactgatcctgaagttttaaggcatatttgatttaaaaaatttaaaaaagaaagaattggggttgggaaaggggagtataaactgatgatataaaaatcactcaatttagactctagtaaggacacaagaattaccaaaacagttacttctcatttaatcattttggtttgtttaaactctttagttatttgggaaagaaatgtattgagtacctgctgtgtgttagatatggtgctaggtcctatatgtggatgtgtgatatgactgatccagttcttatcctaccgtaacttacattctagtaggcaattgcatgagagttccttaagagctataatagcagaaatacaggcttctaaaaaacagaaagaaatacaccttctcctctactagagtgttagaaaaacacatatagtaatattaaatatatacagatacctaatcagacttattggtttggacagtgggataataaggctagtaatgatttcctggtagaaaaaaaatatgtaagtcttcaagagtatggataagctcagataaagtaggaatgggagagataggcaggggtggtgatgtttagagccactgtgaatgaattcatgtcccaacgaaaaaaacaacagggaacgttaggatcgctgattccgggaattgtacagacctttttccttgcgtaagctaagtagtttttagagttacaaggaaaagagatgtaagagactggaggaagaaacatttaagaatctgaaaggacttaagtccatctgggaaggaaaagggaaagggaggaatggcaaaggttagggcgaagtgtgttagggggagtagacaagtgagagagtcctttgtggttaaagaactagctaataaactaggtctgaaagttgttactctatccctggaagaacaaataagaattactgaaggcttttaggcagaaaatgaacacattcagatttttgttttttaaaaaattactctagcttttgtgtagaaatagattggagaggagcaagactgaaattccagagtctagggtgtagaaatagattggagaggagcaagactgaaattccagagtctaggcaagagatagtgttttgaaatctaagcaggagatcagggtcatctgacttttggttttgggtgtaaagatggggaaaataagacattctagagagaaaatgtaagaacgtatttaacaacaaaacttagtgattaattggaggtatagatggtgtccaggcttctgctttattcaactaagtggatggtggtcatattaaataaatcagggagccagggaggagaagcagaatttatagatgaggtgatgagctcaggtgagtattttaagcttgaagcacctgagggacatctaaatagagatctattagacatttgtgtattcttgtagcttcctcagaaaaatgatttgggctggaattatagcttaagggtcatcaacataagaatggtaattgcgttcaaagacaagattacccacataatgtcaagtaagaggaaaagaggtcctagatcaaaactatgaaggatgtcgtcaatacttaatggaagggcagatgaggaattcacaaaggagttaagagtgtagagtcatataagcaaggaacagagtgttttaagcagaacagagttgacagtggtccataataaggtgaactaggataaagactgtagaggacccaccaaatttagcaacatgaggaccatcagtgtccttgatgagagtacctcccatgagcctttgctgctagaagtcaatgtgcagtgtgttaaagcagggctggcaacatgatgtggagacaacaaatatagataggttgtttatgatagagggttatctgtaaaggaaagtcaagagggaaataaccagtgtagcacatagacttcaagggttgttttaatgattaaacaaaaatactagagaatgttcaaatgctcatagaatatgggatcaatctctttctcaaaatactgataggatgatgtgaaaaatcatgtcttcatgagcaagcaatgtggaggcagtatattcccacagaacatattcatggaagtgttaacacaaaatattttaccaagtaatgaccatctctaaaatcacatttgtaaaaactagcgtgctttattaaatcttcatgggcaagattaactgatagacacagagcatttatttgttcaaatgttgagaattacaaattgaggaataattatttctaatgatagattcttaaaactcttattattaaagatataatacactaaaacaataattttcagttatagcctccttccattgattcaaacgaaagacacacaaagtgtaaccgtgcataaatactgtcaagctttgaggaatatcgatttctggaaatcctccgttttattggtaccgagattttccacagaaactcactaagcaccactttttgtaactatcccatgatactcattatacgtgccatgcacacggtcaatttctagtaaattagaaagtaactagcataatcctattatttatttaatttcaatgatgttatcattgaatctccagtattctagaaattctttgtttccagtgtatattcatatatggaataaaccactatttattttaaattatagcaattttagaaataacctcattattccaatttttcatgttctgcagacatctcacaactgaacttcccaggctacaactttaatgtggcaaacacataaccaaaccaaagtagaactgaccggactgtggcagagcacatggtcatttgttcaatcacttggtcattcaacaaacgtcttctaatcagctagaatatgtgccaaggtctggccttaacataagagatacaaagaggaataaactgtaaatagtcattgctctctagggcaaatctagggaggaattcagacaaaaataaatcctcatataataatagtagaaaactcaaaagggacattaagacggatctatcgactgccttaagccatgatgttggactagggagattatacactaggttcgtctgggaaaggtctggtgtacagctttgtcccgtgacctttcctacactttttattctcaaaataaatacattagcaatgatcttgtaaggtgaaacaaaagtccatcaggaaaacaggagttggcgggtgggaaatggtaccttatgaagagaacaaaggaaacaatagcatgggatatcagagaaactctagcaacacagtatagctggggtgaagagtatctctgggcgaggtcatcagggacaaagtcaattagagggatagacagagttccaagtgtcagggaccttgttggtcagactaagcaatctgaactatttggaaagcaaacaaggtaaccctggaggattcctgaatttcaatctagaatcacacactatacttttttttttttcaattttgcatgacgacttcagggaaacatgccaatgaaaaaatcaagttaaatcattacattaataaatttacttagtctaggatttggaatatttattgcaagtcaaactaacctgttagtcattgcatataaacaggttggctaaaatcaaattttaaaatgtagatatcaataggtagtctctgctctcaaagggcttacaatttccctgtaatcgtgtcacttggatcagcttacacagattataatcagaagcagagacagcagagataactcctgaatagagaaactaggttaagaataatgggcatagatatgtctgtgtgtgtatgtgtgtgttttagataagttactgatcttctctgagcctaagttttctcagatgaaaatgagaaccatgaagccttccttacagggtgaataatggcaatccaatgtaaaggagggggggatatttattccaggaaaaacgaacaagagaagtagaaacaacacatacagtgcttgcaaagtgtataataggccttcaagaaatgagaattattatgctatgtcacagtctgatctcattagatactctcaatggcctcatgagaaggatgagaaaggaatacatttctcccattttacaggcgagggcacaaagagaacaaaaaatcaattatttgcttcaaattatacagctatttattggaaacacttgggctcaaaaatatcccgtttccaagtctttaccctttctaaaatgcacactgtccgtgaaacatgccaaattgattttatcatcactaagatgaacttatccatagatccttgtgcccccaaatctcactgtctcagttcttgggtgcctcaagtccaagttcccagggcatctgtctatgagtaggatattcacagtgagtaaaaaggtaatgccataaaaatctaggtgtgggttagtagaatccaaataaacgatatagaacatcacaactcatattcaaatatgttaactaaagtaatgatttcctattacttagagtgagggtctcaaaatgttcctgaaatagatctcaaaatgtattccctctgtctagttgaaactttgtaatctttgaacagtaactctctattccctcactccacctcccaagcctctgttaaccatgattctactctacatctctatgaattcaacttttcttacattgcacatttaagtgacatcatgtggtatttgtctttctgtgcctgggggaaaaatgttcatgtacctcagaagtaaacacattttaagcatgtaccctatataaatatatattcacagacatatgtaattttaaattacattgacactagttttgtagacacaacttacacatcacatacactataaaatatacaatcaaaatattaatttctagagaacaagataaataaaaagtattttttctcactaccccaactgtttagcacgcatattattgggcatgtacattccactttggtaacaactgacctagataatcaaattcaaggtcgttggagtgacaaaatccttcataacttcactggtgtgtgtgtgtaagcgtgtgtgtgtatatgtgtgtgtgcttacaatccccactagattttaaactcaaaagagaaccaacaatgccttcatattttttcttctctctcttcaatctgtgttccctgagatccttttctatttggttcactggccctttaaccccaaagcagtttccactctgtggaagaaggaaatagtttcattatattttggctctgggttgtttcttcatttaaaaccgtagctaaagtccagaccagagaatgatttgaaaaccataccttaagaatgagtttttcctagtacagtagacataagaactctctggatgggggggagtcaaaaagaaagttggggaggaagcaagaaaattagatgcttgtaggtttccgaagagggggcctgatgtggcagtatttcatcagcaagaagggcaaaggcagattcactaaatttcttgaggcctcagagtgcagccagcaagtggctacatttttcctgtccctgaaaagagtgtgggagttgactgaggaaaagagttggtcatagcaagagatgcttaactgaaaagctgcatgggccatgcagtgttaaactcaagaaattgaggccttgagaaggggacccatgggcagatgctcaagagtaaagacattcagaaccaaggtgcagacaaaaccgtgcatccataagataacaatgtatacagacacatcccctgaaggccatacgtgcttcatgaacacttgggaactgggatgcctacacagaaagaagatggggaggaacaatcctaaatggaaaccaatgaagaaaacctgaaatcaatatggttatgttttctgtcttcaagtagaaaggggtcatgtccatccattcaaaagaatggctaagatgagattaatcttgcatttcccggatgcattttccccaagttggagtgtaagccagctctttggagctttagaactaagcatcatctcttcttccttgctgacatatgttctattgaacatcttttctcaaaatagacctgtttcgcccacattgaaaatctgtcaaggcaggtctctccccccttcctggtgatctccacaagtgttggaagggatgtcctggcagtcgtggacctgcccacttactgccaggtggtgccgattcaactgggcgcagagcccatatggcatctgtggcttgagacataagtatcatcagccacagtattccccaaattcttaaaaaccttctgctttctgagttaacattgggcttattgtcatctagtactgttgcttttattctagctgtatactcatatgtttgagtgttttgtttactgatacttcctcagtttttgtttctttcctgtacatcactgtaacagcagcacattctccacacattgaaagactcattgtctgtccttgagcatcatctctactgtcaaatgatagccctcgtacatgcatccactacattcatcattgtctcactatttatgttttgtaactctcattattattataggtcttcagtttctaacactttcaaattagcactgtcgttgaattaggcataattagatttaaaattttgctaaagtactccacaactaaggaagaacagggctccaagtggttaacattaactttggtgggggtatgataggagagtgttgacgaacctgtacttggagctagttttatttctatttaggctattactctctctttctccatgcttccctccctctctcccttcctccctctctctctctctctctgttcatatatatatatatatatatatatatatatatatatatatgtacacatatatacacacacacatatgtatacatatatacatacatatacacacatatgtatacatatatacatacatatatacatacatatacacacatatgtatacatatatacatacatatacacacacacacacatacacatacacacacatatatgtgcaataaagaactgcctgagactgggtaatttataaaggaaagggatttaattgactcatagttcagcatggctggggagacctcaggaaacttacaatcatagtagaaggtgaagggcatagtagaaagggcatagtagaaagcaaggcacctcctttacaaggtggcaagaaggagaatgagtgaggagggaagggggaagagccctttataaaaccatctgatctcatgattcactatcaggagaacagcatgggcaaaaccaccctcaagatccaattgcctccacctggtctctcccttgacacacggggattataattcaaaatgagatttgagtggggacagaaagcctaaccatatcaatgtgtgtgtataatttatttctggtagatgaacatgttcatcaaaatcaactatataatcacaatattaactgaaatatctgacttttaagaactttaaatattttagaggttgcctacggctgtacaagtaaataaattgatagagcacattcttttaaatataaaatgagaggaaatagtcttaattagattactacattttccccatggatgtgtcatagtacattctagaggaaaaaagtaattgattatatgaagattagaataggtatatttaacaagcaggtagtgtttgtggaaatgttctaagatgttagaaaaataagaataagatctactgtttcatagcacaatagggttgctatagtcagtaataacttaatggtacattttaaaataactaacagagtataattagaatgtttgtaatacaaagcacaaatgcttgaagggatagataacccattctccatgatgtgactatttcatattgaatgcttgtgttaaaacctctcttgtaccccatcaatatatacaccttcctcatgtaccccgttgacatatacacctaccatgtactcacaaagataaaaaacccattgaaagaaaaaacttaaaagaaaaatggaaatgctctaagagatgacgacaggtaatatacgtcttagtgcatttatgtatgtgtttatttttgcaagagatagacataactgtcagcccctggacacagctcagtggatagtgacttttgctaacacttaatggattccatatgttcaataaaaaatcattatgagaaagttcactgaaccttttatacaaactaaccatgcaaagctcaattcaaaaaggcacctaggaagtgaatgcaatacttgcatatttcctttgacatgaataaatacaaaggcattttattttaattgagttaaagcataatagtttctcttgcataaataattaaaatagaaagaaaaatagcatataaggagacttactgatatcaggcactgtcctaagtatattatatacactgaaatatctatcaaaacaagcctatgagagacgattattagatcaatttgagagaaaaattaactgaggcttacgtaggttaactcccataggttatactaatagtgatgcaataaaccaggagtttcacctaggcagtatgcccaaagcccatgtattttaatcattataatcagactcctacattacataccactgattttaatttggaaagataatttttttctagaaatgtttctcaatagtattttgttctaatacaaatgtgaacacctttaaaatcctaaaagtgttaaacaagttggggggtaataatctgacattctcccaggtaaggggatttcgaataaggtcttcctatggcatggcaacattaaagtcctcactaagcaacatgttatttaacttcatgacactgggaagagagtatttgccagctttagaaagcaaatgttaagaatctaaacattatcaaggggactattttgcttaattttgagctttcaacactaaagaagtatataaaggaacatgggtatacttcaatgattatgtaagggtccaggctaatcaaatcatcactgaggtggctattacacacaccaaacatataatcagaaaattgtggctcatgagaagtttaacttaagcccttcctattcaataggggatgtcttaggaccaggatgtttgatgatatccctgaaatcacaatgcctattaatgttaacagcctattaaaaaaaaaacctacacatatccttttatcgttattatttatttatttatttatttaattttttttttgagatgaagtctcgctctgtcgcccaggttggagtgcagtggcacgatctcggctcactgcaagctctgcatcccaggttcacgccattctcctgcctcagcctcccaagtagctgagactacaggtgcctgccaccatgcccagctaatttttttgtatttttagtagagacggggtttcactgtgttagccaggatggtctcgatctcctgacatcatgatccgcccgccttggcctcccaaagtgctgggattacaggcgtgagcctccgcacccagcctatatcattgttattactatcgttattactactattattccaatgttaatatggtgcccactgttttaaagtagaaatgctattatttaatcttcttgtgttcgtattcaataaagaaaaatataagtattatgacaaggcagtgatttggacaggatgtttcgaatgcaggcatgttgacatataactggacatgagccctgatatagtttggatatttgccgccactcaaatctcaagtggaaatataattcccaatgttggtggtggggcctggcgggaggtttttgggtcatggggacagatccctcatggttttgtattgtcctcagtgtagtgagtgagttttcatgagatctggtttttttttaaagtgtgtgggcatcaccttctgccatgagcaaaaactccctgaggcctccccaggagccaagcaaatgcctgtgccacacttcctgtacagcctgcagaaccatcagccaattaaactttttttcttgttgaaatataatgccaagtgttggacttggggcctggtgtgagatgtttgagtcacggaggtggatccctcacagcttgatgctgtcctcatgatagcagctgagttcttgagcgatctgttttgttttttttttttttaaatgtgtggcaacctccccctggcttctgctctggccatgtgacatgcttactcctgtttcatcttccactatgagtaaaagctcccggaggcctccccagaagctgagtagatgctggtgtcctgcttcctgtacaacctgcagaatcatgaatcgattaaagctctttttaaaaatacattacccagtctcggctatttcttcatagcaatacatgctaacacagacccaccctccccgtctgtccttgatactcttgtttttctgccgattttattcctattgtatctactctttgtttgatgttaagaaaatgatctttgcttcaaaaattcaaattataatcctgcaagctctttgatataagtgttcaatttaaattaaaaaggcaaaaccaaaataagactaagcataagaaaataatacactttcccttagttaccagagtgatatatttgaacattttaaatgctttcaaaaaatcaaatttctaaactgttacctctacttaatcccacagaggtgataaaattattggcaattgatgatcatgtggataaattgactgacaatttcattcatttattcattaatagctcctcattgatgtatgtatcccaaatgtctcctttccttctctcaaaggggcaagcaaaggaaatggaaactgtaacagtaaaagccatatactctaaggtggacattagaaagtctcttggtctacaggtcgtttttaatcctaaagacagaataatctacctatatagaaatcattaaacaaatagaaattttgccttataaatagtaggaaaatacatacctacatttatggcctgaaaaccagcatcagctatgttatagttgtccacatagaactaatataatgtactgggtagaaagtgaccatttttctccattttgacccttgtcatcactggaagaacatggattccattaaggttcccacattcattacccttctcctcacacagaaatgcaaacattgaaaagtttcttcgtggagagttctattttgttttgttctttttgcattaaaagttcaatactatttattcaagtttatcaagctgaatgaacaaatggcctattataattgcatttcatattttgggcccttaaatttcgaaatctacgtttccaaagagaaagttaaaaacaggggaaaatgctgctaaattatttgatgagcttcatatttgtgatgctctcattttagttacattaaggcaaaaagccaaaataaaatcccaaggcttggagtttgaaacaagtggtgaaagggaagggagcattgataagagaggcaggaaagatagatttaatggcattttttttgttttaaataatgcttaagaagaaaaattatgtttattacactcagtttatttccctgtggaagaacaaccttttcctctcctcagtctggaactcatactctttgccacatgacctgtgggaaattgacttgaacagatgttttggtttcacattaaatctacaaattattttgcgtaattccctagtgcccatctactataatttttatgatgtctctactctttgttttttacatactatgacaaaagagtcataagacatagtgcctagtcagtaattggctcactgaaatgcttagagtttatatatttgtaagaccacacaaaatttcaagcaggaacctttcagttatcacaatctttattaatactctcttgaaattgacactttttaggcttcatatgccaaaaaacatgagagtaataattgaccttatgctttaggacatgtttcttcttaaatacttcttattttaatattagtaacaattctactactaataatatctatggttcattgaatgctagtctacataggtgcatagatacctggatatagatgataaatagatgacagagaaagagaaagatagaaacagagaaatatttttactttgaatgaaatacattatctctcccatcctaataaccaccttccaagataagttcacatcttattattagagatgagaagatttagttttaacaatagtgtttgactgaacttgaaatacacaggtgtgtaaatattaaaacattaaaacattcctaaaatctttgcagataattagaaagagtctagcaaacattatctgtaataaaaacatatatatttaatttggaatgtgctttaattttgtggtattttgtgaccactctgttccttgtcccttgcctgtgattagtgaatatagagtgttcatttattgacacttttatccactatctctggaggacaaatgtgaagtagttgccaagactctactttaggcagtttcacatatcattaaaacaaaaatttacagattatgtatttccatgaaatatgacaataacaaattggaaggctgagggctaattttacacataattttgcaaatctgtttgttaagaatgagtatgcaattcatacattgacattctggtagttcatcagtttataaaactagtgaaatggaagaatgcattgaaatttaattgttggtatcttcacacttttgctgactatattaaaacagatacattgaactgagtggtcccgcctcctaataatttataacatcttcagtttctgccactaatatttatcattatcttatgaacaggtctgtgcattgaaataataataaaaacgataaggaaataaatagacataactattatttattcagtgtattattaagtgtatgatataatgccaggcatcctagatatatcatctcatttactcctcacaatgaacctattaagtagatgtccttgtgcctattttaaaaatgaggaagataaaacgtacagaaatttaacattttgcccaagattgcaaagcaaactaaatgcatgaacaaggatttgaactgtgtttttttttttcatctggaggcctccgttcccaagcatgcttttaaattttttttttctcttgacacatatcataaggtttcttctcatttttcacatcatatcaaccagtctctttgctgttcctggaacagcatattcacatctctgggcctcggctcttactagttccttatcctgactcatttctttagatagtagcatgtttcattccttgacttgatttaggtctctgctcagatgtcacactctcagcctcctctcttcaccactcttgctaaaatactgcttccctttttcctttaccctgatgatttttttcatcgtacttttaatctgatattttatcatatttattgggttctttgcctcccctgctaaaatgtaaattccacaacaaagggacgttgttttctttatggatggatacctggtacctgcaacaaaacctggcacaggctgattgactagtattggttgaataagagcaaaaatgaatgactactgagatttaccctaaaattttcaaatattttgatgtataaaaatagtctatgaatgtaaccaaactgtgtggacagaggctgatggggtctcaagtggtgtgtgtatgtgaagggtaagacattttagaagaagtacctatgctggattttgaaactctgaaaggacaaacgaatggagggaagaaacagtagactgcgggatacttgagaacgagaagaaacaaacaaacaaacaaaatgaatgaaagccactgtcagttcttggaacacagagttgggaaaatgtattatctatatctggagaaatactcaagtcaggggaaggagaacagatgactggcaatgaagggacctcaaagcaaggtctaattgagatttgagacaacagcatgcatccacttggagttcttacaaagaggaatactatgttcaactgactcgtacatttgtaatacgtccgttaaaaaaaccctattgctattggaaatgagtatggaaagctttcagaatggaagttttattccattgttggtaaggggtgcaataaattattcatgcataaccgcaactacaaggaaatgggcataaagaggtgaggtaagtaggaataagtgctagtgcatatataattactaaatggaaatggtttgacaagtctgatacaaaaaggctctctggaccccaatttcaaataaaagacctgaagtgatacatttattccttatcccttcagagtctccattttctataagcgagccccctccacaaacgcaccattaaacctgtacaatctatgacaacaatgggaatttatccaagatgtagacgtagaagtgatgggtcaaagtgatccacagttcacatcagataccattaagtgtttttatagctctttacctcctctagtataaggactcaaaaatacagcttgaatgatccagaaaattgaaggtatcaggctttagtgatacctaacaattagttggatgaggttctgcacttgaagggcacttggtttttcaggaaggaagattttttttcagtaatttttgtattcttactggggtgttccttacactgtattccatccctaagaaaatgctactttttcattatcagttgtattgtatcttgacatctaattggcaatacaccacatttctctataaattatctcgtttaaacagttactttcctagttaagtatatttaacaacttagattctgacagttttttaataaacgtattttggtatttttaattaaaatcagtagagtataaacaaatagaaacacactaaagacaattatgcattttaataaaacaaatgtgcaggtccggaaatgttcatagactcttgattttatttacctttagtattataccaaatgtgaccagtcatttttcaaatttgagcatggattatgttttttttctgcctatatcaaatagtataggggtccaaaacaggtttttagggagttattaagtctatagaaaattatgcttttaggaagtgttgtgcttatgccaagtgggagaagcataataataaaatacaaagtttacaaattatactgcctaggttatacaattactacataattgaaaataaaatttaactgctgtgtacatcatttatctatatcaaagttacctatgcttaatttgaaatcactgtaataatgctgataaatgaaagaattgaattgatttctacattaaaatgtacaattaaacctgctaaatatgcaactgtactttttatatgtgcctttattgtagtaaggatagaaattgttgattgtaaatgtaaaccttatgttctataaggaatgatttcttaaaaagggagtctattacaatcagtaatatcataaaattttaaagataatagatgtttttcatccagttcaaaatgcttcaccatgtgggctttttgatcctatctttaaaaacttttgtgtccatgagaagtataagttaggtaagttttctaagttaactgaaataaaaacacattgaatttcttaaaatcctagcaaaatagtgtaaaataacgtacctatagtcttctctggcacatctttatatgaataacgtgaatcatgtataaatatccttgaaatatgtatttcatttacattgcctcaggctaacttcctctttttttttttttccccctaatagagacaggctctcactgtgttgcccaggctggttttgaactcctgggctcaatcgataatcccaccttggcctccaaaaatgctgggattacaggtgtgagtcacatcacccgactttcaggctgccctcttgatcacacccacaattactgattttttttcaaatggaaatgtattttctaacataaagtataggttagacaaatgcacaccaaatgttaaattcccttctgtgtctagtcatctctgtaattatgaagagacaaagtttaataatatgaaagctgatgaagaaaaaataaccccataatttataaatgtgcattccccagagtgaaaatggctcttggtaacttcatttttaatttcaattatgtattttatataaggaaaaatcacaaaataggctgcttactgtagtgttgaaatatagtgtaatgatagaatgtaattttaaagaaatgtttaaataaataatttagaaaactaaaaatggcctactttttatgatgttaagtatatggaatgctgaattaagagagtaaatttttcttggcaaatagtagacacactagatataggtgaagtgaatgaatatgtagaaaatcagttccttaagaacggctcaatgatgatatttagaatctagtgataattgaaacttagtttaaaagtgaactaagataactaaaatattttcatgtgcttattcacataatcaaggcataggagttaagggtctcctgtcatcgacagccctagagaagttacgaaagacaaatatgagacttttaatgatatcagatattttggggcactgcactgtcatccttttaagcaaactagattctctctccaccacaagcaaaccctaagtgggagatgcaagtacaccttgttctttaaactctggatctttgtattcacaggacaacattcaataaggccacctgtccattgtaatggagatcatgaaataacctaagtttactttttgaagtaatttgggaaatgtagaaaaatatgttcccaggaattttcgtattgggtagaaatatatgcttttctgcaagtgcagtataaaagtatgaaaaataggatggagtaacaggaaaataagttttcttagttgggcagaccatctaggcatagaacctgagtaagtaaattcccccaataattaatcttaaggttcacttttcacatagaagttaagtcacataaagatacactcttgctcctctagctattaaaccaaggtccataatttttttttttacttagtttccactcccagggatatgaaatttagattcttgaccccaaatgaatcttaacacatggatgaaacacttcaaaaagtatagtttctttcctgtttcaccagtcacctgaccaaatcaccttatcaccccttaattcaaaattgattgtgctctctattctagacttcgagtgacccatattttttgccatttgtatttttctttaatttcctagcccactttaccggtcttctcattgtatgttcagaataaaagaaaaggaccacgagaagaatatcctttatggtactatatgaaaacgtggcatgaatatgacttgactaatcatacaaaaatcagtaacatcacactactgtccacagatattgggttagtcagatttcattagtttagtcaggtaatcgagaaacctgcttgaaattaagtgggaaggtgggcacaacgataatcaaattttataacatagcatactgaaggaaatctaaagctgacattaattggaaatgaatgagagtagtagatccaaatatctgcagtaccttgagcagcaggagatgaactgtaattgtcataggccctttaattacgcactgaggaacaactccaccaaaacatcactgctccagaataaaaacaaactataaaaggagagttgcaatgcctctttcttgatgaaagactttgggaagacttgggcaataaagaatactcataaattgtgagtttagtttcctgaagagtctttccccttctctcttgtctattcccacaccactgctagatttatcttcctaaaatagttttagaaacttgcacaattgaaaatacaaaattgacaatcagactaaaagaaggtgtaatagttaggtcacgcattcatggatcttagaatgggacatagtggtcaatgaatctaagaagctctcaaatgtagaattctcatctaagcatccctaacagatgacaagtcaattttggcttagacagtttcagctcattgctttgtgatgctcaaaatactatggagaatagctacaaggaagttatctcgtaaagtatgctgaaacattctttcctatacttctttttatcatttggtcctgtagtagtttactagatcaacacagaatgaatttccccctcaagaagtatatgaataagggaatgatacacatcagaaaaggtacatttcttcactttgttagctcttgttcactacttttagcacagctggcaaagctcttaatgtcatgcctctgtctactttcctattacagaggcattgttgttttttctcgcccactctcaagccacacataccactctccagtcctaaatatgcccttgacttttgtcactatgcctttgttccctctgtcagagatcttccatgttctaaatgtcttcaaagacttctcacccgttaaggttggttctaatgacatctccctgtgcaatctcctaattgcatctttgttggcacacacacatacgcacaaataatatatgctttgttcataaatcacattttattctgcttaaaatagttctttaaatcttgtccatgttcctctccctagttctgtaaaccttttgaaagtaggatctataccttaaggtcacctaattttttttctcttttttaaaaaaagactatatacctaaatcaaaggggggaattaaatgcacataggaaaatattgattttgtccattagacttctaaatctatacacaagaagctttcattattcacatatatccttaatcatattgtatatgtggggtatgtgtgtgtgtgtgtgtgagagagagagagagagagagagagagagagagagagagagagagagaagaggactgaggaaccaaaaagaaaataagtcaggagcataaggaggtattttcttcttttttttttttattatactttaagttttagggtacatgtgcacaacgtgcaggtttgttacatatgtatacatgtgccatgttggtgtcctgcacccattaactggtcatttagcattaagtatatctcctaatgctatccctccaccctccccccaccccacaacaggccccggtgtgtgatgttccccttcctgtgtccatgtgttctcattgttcaattcccacctatgagtgagaacatgcggtgtttggttttttgtccttgcaatagtttgctgagaacgatggtttccagattcatccatgtccctacaaagtattttccttttctacaaaaaaattctaattgacctgtgcacattattttcactttggagaagtgacttctcctcaagtaagccataacaagtgtttgccaaagctagaattagctaaccacttgctcatttgcttacatatccccgaggcaccatacaggacattgctgatactatggaaatgacctacagaagtttggacatttggtgaggaccatttttcactttttttcattcctttctctatgtgaaggaaatttaatagtattatgtattctttaataccttaactctttctctaatgtgtgagagaggggagggaagggaagggaagggaaggagaggggagggaagggaaggggaggggaggggaggggaggggaggagagagagatcaaaggacaaagaaaataaccagagatacaaggatgcaaagagaatttcctttttctacttccaaaatctagttattctgtgcaaaaacgttaagaacgaactttggaagaaaactatgcatggtgaaaatgctgctgtttaaaaactacaacaaaacagcccatcatagagtagaagaaacaccggcctgggaggacaagtgcctgtgttctatcacagagctaatgttaacaagctgctcattgacgaaaatctcgtcccttatatcagactcaatctcctcattcataagatgagaaatttgcactagattatcactgaaatttgctccacctctaaaatgactagggttccatattctggtaaattaaacagagtaatgttttaaattaaagatattatcacaggtgtgtaatcttgcctgttgagcataaattaagaatattttcaaaacgatgtgacattcaatttatagtaacagattcaaaaagcatatttaaaaataaattatagctagataggagaaataagttctagtgctctatacgactgaatggtgactatagttagcaataatatagaagtttcaaatggctagaaggagaacgttgaatgttcccaacacaaataaatgaccaatgtttgagataatggatatgctaattaccctgatctgatcactatacattacatatataaaaacatcactaggttctccatgaatatgtacaattattatttgtcaattaaaaaaattcttcaaaagtaaacaatgtaaaatagtagacgtgatgtgaggtataaggagaacttcccaatcaattttggaacataaaacttcatttctgaggcaaaggaagaacttgacattttatataacttctttgccagaatccagtggctctactatttttctgaagaatgcataaaatcacagtatcatgatactttggaatttaggaggctgctatactgagtttagtcctgtctgtttgtatctaacaaagaaatctttctttttctccaaccctcagtttctccatcttggaaataagaaagttagatgtaatgataacatgaatgtccttacctcttaatctttcagttttatgtgatcatatgagtatcttctctctgatcaagcagtctgcttagtgatttgataaattaaatgataaactttcatttgctttgaagtgttttttattttgtttttgtcactataaaaataattaatttttgagtatttacagcattgtccttccaactgctaaagaaagtcatgtccttgccattttcttcctcaaagacttagaaaaagaaggacaaactaagcccaaagttagcagagggaaggaaatattaagattagatcagaaaaaagccaaaattgaaatagaaaacaatagaaaaatcaacaaagctaagagtttttttaaaaacaaatcaataaaattgacaaatctttaggtagattaagtaaaaaaaaaaaaaaaaaaaggaaaattcaaataagtaaaatcagaaatgaaagaggagacattacaactggtatccaaaaagaatgcaaatgattataagacactgctgtaaacaactgtatgttaacctagaaaaaaatgaacaaattccttgaaacatgcaatctaccaatattgaatcttgaagaaatagaaaatctgagtaggccgaaactagtaaggagattgaatcagtagtccaaaaccttccaacaaagaaaagcccaggaccaaatgtcatcactggtgaaatctaatgaacagttaaagaagaattaacaccaatccttctcaaattcttcagaaaaattaaagagaagagaacacttccaagctcattctacaaggggcatcagtatcctgatatcaaagtcaataaaagacactaggagaaaagtacagaacaataccgctgataaatatagaagcaaaataactcattaaaatactagcaaactgaactcaacagtatattgaaaggattatacacgagagccatataggatttattcttggaatgcaaaaatggttcaatttatgaaaactaatcagtgtgatacacaacattaacagaacaaaggctaaaaatctatggtcatctcaatagctgcagaaaaagcgcttaacaagtttcaacactttcatgataaaaacacacaacaaactaggaatagaacgaaattaccgcaacataataaaaaccgtatatgaaaaacccacagtgaatatcacatttaatggcaaaagactgaaaatcttttcccttaagatcagaaacaagacaagaatgcacacttttgccacttcttttcaaaatcgtaccagaagtactagccagaacaattagataagaaagagaaataaaatacatcaaatttggaaaggaagatgtaaaattatatctgtttgcaaattagatgatctgatacgtagaaaatcttaagagtgacgccacacagagacatggttagaaccaataaacaaattcagcaaagttgcaggatacaaagtcatcattcaacagttgcgtttctatacgctagcaacataaaaacaggaaatttagaaaacaatctcatttacaatagcaataaaaagaataaataacttagtaaatacccaaccaagaaggtaaaagatgtgtgtgctgaaagctatgaaatattgttgaaagaaattgaagatgacaaaaataaatggaaatacatctgatgtgtcatttaaaagtctatatatccaaaccatctacagatacagtgtaattcctatcataatcccaatcgcattttttacagaaataaggtaaatttcctaaaattcatatgaaaccacaaacgactccaaatagccaaaacagtcttgaggaagaagaataaactggaggcatcacacttgctagtttcaaaatgaattaccaaagctacctcagtcaagagcgcacgatagtgtcataaaggcagacatatagaccaatggaacagaatagagatcccagaaataaacctagcatcaccttcaataggggtgccaagaatacacaactgggaaaggatatcctcttcaaccaatggtgctgggaaaactggatatacacattgcaaagaatggaattggacctttaacttaaactatacataaaaatcaactcaaaatgaaatggagtaaagacttaaaaataagatctgaaactatgaaactcatagaagaaaacataagggaaaaatttcctgacattggtcttcacaataattttttttggatatgacgctaaaaggacagccaacaaaaacaaaactagataagcagaaatatatcaaactaaaaagcttctacaaagcaagggaaacaatcaacagaattaaaagcaacctatagaatgagagaaaaggtttgcaaaccatatatctgataaggtgtcaatatctaaaatacatgaggaacgtaataacaacaacaacaaaaattcgaacaacccaatttttaaagtgaacaaaggaattgaatagatatttctccaaagaagacattaaaatgaccaacagttatatgaaaagatgttcaacatcactaactaccagggaaatgcaaatcaaatccacaatgatatactacctcacggattaggataaccattattaaaaaaaaaaaaaaaaaaagcccaagatcattacatgtgttggtgaaggtgtaggaaaattggagatgtagactgctggtggaaatataaaattgtgcagcttttgtggaaaacaatatggagtttcctcaaaaaaataaaaaatataactaccataagatctagcaatcccgcatctggatatttatctaaacgaattcaatttaggatcttgaagagatatctgcattcccatgtttattgtagcatttttacagtagccaagaggtgtgaacaaactaaatgtctattgacaggggaatgtataaagctatgttatatacatacaatggaatatcattctgccacaaaaaggaaatcttaccatatgctacaatgtggatgaatcttgtagccattttgctaaataaaataagcaagtcgtaaaaggacaaatactgcacgcatccacttacatgaggtatctaaagtagtcaaaattatagaaacagaaagtacaatggtggttgctaagggctggaggagggaagaaatggtgagatgctgtgcaatgggtatagactatcaggcatgtagggttaaaaaaattataaagatctgctatgcaacattttgcttatatttaacaatactgtattgtgcacttaaaatttattaagagggtggatttcattaaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatgtagcataagtgacctcgtaatgaactgaaatagatattaagttgatattaaatgttgtgtatcaacggcagtgtgagatcattgtgaactagaatagtgtagcatatcttttggactaaggtagattattccaggctttaaattccgaaatatttagagagtaagaaggacatagagagaccattcagacaacagttgcaacggaagtagacttgaaggccagaaagagctcagcatgcacagggataaaacaggaagagcccagtgctaaggattcactcaggggaagggtgggtgataatactggatgcttaagttggtataagatagtaagatacctgaaatatgaatctgatgttttagttttttaaagaattttacaaaacagatttttaaatagctgtagagattcaaaagagaaacgaagcagttgtacccaaaagtaggataataaagatctcttgattgtgttaaattataaatgcatactccatccatagggtgatgccaaagaaggaggaaacaagtagtttgttatttgtcttcaatttatgctatgcttcttctctgtttgaagaagttgacctgtctgctcgaaagccatatccagcagacccaccgattacttgcacagtgacagaatttaagggtcaattatattcatgaactaatttatttccactgagtttactgatgaccctagaaaatttaagcggtgacacaggactgtaaattctttgttgcattataaagctccttcaagaaattaaaatgcttaagtgaaaataatgatctatccaactttgagtggtttccctacactttttagtgatcactttctggtaagagacctagaaaaaaactgctgaatgaatcctcaatttgtcaattttttggaaaaccaataccttctacagctattgaaaattcagagggcagtttgcaagaaacttaatctatatcatccttcctgcaaccttaccacagccatgattttatcttcatttaaagcacgagattgaaagatgcattgtgagagaagttccggtttgctacttccttcattgttatttttaatctttgagatatacaataaagcatcattaacctgaaagaaagaacacccctccagaacacacagtaatcaatggcaaagttaattggaattgagttcttttaacaattccaccttagcaattctacaatgttcctagtgatagacagttttaatcaaagcttggagtatttgaaaaagagacaaataatgtaaggaaggagataatttgtgactaaaacctagtctttccactaaggatttccttttctttaaagtttcaggtttggagctgaaacactttttgagtagagaagacacaggatgggacagtggttgaaaagaagttggtctgggtgcaaatcccaactgcagcatgttagctgagccatcctggacaactcacttagcctctctgtgctccagcttctttgcctggaaaatgggaacgataataaaacgcactttggcctggcacatagtaagccttcaataaaactatcactatcatttttatgaagcaagataaagcattcttcttgaaccacttctctacattttttttctgaaaggttagagctcaatgagaaccataaccccaggccagggcagagtaaagaaagatatacaattcttcagatctaagcagttgtttatggatacctcaaaatgattgtaatattaccaacatacctaaaagaaaagacaggtgggtcaggctagtacatgtttacttcctacactgaaagcattttgattgatgctattctgactcttccaaattttaatggctcctgttaaccaatttcacctgcacactgggctcgtattcctcatctcagctggtaagaaattaaagtgtctcagtacgatgacaagaaactactgagcaggccattcatcgttctgaaaacagtatgaaacagctatcatcatacctctataaattaaaatgttattttctttctacagttgtgctctgactacaagcatatcggccattcctggtggggtccagttcattatttcagtagacgtaaataatttttagcacaggtatttgaaattagaaggcgattcagcattggaattgagaattgtccacaccactgcttataaccttggaattaagaaatgtggaggtgccattgttccctggggtcatttccatcattctgtaataggtcttttgtttttgttgggactgttgtatttgccacctttggtcaaatgaatctgaaacaattctatagctagagcaacaccacgaaagattgttttgtcactaaaatgatgagctagaaaggaaacgcataggaaaaacatgctcagccttcctatagctaagaaaccaatgtacggaggccagaagagtagttcaagttcttcagaagcacatgaactctttattctaataaattacagagtccacatgtgggagatgcttcactatttagtgaaatcatttcacggaataatatagatcaatgtttctcatgctgatttctccaggtcttagaaatctgaggtgtcagttttaaaatctcctggaaaatatgtgtacacatattcagggtcattcagctcaactgaaactgatagctgattacagtgttcctgctttgttgatatttataaggtctggcttcgtatcaagcagttatgtaaagtgtaaagaattggtgagaatgaacattatgcaccctccatgaaagaagaccaaatgacaaccaattgtatgaagaaatgttaaacacaattagaatggaagaaaacaagtagatgaggagttagtgaatgctacctaagaatacagatattaacctagaaatatgttcttgaataattacgtgacaagagctagacacagaataaatatatcatataatttcatttctattttaaaaggaaagtttatataaaattctatatatgttatatatattaaaacacgttcatatgaatacagataaatgtcttgatgtgaatggatgattcacatgaacacttaagaaagttaaatggggcaaggcagaaatgtatcagctctttatacaatactatttttaatttgttttaatgagcatgtgttacttttgtatatcgggaatacgtttcttaaaaagtataagtaaaaaggattttagaataaatggaagttttaaaacaagcagcttgccatatgaagaattcatactagtctttttggatgaatgttttaaataggttaacacgctcagtaaaatttaatctgcacaaatggctttgtcttacacagagaggatctatgtggaaaacagaaccaaaagccagtccaaacaagtaaaacagaaactgaatgtagagttggaactgatattcaattttggattagaaactgattattgaaaggaaaaaaaaacacagtaatttcagatctgctgtttcagtaaacctgacactaatctgagttttttaaaaaaattaattctgacaaagcttgagataatgttttaatagtgagtcactacaaagtaactattaagtattcaacattcaattaagtcaattcagcttttgatgtttcagccaggtaaatgctcaacatgtgtggatataacacatgttatacttttccatttgtgcagaattttctactcaaataatgttttaagtatgtctaacacacacacacacacacacacacacatgattatatatccatatccttcaacaaaatctgaatatgccttcactataaatcttttgattaggttagaaaagacaatctatcctttggagtgatcaattgcctatgagttttgtccccctcaactgctgcttagtccataaacggaacctcagaagttctgctggaagctacagttgaagtctttctataatgttctcgttgctaagactttagagctagccatagaaacaaactgcaaatgttatttatgctttatgtagtaaaatgataacctgaatataagactgggtctcgattatttgtttcatttatttccacactccaaaaagtctagatccacaaaatgcaaacctaggattccacgcacaaaagggtgcaaacacgaacttttatgattctcatatctttcaaatatacttatgaatagtttattactatgggacaggtatggataagtgtcgatttctttactttttattattttttgtaggtacatagtatgtatatatatttgtgggttacttattgagaatccattcaacgagtatacaaagatcgcggatattaaaactgaaaagaaagacaacctggaagttaaaatgtttgacattaagatttactaaacagaaagtttgcaaaatttcacaaactatataagttcatctgatatgatggatgcttccaattgtagaatacagaaattatattcttgagtttacattttaaacttgtgagatgtttggactgaatatataaatagaaatgacttaaaaattttcatgaatattttcagtggatactattacaaagctcaaagtggaggttaaaagttttgactcattcgatttattctcaacgaatgaattatctaatatttcaatgtatatgagataaacatgtttatattagaatgtcaccaattgactctttaatatataaagccttaattatgtttaatctataaaaccactaatgttagagactattcatcacatattcactataagataaacactatggagaaattatgcataaatgtgttacattaaaatactattaaaaagacaatttctatgtgtgtgtgcatgtgtgaagaatcattcgtttctctatccacttgactacttgtcatttctctgttatatctaagtgtaaaatgcagacataccagaatttttgcatgctgggtttctgggctttctaggtgataaaagtgcctaattattccaaactgttagatcattaatcctagccacaaaaacatctacattaatttaaaccttggcaaacgttaaacaagtaaattacgaaagtatgagccatcatgtcctacttctcttccattgtttctcagcatcttaaaggattttatttacaaaaacttagtaatcccttaaatacatttcttcagtatatctgaatttcctgtttgttgtgtgtattgtatgtgtctgtctgtatgcatgcatgcccatgtgtgtgggtatatggtgagctaaagaggcaaacagtatatacattagctaactacaagttttctacccaaattttcccacaggccacactcaacccattcttaaaatgttgcttaggcattcatcttctccttcaggataatgggggaaaatgcttatgctttttatttgcttcttgtagataatgaaaattttattattcaccctagcatgctatcgatgcttcagctgatcctttaaacatctggcctactgtttaaaatgcatggagtgaactgatgtcagcccgtgctgataatcagaggaccttcaattaagtacctacgaagcaaccaatgataaaagagaaaagacagtgcaagtttgccaaagaattctttcatagtctgattctcaaaagcaattagaatcacttcttttggccttggaattaatgaattttcattaaaatttaaatttcaaatgattccaaggatatcaaacttgagaagttgagctgattgtctacgtaataaatcacaccacaggaacatgtcaaaaagactaatgcaagttctttgccgtccaaagttttgtttctccttgtcagtgctatgtgaacatatataattgctttcttttcctggaagcagcttacccaaagacctaccattattacactccgtatttctctctgtttagaatttttgaaatgataactccaagattaattgaaactagttcaagtctacaaaacaagtttgctctcataattgaatgtgatatgatttttataaattgctgcagttacattcttcacactgtaatttgcttaaatgaggaaataaagttgaacattctaatatcaacatatcctgtatttgaaagtgacatttaacttaataacacagacattgtctttacttgacagaaaacaaaatacattggatgtttgtgtatgtgtaaagtaagtgttgtattttggactgtacagaagtataaccatgaaaagtgctaaacatctttggccatagaaagcaacacgggtgttttgaaatggtaataaaattgagcaataaagcagaaaaataatattcatataaaagtggtcttgtctgtggacgttaaatattttaatcttgaattaaaacagcacaacacgtaagtaataggcacattttgttcactctttaactcattctgacaaaagtatgtgcatgttttcaataacaaatttcacagtacctctttctttcctcgacagtgaatcttctttgtcaggaaaaaaaatctcaacagtctaaagaagaattttcttaaacatgacatatccatatcaagcagccatgaaggaatgtttctagttcttactgtaatatttttcttgccatgtccctcttcacaggtgtactttgaatcagattgattaacttatcagtggtttaattgttcaatatttgttccatgtattaatattttataaaggattttgaacctggggcaaaacctctgcactaaatttcccccatccatcgatcttttccaactcagcatttcaacagaacttaaatcacaggggtgctggcttataaataaatgtataacaataaataaaaatagatgattgtggctttaagatatgttcagagactggaagaaagagcagaagtccccaactgaccatcgaactgttctaatgtccattttatttgccccacatagtgtttaaatatttcagtatatagtcagcttggaacctcttgcatagatagcccttactacttcatgcttttctgttacctgactacccatgtgtacattttgttttgcaacacctgcattagatgctgacatgttgattatattgtattatactgacactgcatgcctagcctcatctcgtccctactttcacagctgagatctagagccctgttgcaaaaacattttaacctctgtagagagcagggcgtttttgtcttccgtttttacttgtaggtatcattaagtcccctatatatttgggtgctgaagagataataataatgaacacacttacgaaataaataaatcagctcatcatatggtgactggaattacttctgtgcgcacaaactaatgctaacatttttcggatgcacaaaacatgtcagtacatagttaccaacgatggatggatagaaatattgttttagaaagtctgagttttaatataaaaatggatgagagaaggaagttcctaaattcatacaaatcacctatagtggaaatggggatatgtagaaataaaataaattaagcttaatatttagtaatacagttaaaagcaattcaatatataacccatggattgggatgatttttcagtctactgcttacaatttcagtattaacatgctcttctcacttaaaacattagaaaaataggttaaaaattttcagacacatggacaaagaatgtttttatctttctgacagattatcagaatatgtaattattagttcaataaataaagaagtgactggtaacaaaaatgcaaaagaattcacactgtgatcaaagcagaataggatctccgacatgacttgatacaaagaatacacttccaattcacccaatttttatttttatgtataatacattagatacttttagtgaccacgaatatttatatgacatctttttttttcaacttttaagatccagagggtacatgttcaggtttgttacctggatatatggcgtgatgctgaggtttgggatacaaatgatcccattaaccaggtagtaagcatagtacacaataggcagcttttcaacccttgtctccccctttcctttccccttctattagtccctagtttctactgttgccatcttcaattctataagtacctaacatttagctccaactcataactgagtacatatagtatttggttttctgttcttatgttaatttgcttaggataatggcctctagctgcatctatgttgctgcaaaggatatgattttcttcttttcgtggctgtatagtattttatggtgtatgtgtacaacatttactttatccaatccaacgttgacggacacctatgttgatcccattactttgctattgtgcatagtgctgtgacaaacatgtgagtgcatgtgtctttttggtagaaccatttgttttcttttggatatctactcagtaatgggattgatgggtcaaatgatagttctattttaagttctttgagaaatgtccaaactgctttctacagtggctgaactaattaacattcccaacaacagtgtataagcatccccttgtctctgcggccttgccagcattgggtgtcttttgactttttaacaaagccagtctgacgggtgtgagatggtatctccttgcggttttgatttgcatttctctgatgatgagtgatgtgacgcatttttcatgtttattggctgcgtgtatatcttcttttgagaaatgtctgttcatgtcttttgcccattttttaaatgatgttttatgatttttgtttgttcaattgtttaggttcctcatagattctggatattacaccaccgtcagatgcataacttgcaaaagttttctcccatttggtgtttgtctgtttactctgttgatcatttattttgccatgcagaagctctttattttagtaagtccttgcttgtcattttttttttttttttttttttgcaattgcttttaaggacttagtcaaaaattctttcccaagccaatgtccagaatggtatttcccagattttattctaggattcttatagcttgaagtcttacatttaaatctttaatccatttcccaatgcttatttttttgttgactttgtcgacgaacagttggctgtagctgtgcagttttatttatgtgttctctattctgttctattggtctatgtgtacatgacatcttggtaggatttcaaacctgttcaatgccctaaaaaaatataacttttaagtgatttgaaaaaaactgcctgctaaatctaaacttggaaactgcctacttaattctataatgagaagggtaatctcagcataaatttcaaaagttaggctaaactccatatctacttgacaagtaaccatgagcttaaatataatctgagatcacccaccataatatggaagtgaggtaggtgagattggatggtttgggagtagagatacaatgttataaattccgaattggaacatattgacctgacaactgggtagaatatttgcaatcaatattgttcagagacattttagtcatttggcccttctgtaacagagtcatagcccaatccttatcatgaaatacctgggacaaagtatctgaaatgttaaaagtttgggggacgtaattatggtttgtggtggaatcgtaggcatgtatgtaaaatcatggctgtccttatatttgaaattctatttacttccttttggtatgatggcattgaaaagaagaaatgataagtgtttcagatggtggatatcccaattaccctgatttgatcattacacattatacgcttgtatcaaaatatcactagaatcttagaaatatgtacaatctctatgtatcaacacaaaaataaaataaaagctaaatctaaatatgtttctttagaaaaaaggaagaatgtcagatttttaaaaggtaataataattattttataggtaaaaatatttttctcatatacataattatggtagaattgagtgttgaatacaataaaatattctaatagcaatagatttgtgggcactgtaactttctcgaagcagcagagaaagttctgtaagtctccaaccaagttttatctatgttatgtaagggttttgaatgcttttctataacatagtttgatcttttttcatttgaagcagtaaaagaaatttcaatgaagcattttaagtatggtgatagattaatgactgcatacaatttcactcatttaattttatttcaccaaattaggcttcaaatcctccagaccatctgtgaatatctggttgacttgtcagagtgcattttgcctgagttcaggggcgctgtgaatttctcactccaatttaaatttaggacctctgaacactgttcttctatatttgacatctgatgggaagacttggataagcaaaaacacattcattacctgcattccagaaattaaaccatcagcaacgtgttgctacattttcaccctaaattgacaaggaggacattataccacgatggaaaaaacacatgagcaaataggctaattaggtgctattggtttagattatctgtcagcagcaggactgtaggtagccacagggagtacaggcaggggaggaaagcaggcttgatctagattcaagcatgaaaccagcactctagaacatgatgggtgtaatctggagcagataaacagaacctgtttcatgatagcatttttgatgattcaggccaatcggatggctaggaagcaggcgctctccccaccccgctcaaactgctgaggaaggtgaaccatgcagttcatcagagggctacaaagaggtatcaacacttcagttttccatatgggcatctggggctcacaaaaccaaacagatttttggtatcaaaaatagtattgcagcctctgtggaaaccacccatggggtttctcatctatgtaacactgacatagtagaaactcaggctgcctagagcacattcagagaacaagtgaatgagtgcagtctacaaagtaagtctctgtcacttacatcatgcttcctgagaatatcacttgcaattgtgaattatgctgctataaacatgtgtgtgcaagtatcaacccaaatgcccatcaatcgacaagtagataaagaaactgcggtatatatacatatgtatgtacgtgtgtctatatatatatatatgaatactactcagccataaaaaggaatgaattaacagcatttgcaatgacctggatgcgattggagactatcattgtaagtgaagtaactcaggaatggaaaaccaaacagcatatgttctcactgatacgtgggagctaagctatgaggatgcaaaggcataagaatgatacaatgggctttggagacttggggggtagaaaaggggtgccgagggacaaaagataacatatatggtgcagtgtatactactcgtgtgatgggtgcaccaggatctcacaaattaccactaaagaacttactcattgcaatagtttgctgagaatgatggtttccagcttcatccatgtccctacaaaggacgtgaactcatccttttttatggctgcacagtattccatggtgtatatgtgccacattttcttaatccagtctatcattgtcggacatttgggttggttccaagtctttgctattgtgaatagtgccgcaataaacatacatgtgcatgtgtctttacagcagcatgatttataatcctttgggtatatacccagtaatgggatggctgggtcaaatggtaattctagttctagatgcctgaggaatcgccacactgacttccacaatggttgaactagtttacagtcccaccaacagtgtaaaagtgttcctgtttctccacatcctcaccagcacctgttgtttcctgatttttaatgatcgccattctaactggcgtgagatggtacctcgtggttttctcagcaaactatcgcaaggacaaaaaaccaaacaccgcatgttctcgctcataggtgggaattgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatacgtaacaaacctgcacgttgtgcacatgtaccctaaaacttaaagtagaataaaaaaaaaatctcagaaatatcaaaaaaaagaacttactcatgtaaccaaataccacctgtaccccaataatttacagaaaaataaaataataaaaactaaaataaaaaagaatatcatttgctaggagtaaaaaataaaacttcatcttgaagatcataacaaccctagatgagaaagcaaatatattacctgatctttttattttccatcctcattttctcttcaatgatatgtatgaagagaaatattaatgttagaaaggtaatgcaacgtgttagtaattgctctggaattgatttctctattctgttggcatttatcagaattatttaaatttcaaagcacagtctaagaattccatgagataaatcttattgtaaatgaattatattaccatgggcttgctcattatttgtgaaagtgactttatctgcctggcttattattaaatatagtttatgaacaaggtggcacatttccttctgtttgatttttgtaaagaactctgtatcttgagcggttgggtgctgatatacgtgccacgatatgtaatattaaaaaccctttgctctccaatgacattcttatcatttgaagtcatttcttaatgtttctacattatttttaaaacactgctcttttgagattttaaaattgttatttatattgcaatattttatataaattaatttactccttaggaggaaactatatagtgaacaaagattttttatttaaccttttcaaaaataatatcttctatttgggaaaaaaaaaaatgctttacaaaagaggttccaaaacccagaggggcccacagtcattgtgttctttcttgactaacgaattccttgagtgcagtttcaagtacagattgtagtatctatcaatgtcttacccaattttccctgtcagtgtttcaaatatattttaattcctgtaaaataatctgggatgtggtaacaaattatcatatatacattaagaaaatttggttcaggacaggtccactgataaagtttcctggtgtgcccgatattctagtaattccttaatagaaacctaagagaaattagctcttttttgatcatcttaggtagcctggggaaaaaaaatcactccaggtacagcatcctttcctattttctcatttcctttaacatctagttttattttcttaatgctttgtcattttgttagtattttcttaatttttttttagtgtttaatactcggcaaaggacagacatagcctgcgatgcaggcagggctgcttctcttaatgttcttttgacagtaaagattcaaaattagcccattatcaaccaacaaataaaggagagggttggaaataagtgtaatggttccggccaaaaataaacacaaggccagtctgctaaattcgtatgttgcaaaaacgtacttactacttcacttagcctttaagaaagacatgggatgaattgggatttttaaagtaagaaggggaaaaaaagcaacactcttagctcctttatccagtactcctgactctgcaaggtagattgtttcctcctctaattggcaaaatgctgcaggttttcagtccctcggtgaaagtgacttaggacggggcattaattctttcagttcactagggcgtcatttggcaaattactatatgtgagcaataaatcaaagagttcgaagatgccttgagaaattctccaggattattctcttgccttctggtaaattagaaacatactacattcaataacaagagtatacatattttatattataaacattatggctaaaaaatcatggaagaactattattattttacaaccccctctttttaaatgttttcctaaacatacatggtatgtatgtatatttcaaactgtcaaaaatccctggattgcaagtaaaattcaactatcccacttgcaaaatgaatgggttaattgttcttactttagactcataagttttcaaagaataatttaaactgttaaatatttaaaacaaatatactttatttggtgacttaatagataagagaatagaattagttgtgaacatttatactaatcaaaataatgaactactgtcattttgaattgacacctatataaattctgatttaaacatatttttacatctcagaagaaagagcatagcgttaagtataagaacccatttcaaccatagattggcatagcaattatctgatcttataaggttaaaaatatgagaacattttcataatgatattaaagtattaattagtaaaatagttgctcgattatattccataaaaatagatagacaaagaaaattttaagataaattcctatgtagtaggtaaatacttttccctcaaataagggaatacattaaggagatgaaaaattctcaaactttttcattttataaataagaaaaaaataatcaaccatataaaaaccacatgacatcaaaagctatagttctaaatgctagccatagaaatgcatgattatattatgatactatttatctgttcataaacatgacctgcctccccagtgcaattttaggaccaatgaaaaggagatcctacatccttttaaatttccccgaaccctagtgcatgggaacaatatacagtattttctcagaataaaaatcaggatgatgaagaaacggcgtttactatgcaagggctgaatacaaagggagattagtggactgtttggaaaaagagaatgattattactgtttactttaagacataaagtcagaaactatagcctgtgtgacaactcgcatttgctgcctgtgtgcgtatggcacacaagctaagaatgggatttacatattaaatggttggggagaaatcaaaagaataatacaactttgcaacacataaaaattatacgatatccaaatttctctgtgcgtaaagtttgctaggaacaaaaccatgctcattcaggtatgtattgtctgctttcatactacaacagcgtagttgagtaattgcgacaaagacgacaagcctaaaatatttactaactagcccttcaaagaaaaaaggcttctgactcctgctttaggagaaagcacgtacaaggaggtaaaaataaacttttttttttttaattgcaatcagattccagatggaccctaagagctcagttacggaagtggaaggggaaaaacagcagcagcagcagcaacaacaacaacgacaacaacaacaacgacaacaacaaaccgaagaggaaaagagagctgagtggaaaaagtctttgaaaatttagtcctaaaacttatatttacattctcatgctctcctgaagtcacagaaagaggttcggaacttctgctttaagaggacatttgaatcgactggagaggaacaaagcattgaagagagaggaagtgaactcctcagataaagctctaatatgagaaacatagttccagagagaagttaatgttacttcatttttctgtctcatttccttcaagctcaaagcatgagtaagtgataatggtaagtaaatatgtattctctctgccatcctaaaaacagaaggagggggaccacttgtaaaattaaacactggctgtaaaaataatttatccatatgtaggatttttttcagttggagaaagcacccaagcctacagagtgcgtgcctaggttctgcaataacaatgcaatagaaacagtcacaattaacatacaggcacacaaacacagaaacacattttcgtgctttcactatagttacttatgggaaaaaatcaaataaaatgagggcattggaaggcaaacaaaacatgcagatacttattttttgacaaaactttaatgtgaagttattacaactgtctgaaaatttaactctccaacaaggtctttcttgtgaaaccgttgtttatcttgcaagttcctacagattctcaattctgtacccataattttcctatcccttgaggcctggtaaagttttcatggaaaaaaatgaatgtttttgagattctacatttaatctcttaattattctaaggcaataacatctttccagtgttacagatttcatgccaaaaaaaaaaaagtttatttagggatgcgcgcagcagctgacgcctgtaatctcagcactttgggaggccgagtagggcagactgcttgagaccaggagttcgagaccagcctgggcaacatggtgaaaccccgtctccactaaagatacaaaaattagccaggcgtggtggcagacacttataatcccagctactggaagacagaggcaggagaatcatttgagcccacgatggggaggttgcagtgagctgtgaccatgccattgcactgcactccagcctgggtgacagaacgagactctgtctcaaaaaaaaaaaaaaaaaaaaaaaaaaaaaaaaaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttagaaaccaatgctctggataacatccctattttagaatactcaaagggctgctacagctatttttttttttggcagttccattctccacaggtgatctatagcttgaactaaacctaaagccatcagattttccaggtttaaaacattttaaaatggtcccatctaatccacaggtttttaaagttacagttaataatcatgttactgaaaacatacactagaagaaatgttatcaagacattaattaaaagtcatgttgttaaaatatatacaagacatacactagaatttttaaaaatattattcacatactaataaaatgaaagtaaggaaataatacaataattacaagaacttcaagaatttctcatagctagtagtgaacatactgatcagtataagggcttgggggtttattaatatttctgaggcataactgtcttaaaaagagccaaaagtgagatctgataatttatcagattgtctaagaaaatgttaatattcatcatctataaaatgactaacttttctttggtgtacatggttttcaagaaaacatgattcattatttcaacatttaaaatttgcctagagagcagcagcatccctgacagactggctcatgctatgattcggtgtcaggatgaaaaggctggcttagagacatgttctgggttcaatttccagtggtttaaaagatttcttggagttaggttgtgcatgataatgtgcctcaatctagaagaggcatgggcaactcccagcatgcaagcagagctcctggttaacatctgaaagtattcacccacaccgtaatccgctggtttattccacctttatgaaactcctattacatttgtccaccctgtgcttaaagcagcaacagcttaaaagagggacacttcagacaaggccccttctgggtctctttctctttcagtaccgcagagaaaaagatacaatggaagcaacagcagtagatggaatttttatttgaaacaccaccactaaatagctttcagatgaggaatacaattctttggtatttctattttaaatagtgcaggggctgggctatgagattttcatatgctatctcatttatttcatttatctatacatgtttaatttagagtgatgatgtaacattggatgtggagactccaaagctgaataatgtaatatatcaatacaatacctgcagaaacagctatgcagtggagtattttggttttatacttcctcaaaaatgttcatcacgttattttcactttttttttttttttttttttttttttttttttatagaaacacaggactggctttggagttatttaggggaagagtgcctttggtctttagagaaatcttcctggacaattcttgtaacaaataaaacatcaaggtgtaattatataaaatcactattaaaacgcaacttatttgtactatattttagctgttttaacactaagtgaccttacactcattcattgtttctattgctccctgttattgttcctttctaaaagaatgttctcccttatatactgtactatcaccactacttaattagtttttgtattcaatagtcttgctcattggcgctaacattaaagtatgaaataagttaaatataatggaaaaaataatttcttactttaatagtcactttagtcttcacaatagaattctttaaatctataactcaatacttaacagctgagaagaatatgagtgtgtttaatataaattaaagcagcaatttctgtttcataccacattttcttttcaattcatccactgatggacgtttaggttgattccatatcatggctagtatgaaaagtgctgcagtaaacatgggaacaaagctatctcttcaaagatactgatttccttttctttggataaatgcccagtagtgggattgctggatcatctggtagcaattcatgttttattaagaaagtgtttacaacacagaagctcaaaagccttcagctatctctatacaatgccattttaaacacctttggaagattattaaaatatgttaattattttgtcgaaaaactaaaaatttaaaaagcaagacaggtcaacaaaggccagattagaaattaccataaattattaaagtcataaaacatactgaaatctttgggatgtaatttaacacatgagatttacgactactcaagaagcatactatgtagtatgtcacttttgtgctttgagcaaggaacatactttgattcctctatttcagtgggatgaaaacagcttgtgcctctagaattaagacaatggcccacagaattaataatatgataatgaattaaattctctatatttcacagaaaataacaaattttttatgactgtcaataaaaccctcagatagttcaactctgtataactaacaagaaaaattagtttaaaatgtcattttaaccctcctttaaaaaaaaaagcttatctaaatttactggagatatcaatgaggttacggagaattattttaagaaatgtaaaaaggaaccacaatggttctttgctcattaacaaaatgctacataactacaagagatggtttataattacaagaggttaatcatgctttgcaagttgtaaaatttactctcttaggaaataatttcaagagtcctactgattgttaacaggttaaaaaaccttcaacgtttgttaacacattaaaaagtcttcacatatttggcctttaccaaagtaggcagtagtgaccatggtcacctatactttaatagtttttagaacaacttatacatagttcttgaaatggcaataagaattagtggcaataataaataaaacatttatgaacacacaatattgttaaaactccagtgttcacttagatatgtaatctatgtaacaatattgcataattgaagagtttgccaagataattactgatgtatatatatttttcttcatttacaaatattcatggcaaatatgtaatatcaataatgccaaaatgtttagttatttttgtgagatatctcaatacacaaaacagataatagaaatataaattaatgtttgttagagtctatttattttagatacacatctcttccttcaacagcattaagaaatacacaatctccagtgtaggacctccttatagaaaaacattctatcactttgcatagggttattcagatgtgcaggaaagaaccaagaaataattattggttatctattatactaaaattcataggcctgaagggtacatcaaaataggaagatagccaagaaatggtgttcattttcaagtatctttactcaagctaagtctgtaagtcatgtattcacaaaacgatgcttagtggcttgtggcagtacactgtaaataccaaatgagctgtataggactttcaggaaatgatggtttttgagagagtaggtgtggcaggtcttcaagggggcaatgggacttgagcaagtgtcttgtgatgatgggtgtaatttgtaccttgcatgagggtaaatggcgaacaggagagcatggggctagaaaaacatgagacaaatcagaggacagttaatgctggcatttagaagatgtgctggaggtgaattaccaaaagagtctgaaagggcttggagattattcctccttccagaggtgaagaaacaggcccagagtcgttgcataacttgatcaaataatagggccctgtctttttgaatcatcgtccactgcctcgagctacttccatttcctctattctttcactagttaaaatgtaccttttcactttgtgaaaatgacgtgagtgagagtaatagaaaatatctcgttatccatagtttcaagcctagatttgtggaagtcagaatgacagtttcttttaatataacaagttttcattgataaaattattttcagaaaattctctaagtactcttgagttggttaaagtccttatttccctccccaaagaaaatcttaaattcctcgagaccaggtctgtgtatgaatcatctgaaatcctccccaaagggatggataatgcctttgtctaaatgtaggtgcttagtaaattatggataaaagttgaacagcactggcaacaataattcacatcaaagtacattctagttctttatatcacatagaaataaagaattttcttataaattttgtaaatgtgaaagaaaatagaaccaatttagaaaataaatgtcaatcttgcattttaattgttgctcctttcacattaattttacaaaaacttgtttctgatttgattttctatggattaaaagcattctgtgcagttggaagctcattattaatcatgacaactgtagtggctgctagtatgaattaagcacatataccatgtgcctagctaaatggcaagccattcagatctctttctactacagttgattataagtttttttttttattatactttaagttttagggttcatgtgcacaacatgcaggttagttacacacgtatacatgtgccatgttggtgtgctgcacccattaactcgtcatttaccattaggtaagtttttaagagtcaggcatgatatcttagccatctttctatccaaaatgcatagcatgatccctgacatgtgtcatgtgcaatccaaatttaaaaataataaatcccctaccaaatacatttccattaaatatttcacatgagttatctggtttaatcatcccccaaacctcactttacaaatggagaaacaaaagtttcacaaatgtaacacgcccaatgccccacagatagaaagtggtggagccaaggtttgaacccaggctctttgactccagagcccctgcaagaaaatacaactctatgctgccttgacatagctcttcaaataaacagccattcaattatgctcagtgatttcctaatagtttccagaattctagccatgagaaaaataatggttactaatttgaataacgtaagaattatattaccaacaaaaaacgggaggccatgcttaggagacactgtgataacagtagaaagctcaaataaataatttttttaaagttccaagggatccattaaaaaaatacaaaaaaaaaaagtccatttctaatattttattcacagtgacgggcctgagcataacataaactgaaggctcttaccatgttagaaaataaacttaaagtagagatttcactggagagctgaggacccaggtaggtgaggttctgagtgcatctaacagaggggttattagccacatcattcaatcacttaaaataagactatatacgcatagcattagcgagtcaaccatcattaagacaagcggatttttcggagactttagcatgagtccagatgaccaaactcctctgctctgcagatgccatatgtaatgcagatttgcatatttctaatgtattcaggtattactgtttaaaatctactagaataacgacagctttaataaaatagagtttgaatggcttcaatagcaaagaaaattcttaaagattcaagggttcaagagtagtctacttagaaataatcatttaacccccattaatgaacattttttttggatcagtatctacagttctttttttaaagttttttaaattttaagttctgggaaacatgtgcagaacgtgcagatttgttacataggtacacatgtgccatagtggtttgctgcacctatgaacccgtcatttaggttttaagccccgcatgcattaggtatttgtcctaatgctctccctccccttgccccccacctcgcgacaggcctcggtgtgtgatgttcccctcccggtgtccatgtgttctcattgctcaactcccaattatgagtgagaaaatgcggtgtctgtttttccattcctgtgttagtttgctgaggatgatggcttccagctttatccatgtcccttcaaaggacatgaactcgttcttttttatggattcatagtattccatggtgtgtatgtgccaccttttctttatccagtccatcactgatgggcatttgggttgataaacatatataaagatcactttcttatcctaaggaaaagtatacttgtataatgggaccagatatataaagtgacttagttaaaatacaaatcaaccctaagtataaaattaaagggaattctaaatacaacatgtatatggaaatacctataataactaaattcctaatgttgacaaagcacttgacagtttacaaattcttttactatatcatagcatttaataatgttaatgaagtctgtcacgtaggcattttgcatgttttacagttcagaaaatgttttcttccagtaaatctcagctaaaaactgctgaagctagggcttgaacatctgtcttattcccatttttaacacggactgttacattttcatctactttttttgactaataaagtcaatatgaaagtcagtctagattcaggctttgcacatcttctttacaatgctagcgagtttggggcaaccagataaacaccaaaagcactcaaagaacatgaccataaattaaaaataaatccataataaattcagatgctatgctcttcaaggaaaaaaatcaaaaaggggtattgaaaatgtgcctgtatttgcgtgatatatgcatatatatgtacgtaggtacacatatttgtaatttatgtgtatatatgtatatagtttatggatgtatatacatgtaaatgcacatatatgtaaaaatcatataaatatatagaaataaataaagatctatagtaccattttagagaaacaataaagcataatttctggcaaaaaattaaagttgggtataattcaaatatcagtccattatacagaaaaagtaaaagtttgtcctaccttggattttactgattataaaatgaaagcacaaatgattaaaatttctagttttacaccaggtactatactgatggcatgcccaccctgtcttgctaatagtccagttttcataaactaccttgtttgaaaatgagaattttcatgtgaagtcagggctccacattggaaaacactgatgtttctaactcattctagatatttcattctctctttctacccatgtaattttagcattgcttgctcctagcacaatgtttggcacatacttgtttcttaatacaagttctttaactcaaacaatataatcatctcagtaaattcagtgccatacccatactttaccttctcttattctcccggggctaaatatgatcacttcaatcagaatgctcataaaacaaaatcacctgattaatgcaacttatgttttcatgaagtttaaatcaaaatcatttggtttgtttcatctcttcattttaaaacccttttaaaatagattagtctactttattgccttggtaaatatagaatgttgaatattaattttaatcattgctaatgattggggtcattaaaaagttccagaatcgtcatctttacaaatagtctctgagtatactgctgtgcatgttgagggcttaggcctttaaatttgtgaggcaaatctatggcctacagtgtgccctatgaacattgcttttaggaataaattgatgttaagaatgtactagtttacaatcccaccaacagtgtaaaagtgttcctatttctccccatcctctccagcacctgttgtttcctgactttttaatgattgccattctaactggtgtgagatggtatctcattgtggttttgatttgcatgtctctgatggccagtgatggtgagcattttttcatgtgttttttggctgcataaatgtcttcttttgagaagtgtctgttcattgtggaaggcagtgtggcgattcctcaggggcctagaactagaaataccatttgacccagccatcccattactgggtatatacccaaaggactataaatcatgctgctataaagacacgtgcacacatatgtttattgcggctctattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaactggaatacatcattctcagtaaactatcgcaaggacaaaaaaccaaacagcgcatgttctcactcttaggtgggaatggaacaatgagaacacatggacacaggaaggggaacatcacaccctgggaactgttgtggggtggggggaggggggagggacagcattaggagatatacctaatgttaaatgaagagttaatgggtgcagcactccaacatggcacaggtatacatatgtaactaacttgcacactgtgcacatgtaccctaaaacttaaagtataattaaaaaaaaaaaggatgtatcctaccatgatgtgtctttttcctaggactggcataaaataaactaatctggctcacagacaatttcagtttatcctcatttttatcaccatgtgacctcgggcataactaaacatgatctaattttatgttacttctggattcaatgcatttgcctctctctgagatctatttgtaatcaaatttgttaattccatcctgaaagggagaagtaaaaaggaaaaaaagttaacatctttctaacatttcaactttgaactaccccatccccagaagaaactgctattaaagataagttttgaaaactacacaagggccttacattatcttgaacatatatattatttacaagatcacctaactttcttcctcatttaactgaaaagctttcagatagcctacttttttctcacataagtagatgaaaaaaagaaagaaaatcactgtgtattattttcccagatatatatatatatatgtatatatatatatattagctactacggaaaatgtaaatgcatttatctcacaaggaagtttaaagccttggagccatgttttctgtattaacacgtgttttcatcgcttcttcctccacaattgttttttagatttacgctttttcaaagcataaataaccccagtttgtcttcagctgcaatgagaaaacatagcatggtatatatctcttgctatctgtcaatttgcctattaaaatattgttcaccttttctttggagggtttttcttcgcctcctctttcctgactaaagtttcttgcatcccgtgcatccgtcaaaggcttagctttctgttttgtttgttcaaagcccgccttttgggagcttggtcccatctttgcttccctcctgctatcatctccttctaagcattctgtttttagcttcacatctcccttcgccatgcttcttttgcttagaacaataacgcagcagcaagtacatcgattgctttaggaggattttatcttgtactcagttccatgttcctattcattcatttgtctttatttctttaagtttctcgaggcaaatatttagtgttacagatctatgcctacgagttgatgtctggttgccagaattttatcagatacatacacagctcatcacagacaatgtgattaacacttctgcatgaattatgtaaaatgttcgtatcagagtcttttcatagtaaagatattagtgatattatgtataagtgtttatatacattatattttgttatattttgttgcagaacatgttctgagttttcttcttttcacctagatttggagttttaatatggagaagcagtggtggtttaaaagaccacagaatgatgtcagacaggccagagttcaaatacaggttttactactctatggctctatgagcgtgagtaagttaccctagcctctctccagctcaatttaggattactacgaagaagctcggaaacctcacacagggaaaagtcatgtagtgggcatagcacgattagaactataacacaccctcaattaacgttgatacctgctcttattctcatcctcaccattgctattgtaactattttctccccttgcaattggttcccagaatttcacataaactatgaatccagtttgaacttaatatttattgaattattttcttctaaacatttctaattttcccatttcttgaaaagaacttttaccagatgttattcatattgaattgtaaatttaaaactattataataagctgaaatatatcccttggttagaggacttaacactttaccaatataacaattataatcagtaagaacattgcttctatataacattttattacaattttgctatagtttaaatgtgtcccccaaatttcatgtgttggaaacttaatccccaacgtggcagcaccgggagattgtgcctttaagaggtgattgcatcatgagggctctgcccttatgaatggattcatccattcataaattaataggttaatgggttatcatgggagtaggattcatgattttataagaacaggaagagagacatgaacacattagaatactcagccttcttgccatgtaatgtcctgcactgcctcagggctctgctgtgtccccatgagcaaaaaggctctaacaagtctacagccacaccagcctaaacgcgcccactcttatctgatcttggaagctaagtgaggttcgacctggttagtacttggatgggagaaggctctgaccagatgtggcccctcaaccttggacttctcagcctccgtaactgtaagaagtaaactccttttctttgtaaattacccattttcaggtattctgttacaagcaacagcaaatggacttagacgaattctttcacagtataagattttattgacacatagtgtgttgaataaataacagaatgatttcatcttttgtaatcaaaattaagtttgtattagtttcctgtattgttcctaactcattcaaagatcaggtggatgaaggacagactggaaaattttaatgactttacttaaataagtcatttacttatttaaaaagtcacatatttaaatgaataatttggttgtataacacagttactttagaataaaaatattatatctataatattttaaagtaataaataggaccataggctatttatgaaatatgacatgaatttagaatttcgagacaaatctatatttatttaaatgggcaatatggtttgagaacagttgatatgaaacacgatgatgaacccatcttctgatgaataagaaaaacactcaattggcaatggagctgatcatgcattcattgaaattaaattggctttaagttgtactagtcttcttatgcaacgagtagctccttattttgatgaaaattccccaatttataactaagactggatcttgttattttgatcagagatgcaaatgtctttggaaaaaaagttgggggttcttaatcacatgacttatcactgagaatttataaaaacattttatccccttgtagaaatcgatctcaaacttagggaacatataatttagagaaactatttttaacccaacggagctgcatttaggttactccctgtgattacttttgaacttggtagcactcttcttggttagcactgttatttggagacaatatcatacgaggtttatcttgtaggacatgttcagtaatttcctggatagtgttcaaattattaatagctaatcattattccagtgaatataatacagtgtactttaaaagtcatcattatatatatgctaacgataaatgaaaaataatcatacgcagatatgagaactataatgttggaataaagtgcttcattgctgccccacacgcgttagcacttgaataaatgtggatataaagtagaaagaaatattaaatatcaagtgttattccaaccattaaaggatttttactaagagaagaatctttcttcacatgatgactctataacttagctgaaaacaaaagcgcataaatggcctctcctgaagctatgtcttacactccttctgatgacatttcaattataagccgaagctccacgaaacaatcgattcctaaaggtctaacaattgatcactccgtacactgaagtgcctgtaatgactactgtttataaatgttttgctttaaaaaataaggcacactattaataaacagtttgctttaatagaacaaatgcaagttttcaaaatatttatcagaccacgactcttcctgactcagattggcttcagatgtatgtataaggaaggcctattatattcgtaaacactgctaagttgagagacctgtttctagatcccagtaaatagttaagagaaattcacatcattgatctggttgcatcagtttcacacagtgcacaatcttatataaccttttttccccccagtggctattcatttaggatatcctttagaacaaaagaataggattgagtgtcatttagcagaaagaagggagctaagctgacaggcatagtgttctgttgcagtattttgtgttttcatcattggacagcaatgactacagaaccggccacggcagcaaacccctcagagttcagggcttgggagtgggggagtgggatggacaacaactgaggaggcagagacagagaactgcttagcaaaaaggaagaagaaatcaataatgattatcttctctccttgggctactgcaactctgttaatttaggcatgatttttgtactacatattctttgaattggaaaatatatttttgatgtatttcgggaggtaatacataatccttctgataagcaatatttgttgagcattttatctgctctaattatgtcaggtgctttgctacttcacagtaaccacatgataaagaactatgaatagccctagcttagaaataaaagtaaaaactagagaggtaaagcaacccacccaacatcatatacatagtgaagaagctgccaggactggaggccagatttgcctgtgtcctctaatgctaaatgtgcacagggcttagagctgttctgaattctgtaatacccaatgtctccctttttagaaccaacatttagtaacaccctcatttaccaccctgaaatgaaatgaatagatctcataaacttgtctgcacagtgatctaaccatcatataaaaaagaaagaaaataattcataacacaacaatatatgttttattttattttaaaatactttgaaacgtgtgaatgttttcatggccacaccagaagacctattgaagatgccagacacttgcgcctatgttaagaatcccctttaatgtagaatttttcaaatgtcccctgaatataggtgagttgtatggaacactcaagtaccatgagtcgcaaggctattaagtcctagttttctgctatggaaaagagctcctaggaaacttctagaaattgttctataattgctgcattcttgaaaaattcagcaactatcaaaactgcatttcctctcctgtctccctgctccagtaaaaaacatccacacaaaacacgctttgtgtttatatgttaaatggatttacattctaggggaaattaactataaacaaggttttcctctatttgaatgtgcaggggtatgaggaaacactgtttacgcatcatgaagagtctagtcgcttaccaacacacgttagtgccagcagtgtccacctttcatcataacaaccaaaaatgcctcccttgttcaattcagagagaccatattccagcagaaacagaaatgcctcaggtaagaattgtaacattaagagaacatatgcaaagatctcagtgcagtacttttgcactcaacaagcactaaataaatggtagctattagtgaataatgacaattctatatttatacagaattgctcttacaaagcttatattaacagcttaaacagaaattgtaacatttatagcttaaaatgaataaagctatgtgtgatacattaaatgatttaaattttaaaaactgtaagaattaatgtggaaaactggttttaatttgagttatttcacatacacaaatgtttgctcttatacacattttattgcccatatgatagaggtagactttcttctaaaacaatcatattaatgatttaaacaaaaacgtgagtttaatatgcattattattcatgcttcataataatcacctgatctcttcaaatttaactgtcacacaaagctcagttccttttcatggctataaattacatttcagaactttgtgtctttatactgctaataagtcatatttgataatccagcatataataaaaggatcgtgtacaacattaattacaaggtcagttagatgtcaatgtagaaactcattgaatagtatttttgtggaagtagctagactctattatgtttaaacttcaccataatgaataatttgtatcagacttaattcacgagagaaaagtgaaagttctgcggcaaagtggctttttctcccgaaataatgttaataattgaaggctttcaaaattttttcctgcaaatttcagatgtgattaagtgttgactttataaaggctggaaacgtcaaacactttaaagtaaaattgtgttttcatcttaatttaatgatgaaaaacatacttatgctgtctaatagatctaaccaagaatttctgattcatttgattggtctacctggaaaataataaaattaataaaggagagtataaaatgcatattctgtagtacataaatgatgtgtcttttaaaatgtcaactgaaataatattttttaaaatgaagccatttaaaaatgatttttagtgtaaataagatgccagaagatggacaggtataaaattaacctctacccataaccataatttcatagtagttaatgagctcaactcaagaaaaggatagaagtctagtcaggaaaagggtaatgcaaagtgaaacattaaagttaaattatttccctcatttttggtaacaggttattaaaatagacttgaatgggtttttcaatatgaaacactaggatgagctttctgtgcttcagtttcttcatctgaaggagaggctgtctgagtaggggaccataagaatccacttcagcttctgtagtctatgatatatctgcatttttatcaggcatttattattattcccatgtagcagggaatgttctgctccctcccttgagccaggaagtacaatttgtatcaggatctcgaattatgttttgctccatctaatcccagtcatttctctacatatctgtatttttcaccatacttaataaaattatagggatttcttcttgttctaccacttcacttcatggtctccacttgagtaatgcaatcaactggcaggtacaattaccatgaggcagagggaaatgtttcttaggacccaggcaaaactgatttattttcctttgtgccaaatcttacatgtacttttacaccaagttaacctgcttaggcaaagggaggagccatctttttcaagctctgcaatgatccttgagaaagcagaaaagtcaatgggatctaatatttttatggtgtgagttccatctggggacatttgtatggggttgaagaggaatgcatttgatgaggcagtgactgtttgatcttaggtaccacgttcctcagtatgtgggagtgtaaagcttcatgaacaaattatttttagttgagctaaatggctatgagttgatcattaatgattaggaaaaagagccaggatggaggattacgctcttggccttgaagatctctaaggcagtagaaagagtaataaggagtatattagggttccttagagaaacaaaaggaataagagaatatgtatacacacacatatataattatatgtgtgtgtgtgtgtgtgtgtgtgtgtgtgtgtgtctctgtgtgtgtttgtatgtggtaagaaattggctcatgcaattatggaggcaactatggagactgacaactcccaaggtatacagggtgaacaagcaagctggagacccgagagagctgatagtgtagttccaatcgaagtagagcagacttgagatacaagaacagctaatattgtggttaaagtctgaaggcaggaaaaagcccatgtcccagtttgaaggcagtcgggcagaacgattcccttttgctcaggggagggtcagtgtttttcttctattcaggcctttaattaattacatgaagtctgctcacattaggaagggcaatctactttactcagtctaccaatttaaatgttaatctcatctgataacacttgcacagaatcacccagaataatgtttgaccaaatatctgggcaccttgtagcccagtcaagttgatgcacaaaattaaccattacgggcagtgttgacagatcaaagtagtggtaacagtaggtgcaaagtgaacaacagtatcattagaatgtccagggactttttcaattccagaaacatattgactgggtttgatgccccataactttacaagtaacaactattccacatgatactcaatgctcatatgactgccttggaggaataattgacattctctaccccctgtcccaaactttaaaaaacattttgtgtactgaaatgatttaggatgaactgtgaccggaaacaagaaaatagtaactcacggggtggtccaagcaagatgacagccaactttttgttctttgttttgttttagattcttaacgctttagtgaagttggatccacattttgatcattgcaaatattagaaacaacttacatgttcaacaaggtaagattggttaaaaaaaatcagcacaaatacaacaaaatactatcaggtcatttaaaaatgtgaaagaatgaaatttaagagcaaagaagaatctcatgctacagagatttctcttacaaagaaagtcatctaaattctcatggatagaatgcaatagattaattaggaaacagtatttatagaaacaggattgttactcgttaaattgccataaaattagaacaagaacaaacactagcttaaaagagaaaagtgccttttcctgaggacatgtgatacaatgatggcatttacagaaaaatgagttaatgatactgagggactggcaaaaagaaaggaggccattttcatggaaccaaggaaaactatattcaaaggtggtatcttttctctgctattggttttataatcatatacctatagctacacttaaaaattaaaatacttacagaaaatataactttgatattgatagtctgaaactctctaccccaacctcttctcttaatggataattatgtttaagatggttttttaaataacgtgaggttttttattagttaagaacacaaggagcatgttagaatacactgcatgttgtgaagttcagaaagcctgttataaaagagcagtatcttattgccttttcataaacatacgaatgtttaaaattcatatttatataacaggaaaaaagactattaggaaatgtttgaacatgaaaatgtatcaaaatgttaaaagtggtttgctggggaaagtgatattaaagaagatatttataattttttctctatgctcatctatcagcctatacatttttcataataaaccaatattatttgcatattctgaaaaaagtgttatttacttgttagctaaaatttcatgttatttgattcagactgtgtttcttctgctcagtttttggaatgctctctctctacactcaatctatctgagaagaatcaacagctacaatacaattttttttttgcatttagagactctatgcgcccagaataattctgtgatatgtatttctctttatctaaaagtctatatagacaaggggctctgatacatggtttcttctttaagccaccatcgaacatgctgcaggaaagttaatcgtggggatatccaacagagacctgtatcaataacataagaaaatgggaaattcacccgatacttttatttcctagggtgaaaaagaaattagagccaggtaatatctggtataaaaataggtaatatcatacaaaattcattaaagaaaatctgagtgcggaaattaccaaatcacagaatattagagctggaaaagacattgtacagatacagaaatttgaaaaaaaaaaaatacagagatgaagtgatcattctgctgtcctcacagaaatgcctgctacttctattgaattttcctctcatcttcctttaagcatttctggagtgcgtggtgtgtgtaatcataaagttttgtgttaaatgccaaaaaggaggaaatcataaaagagcggtgtaatttttctattatattttgatagtcctgccctctgcataattattttgtttctaatgtctccaacataatctcttaaacatttcttaaaatattttttttatcctaaatgcgagccgactaaggcaacttcttgacaaacacacgtcaaataacaccaacatcaaaatctaaccattcacatccatgaggtaaagaaaaccaaattaaccagtcattatttttcaatggctatgacttttataatagtacagcttagtttctatgcatcctcctatattctgagattcagcgttatacattttcaatttgattttgccagtcaaatttcatttgttcttgtttgattggctgtcgtttacctattaggtgctgccttcaattcatttttacattctctggggagacaacctacacacgaaggttttgccactttaaatgtttaattctgcaacacgttgcagagtaaaatcttcctcgatttatcctatagaagtttcctgtgacaatgcaagtgaaaaaccaaaactcaaagtgtggcaagttggagctaaggctgatcctggaatcaactagtttccacagtaaaaaaagaatgagaatgagacatagattccccacttaaatccaatagaggtagttttcactctgttatcatgcaacagtgtgtgatagtcaatgttgaagtcatataaacaagttatttggttttagcatttaaaataaaggagttctatcaatttgtggtaaacacaactacccatattgttctcttcctttagactctaactggagaagagagtatattttctgcctcttttcccaggtaatagcatttataggatgaggagctggctaatggcttcagttccacatggctagctacactagggggaaaaaaaaagcataatgctgcaagcaaaattccgatgtagtcacaagaaggacattctatttccttttgaaaaaatgtgtttcaggttcttgggtaaatctggtggtagaaagtttaccacctataattctgtaatgtgatcctcctttataaaattgttattacttgtggcaagaaaagaggaggcagatggtactgtgtcagatgctgaaaaagaaagtgagcatctcctagaatattacagtggaagtatccaacattgaaggcagatctctggaatacaaattcagaagtaaataaaatagacattctacaaacagtgaccaaataaatgtctggactgtgaaacagtttatccattgtttacataagaaataatgcggattatattgcatagctagtatgtaccccaaaccaacaaatatattttaaaggtccatcaaacagcccaataaggttccattttcacatacgcatgcagcattttataacagtcctaggatatgtgtatatacagagggatggaaaaaatacagttttaaaagacagaaatttaccctacattttattgccatctgggcagaaacacacgttccattcttttcgtttctccgtggcttctcccaaagagaaataggcctgtttctttaaacaatttttttataagcgctatcccttcttgaagttgagtatagcataacaaatttactaaaatttttttcttaaggataacagtagaataaagaacaatgagccactttgttacagagataagccatgtcattcttttggtttataatgtatttgcccaaaagtattatgtggctagctgatagctgcatagactaactacagctttttactatttgtgatacaccaggttccctttaatcaaacttcagttatctgtatctatattctccttaggataagcctagattgtctaaatttagagcttgctaccaccccagacattctttctttttggttatcatatcaagtcccaactgtgcagcctggaattcaatgtcaaccactttccatacctcacacaatccctgtgattccatcagctctgaccgaatcataataaacaacagtttattatgatgcttcaagtcccatctctgcagcaagtgcttctccaggtgatttaattaccaataatctttttaaaatctgaaaccccagtcccgtttttgcccattgagcagaggctaggatttattatacagaggatattgttttattatctatggcaataaattattctcttgttactctatagttatatattacattctgcaaacaaatttcagatacctcaagggcatgaataatatatttgattagctgatttattggcatagaatgcatttatcgagctttaattatgggccaaaaagtgtactacgccctgaagtcagaaagatgacaaagaaatgttcttggctttcaaggagatcccgtccctcgaattcattctaataatttttagaagagagttaaagaagaatgctctagaccagtggttctcaaactttagtgtgcatcaaattacctagagggctgataaaaatacaggctgctcatctccactctccaatgtttctgatcaagcaggtctgagatgaggcctgaggatctatatttctaatgaattcccagatggtgctgatgttgctggtccagcgaaagagtgatttagagaatggaaaggcaattaaataggcaatgcaaagacacaacgaggtagagggccaactgtattcaagtagcagcgggaaggtcatatggtgggtttagagggtgcatagggtgaccacaacatggcacttggagacgaatagattataataggttttggacatcatggtaatggtaaggaatgtagatattagaagaatcatcatcatcagaaatttgtaaataacggagggatgtgatcacacctgggctttagcttttagaaagaaaacaatagggcagaggatatgtctacacagaggattgtatcatactgatatttagaccacaaagatgagatttgattttctttcaacactgagggctaggtatcatgcttcatatttatggtctgtctcagctttcctcacctggccaattttaacaacctcctagggaaatcacagcctccagtccacctcctctctccctcccataatggcaagtagatatctggaatcccgctattaaatagcatcaacatctgaattcatgtgtttcaccgatttctcaggctattatagcaggagaaactcatgttgtaattttacttatcaggaatttgaaagccaaattagttaagtaaattaaagtaacgcagctagttaacagcagagtcaaaactagagctcaactatctcaatattgtgtttattagtataataaacgcatataaataaatgtaactatttaattaattgacaacaatatgaatagttacgtttgcacctgcacaggcaataataactaatgcacagctgtgacaccatcacctatgagacgtatctgttttcagaaatattaaaaacaaggtgcatccagtagggtgactatagttaatgacaatctattttgtatttcaaaatagctataataaaatacgtgaaatgttcccaacacaaagcaatggtaaatgtttgaggtgacggatacagaaatatccttatttgataattacacatggtatgcatgcatcaaaatatcacatgtatcccacaaatatgtacaattattatgtatcaatttaaaaatgcacatcttagttgcaataaaatacagcaaacacaggtgacttttcagggcctcgatttcgttcatgggaagaatgaaagatgacatgactctgatgactttttccatgccctatttccaggcaacagagtgtccttctaaaccagaagagttcagctctaacacagaagactattataaaagttagactcctttgagagcattggctgttctttatttttgtgtatatcctttcctttctcgatttcacaagcaactcctgacgattctaggaatttattgtccaattttaatttcctgatcatagttatagctttgaagttcattatcaaactttgacctcatgccctcattcctacctctcagacacaaattatattattacagggatatatattaatatttcaacatttctgcctttcctaaatccaaataaaacaatagaatactgaattaaattactacgataatttatcattgtttctaatattttcttgttttttttctgagaatgtggttattgaatagactacttttttgattatgcaaggctcaatgtcaacattttgttgctaaattataacattaagtaatccagatcacacaatatttttctttagctaagaaacatgtttaacttccagctacaacattttctcacagaataagaattacattgtttgtatttatctttagcttcagcacttattgcagttataaaatatgttaatatcatgggcataacaactgaaagcgtacttaattgttcaaccttggggaccacataatctacatcagatttctatgggtttttcatgtctctggttatgattgcacctttccaatttgtctctgtgcctcaactctctctctccccttatccatcctgtgtagcccttctaaaaagaatctttgaatatatacttttactcattttatgatcgcctgttcctccagctagcttctctttgacctcattgactcaattcaccttatgcctttcccctaatatcttgtgtctaatcatgtgagacttcttaatatttccagggcagaccgtcctcttttgtcctttcaaggttattcaagctgttgtccacacttctgatgttctccctctataatgacaagcttctactcagcctcccagatgagctaatctaccaccttctccgtgaagctgggtcttacgctctgttggagaagagactactctgattccttcacagattttactgtacctatcttgggatactataatgattttgatgctgttctacctgactaaacccagctgttactatttagcaatggatacaacatagtagatactcaacaaatgtcttttaattagtgcatgagcagcagtatctgcacagtgaaagccactgtctgtatatcctcacctcctactacattttaacctaccacaaatagttttttgatgcatgcttccagtgaaaatgtcttttatcaaggtcaagtatgagctccatattgcaaaacccaatggtctattcttttgtgtttgtctaattgtattttcaacatttgacactgtttttgattctatcatgaaggactttcttcatcccacttgcctggttttctctataaatcacagaagttgcttttgtctcctttgagtattttttttcttcctcctgttttgaaaggtgcagtcaattctcgggctcttttcccaaactctcctcctagaagacttcatccagtcccatgtctttaaaaaccatctaagggcctatgactgccacattatttatttatttattttgagacagggtctcactctgttgcccaggctggagtgcagcggtgtgatcacggctcactgcagccttgacttcccaggctcaagtgatccttcagcctcggcctcctgagtatctgggactacaggcatgtgccaccacacccgattaatttttgcgcgcgtgtgtgtgtgtagaggcgaggtctcgctgtgttacccaggctggtcttggactcctgggctcaagtaattctcctatcctggcctcccaaagtgctgggattataggagtgagccactgtgtccggccaactcttacgttattattccagtcacagtatctgtcttcagcttcagactgatctacccaactttctttccagcatttccacttggatatctaatgagactctgataataagagagactcttgatttcatcacaccttgtaccctaactttttcctcctccacttttccccagcaaagaacttagaaataattctcaattattctcatactttacatctaattcatcacagcaaatcctgtcagctttgtctttaaaatgtatcctaaataccagctctctaactgaccccaccactccaccctagtctgaaccacctctgatgtggactagtaacgtggcttcctgtgctatctccctgtattcactattgcttccatttcagtctaacctctactcagcaatgatgaatgaactctttgaagaaagcagatcaggtatctccactctatttttctaaattcttcaatgatgtcctgtcaaaattatgaaagagttaaattcttttatcacggcctgcaagatcccgtgtgatcttgcccttgcctatacttgcacctccttccttccccaccttctcttacactggaatccttgctatttgttggctaggtcaagtctcttttgaactcagtgcccttgcccttgtttcctctgcctggaatgtttttgcccaaattggagaatatctgctctcatatctgctcaaatactgccccctagagaagccatgccaatccacccaatctaaacaagtccaccttcaatatcattttctattcccttaaccagctttatttccaatatggatcactatctgaaatcatatgtgtatgcatataataaataatatcatttattctctagctcactactagagtgtaagttctacgagactagggacatacttatgtattcttgtatcccaagtacctggcatatatcatgtacttcacaaatatctgtggaataaatgaacacattgaagagatctacattatgccatcgtgatgtaaaaattgttttgagctaaagccatttgaggatcaacagatacgggaaggggctttttctgtactccccctatctgcctaaaagcaaagatttctgaaataattcaactgttttaaatcctcctttaaggaaagtttcttgcaccaggggtaaagagtgactcctgtcaccagagatgagaagttgtcgctgggaaaagaaaattacataaacagactttactaaaacaaacattacctttcattagtttctttcatatttcccaccaactttgtggcttgaaattctaacactcttcttttcaaaacccttgttaaaatagtacataagccccaaattctaacttcattgagctatgttttctgtgagctcccacatacttctctgaataaactttgtcttttctattgccaatctatctgtcgtcagtttaatttgcagccccccaagtaatgaacctaagaggggagtgaaaaagtttttcttccctgacaacacaaatggacacatcaataaatggatagcttgagtaaatttcctcatgtttctaagcctcactccattacatttttattgatcacagcaccagtgccagacgacaaatgggaattcttaagagaaagggcattagaagtgttaaaaggcaaccacagagagctgtcacatggagaaatggtccatgccatcttcatttgatctcactcctagttgggagtcatcagaatggggaacggagatatctttcagcaaggaggtcccagtgatatgattaataaaaatatgtcaaaagacacatgagaatagaagttcatttgatacaagcaaaggttattgtttattctactaatacggttccacagaatccaggtcccagcagtgccccctcttagaaggacaagcctccctagttttcaagtcttcacaaatgtggctagctgacaaaataccatctgatcaagtcataatcttctcagatccttcataaatcttcttactgccatgctcatgtttttaaccccttccaacctcttcgagctgacattaagtagcttcttttaaaaaccagcagaaggttcatgaatgcatatgggagaagagtgaattttaggtcaaattcccaggctatgatttaaccttgtcgcaatttgtactctcccaaatcagagaggaagcctgcctacagggcacttagaatctaagaaagtgccttcggtggagaaaatatttaaccaataggtttgtttgggggatggtttggatagggatcttctatatggacctagaaggattatcatcagagacaaagagtatgtgaactttctgttaatgcccagagatgtgacaaccagagaggctgggcagaacagaatctcagagggcatgtggagcaactgagaagactataaaggcattgtgttttcttacctcaagttcacgtaaggcttataactgtaaaatcatctatttttggattatccatgaaattctcaatcctaggctagcagttttctgcaacttacaagcccatgcctctcctacattcaaaggtttccaataacattacacccagggacaagaagtatattattttattggcctgtgaggtgggggaaggggacaaaatttatataataaagtatcctattttacacagtaaagtttattgctttactttattaaacactgatcactgatgatctgttctatagctttcccaaaaccctgtgtttctggattttcaattatgcagagaaaaaagtgaaatctcctgagctggcagctcttcccctccatcatagttcaaaaggtgacagggaatagcagcctacagagtgaacagaacataactctctgagccatggttaagctccagcaattttggtggtcgcagtaaacactgggctaaacccaaggaacttctccccctctatgtggctttggttatatattgataaccaaagctgatattgctttggttatcaaagcaatatcagcatgacctgggaacttattagaaaagtaaattctcaggtctcaccccacagctaccttatcagaactcctacgagtggggcacagcaatcagtattttaatgagtcacctggaaattttgatgcaggatcaaatgtgaaaaccatcgccctatagcagcaatccccaaccttttcggcaccagagactggtttagaggaagacaatttttccatggatcaggggcgggtggggttgtggggagaggtgcgtgggaggcgatggtttggggataaaactgttgcacctcagatcttcaggcattagattctcataaggagcacacaacctagatccctcgtgtggacagttcacaatagggttcgtgatcctatgagaatctaataccgctgctgagctgatagaaggtggagctcaagtggtaatgctggcggccctgcagctcacctcctgatgtggggccccggttcctaacaggtcactgacctgtactggtctgtggccccagggctggggacccttgctctatagtgttaaaagccaaaggaaagcgggcagatcacttgaggtcaggcgtttgagatcagtctgggcaacatggtgaaaccctgtctctactaaaaatgcaaaacttagcagggcctggtggcgccagagcacctgtaatcccagctacttgggaggctgtggcatgagaatcacctgaacctgggacgcggaggtttcagtgagcttagatcatcccagggcacttcacctggatgacagagtgagacagttaaaaaaaaaaaaaaaaaagccaaaaggattagagcacagaggattggcagtcttgagaactaacgtaaccctatttgcaaggtgacagtatgtatattgaactgtatcaggtccgcaatgcagcctttcgtataactaggctcctagtgcggttgtatgctaatcctagtcctaaaaccaagattaggcaaaaacagacttgagattcatttgagtcaaggtcccattactcagtaactcctgagatgaacacaatgcccatatataactaggatctccggtgtaccctcatcttctgatactgcctccttctcatttgccttgtccactgtgatgtggccctttctgtcttccatgtagatgcataaagccctataccaagcactgcaaacatatagctgagaaggtcctcagcctccagaaacttacttttgtcttaaccacatctgattgatgtttatctatgggtctttatgcgaactgtttcttctttctgaattacccttccctgctttcattcttcattttgggactgattccacagccctgggtggccatcacaccctgtggtcacccttttcagtgcacagtcttgcaattacttgattatacagctgacttgccacctcaactaggagctggttgaagggaggggctgtgtctttcatctctttatcaccagcatattgcacagttcctacctatagttgatagttgataacttttgatgaatgaatgaacgagaatcagacattaaattttcagaaggaaaaaacagtttatccttaaacaaatgtgtctggattcagaagaatcattttcccttcgactttatgctcacaaatgtgttgggattcagaagaattccaaccttttcatttgccttgtccatgttatatggtttcttatagcctagctaaagcagtggttttcacagcatgatcaaggccagcagcatcagcatcacctggtaacttgctagaaatgcaaattctggacctgcaccaaagttactggaccagcaactttgaaggctagcctagcaatctgtggtatagcaaaccctccagctgattctgacgtgagtactactggcctagagttgcttctaagactttggtataactaccagtcagaatctaggtcttcacacacagacactgattcagtaggtttgggatgaagggcaggcagtctacagcctttatcaagctgcccagatgatgctgaaaggtgttttatggattcagaagagtctcaacacattcgtgagcataaagttgaagggaaaaaatgtttaatgaatttgcctggggttttgttacttcttccactcctaacttcatttataatcaaggccctaagcagctggtttccacttaaccttaccaaactcatacaaattcagttgggattatttacaacttccagggttacttgcaattgtatactgagtctccaaggtggttaatgagccactttggatgataacaaccaccttggctgataactaaattgataggtaagcaatgtattataatagcaaccaaacccttgcttctctgatttactgacctgtcacagatatggaccaaaccaaatttctgaaattctggctgctcaaatcccaattgcaacctgattgaggcattattagtattggagtttgaagtaaataatacaaatgcatcgactgaaataggtagagaacaagcccggaagtgcaaacgttcgttagaagttactgatttgtgcagaactctgtgtggcttgggcagtcacttctctttgtcaagtaaacatacaaaacgtttgctccttccaattgcaatggtatccatggtagatacgtgcaatgcatttgaaaataataacttgagatcgaaagacaaaaaatgaatacgctaaggaagtgtggcagtcacaaagaggaatgtatctagttcttaatcagggcagacctcaatattcacatttttagcacaaaagccaaaagggagggttgaaatttacaagtcccttcatcttggttaggctctgtggggagttctccctgcagctggtgggctgcttcctgcttctgatgtctccacctgcaggtggtggcactggcccctgacctcctgaaataagcctgttgatcttctcccacattattcctgctgcctgtggactgctgacaggaagttaggggacgacaaaaagtccctcagtaaaagactcgattaagtggctaaataacgtttcctccgaaagctttcttttcaaataaggttttcaaaatatgtgtgcatatatatatatatatatatatatatatatatatatatatatatgtattcggttttattcagaatgcagaagtgtatctgcggagagcagaagggcattggaaggagtcaaaaaaaatgtgtgtgtgtgtgtgtgtatacacacactcactatatgccaaaaggaaaagcaaacaggagaaaaagatgtgttgaaatcttgacagagcacagacaacagtggcatatttgagttagaaaataaacaagggtgtgcattttagaattctcagatttatttgatttttgtccaaccactacaaagtaaggagtaaacgtgaatatgagggggtaagagaaaataagttgatttaatggtgaactagggacaaagtcctagtgttttgcatttgctctgtgacccaggtcttcagcacctttccttggcaagtcaggatgatttttaactagctcctaactagctttcttgtgttagttctgtttccttcgaatctataggccaagctgcagaagggggctttctaaaattcaggcctgtgaagtcattggccagtataaaagccttatatggtttttcctatagcgtagctaaagcagtggttttcaaagcacgatcaaggccagcagcatcagtatcacctggtaacttgctggaaatgcaaaatctggacctgcaccaaagttactggaccagcaactctgaaggctaacctagcaatctgtggtatagcaaaccctccagctgattctgatgtgagtattactggcctagagttgcttctaagactttggtataattaccagtcacaatctaggtcttcacacacagacactgattcaataggtttgggatgaagggtaggagtctacagcttttatcaagctgcccagatgattctgtaaggtgttatctggattgcatttagagaaatgctggccacagtctaaatagtatctgaaccactaaatacatctctctgtgccccctgcccaccccatctgtgaaattttttgagatcatcttgagctccccgtcacagcacagtgcctgcaacagaactgacacattcctctctaaatgtttctgaataaataaactgcactttggcagacaaattgcaatccctaatgtgaaccttttttctcttatctagacaaatgaggcaaaactactctgacagacttcagtggtagtttttaaattgttgttatttaaggaatacactactcataaggacttttcttctcacattgaacattacaagataaattaaaataattttatctaagtaaatgtcctgacactaagtttagccagacttcaccccttaatcggttttctaaaacacaaaaagaaaacaaatgacacctacatggaaattttacttttgaaaagcagtgaaagaaagcagtgaagacgctttgaccttgagtaagattacagcctctggtccccaaatgagacatgtgtagtcttaccttgtctcaggtaaatgtgtgttcatcttgtatacatacataccacatgaatacaggaaggggaatactaaaacctagtaaggtgaatggttttgtgagcatgcatatatatatatatatatatatatatatatatatatatataaatgatcaaaattgatgctaatgaaaaaaatctgtcttgttacaggatggacctttcttcccgtggttctttaacttgagtgtgcgttagaattgcctacagggcttgatcacagatctgcgggctccactctccaagaatttctgtttcagtaggtctgttgtgaggctcaagaatgggcatttctaaccatccccgtgatgctgatctgggacccacactttgaaaacaactgctctactccatagggggaaatgaatgtgtcaggaaaaaggtgctctgtttctgaagaaagagaaacatgaaaggttagacaaagaatataaaggtaactgaaatcctcgaagtaaaataaattccacctcttaactatacctataatcctttgtttcacaggccagcctaaatttaccactttatcttatagagttgtctgtgtgaatccgctttcttatgatatagtgagctcctttaaacattgtggcatgctttattcatctttatgtctgtcatagattagaagtagtaagtgttcaataaacatttgttgcgttaaaagtattagaaaggaaatagactgtacactttattctcgattggtagaaattttatggtgtaatcctaaggtaaggtacactattgatttcaatgtttgaattttttattttattttctatctaaaacaattcacatgtgtaatgaattaaacatctgtcttttgtgaggtgatacttaaaaaatacttagagacacttaaataaggagcataatgctgtagaaataccatatatggaatctattcaatttaacaaaactttatattgagcttctaccacatgcctgatagtatactcaatgctggaaatatctaatataatgatgttaagagcttcaatttattgattagttagcatacaacaggcaatctgcaaggtgtttacagcaaattatgcttatttactcatcgcaatacctctacgaagttggctttattagcatctccagattaaggaagaggaaatcaaagctttaaaacattaatttattctaaatcacacagctaagaaatgacggaaccatgattcggaccaacgttgtccgaagctagagtctgctttcaacagctctgctgtattgactcattccgaagacagggttagcccttaggaaagccacatgcaaaagagacccaattactttctactgtttaaacctgagcgaaactagggttacgtttacctaggtccaaagtcctaatagaccccaaaggggagctcttttttggatacatgtcaggaacatgttaaggtacaacttttcattcatcaattcaataaatttctcttgaatatttgttgtgtacaattactgtggttctatgaattcagtggtgagtaagtaaagaatgcccaatatctagtgggtgacacagataataatcaaatcctcacacaaataacatgtaattacaaactgaattaaggatgaggagaggaaaataaagagcactaggacagcatgcagcaagaggacttaattcaatttgtggagggggtgaccagggaaaccttcctgagcaagtgacaaccgatcaagaccggtaagacgggcaggaaaacgtgagtgtgtggagtgggtggagacagtgagcagattccctgacaaacggaatagtacgtgcaaaggaaaaagagattacagcactgtagttagagaaatctaaaaaaaaaaaaaaacaaagttagtgtagttggagtacagagaatgagcagatgagagggatagtaaaaaatactgccaacatagcaaaggacagactatgcaaagctttgcacaccattttaaggctaaaattaatgtgaaccttttgaaggagaaatctagccaaggctagatttatatttattaaatatcacactatctgtaggcagaacagtctggtgggtaggggggttactgtgttaattccaatgagagacgatggtagcttgcactaggatactaatgggcataaagaaaaactgtagagatattgagaaggttaaatcagtaggaccaggtgacagatttaataatggtagttgacggacagtgaggaagagtgaggaaaaaaaatccagacttttggcttgcttaactggatagtgtcattcactgggatggaggaacctggatgtgtatcgggtttgaaggacaaggtcgaacattcagtttggtccttgttgagtctgagttgcctctgatacatttaagtggagatgtcaattaggcaggggggtatgtatataagactagcattcaaatgagagtttcagggctggagatgtaaatattagaagctttgcagaaacattagttaggttaaatcaggaacatagataagattacctagggacagaagacaaagtgaagaaatgaaaggagatatcattccttctttggaaccttgtgtagtgaatcagaatcaaaccctgtttaattttaaattacaaagccaatctaaccactcactgtgtagatgaagagaactgaagtcctgcgagttttatccatttgctagattgtaaaagtcaagctggggcaagaactcaggtcttctgagctgcagtttaattctccacctttatcgatatttcttaaaatgtggtcctggaaccagcagcatcagcatcacttatacacttaaaaatgcaaatatttaggccccatcccagatctactgaatcagaagctctatggctagggctcagatgcatattcaggtcagagggctcctgctctattttgtgtaatccccttcctgagtgttagcaaagtgatgggttcacacttacgggtagagaggtagcaggaggaaagtgaagctgttcttgactctgtgccagaagagattacagaaactgaccctctcgaactcaacagaagctgtagaccacattggtacatgtgttttataaactacaatcatgcatgccgtttctgtgctttgcaaaagagacagatagtggtgccaggggaaaggacattagcagtccaagttgattaggtaaaatggtctgacacagtgaggcaaaagttgatttggtaaaaacttgacatagacggcactttcaaccatcggtatccacttaatagatgtaaacagctattttcacgacacaaacacccacacttacatctttagaacagtctcagcaattctgtatgcttgccagataaatctctgctgcaaattatcctccagccatgagatttaaaaccaagagtttctagtgttttgttcctttgaaatatgtaaccttaaccagatgtttataccctgggtcacaaaaatctaattgaatagttcacttgatgtgttcgcacaattaagaaactcttcttccttaataggggaagaggggcaaattcatatgtttaattttcaaaaacacagagcgttctctgctctacaacagtctatcagctagaaatgtctattaactgtctcttctctacttcatgagcacaaagataagttgtggttttagggaccctttgggggatattaagagatcttgaggtaaatgctaaaccaaacagtttagtttgtattcaggacagtagacacgttttatatactatcatcctactttaacattaattatattaaaaaattcttcttttaactgggctatctaattaataaggccagcaacattccttgaccaatatgcttgtataagcttagtttatttttgtgtataggatttatatattcaattgtactgatgaaaaaagtatcaggagcttctgatcttcctttgtgacagtgagaaatacagaactctcagcacttaacaactctgtccaaacccttgcactaagacttgactaaactctagtatggtttctagccccagaaggccatgtccctaggatgaccctagccttcccttaagtgcctgcttgagaaagctcagtgctgccaggaaaatttaatgtttgttctagccaacacacatctgttgataggactcttacctccgtttcttagaacatttactcaaaagggcttacaattgtgaacatgtagctcttggaaatcagaagtgtctctcactcaaggacctgaaagccattcttttcaaatgacatcatcaagaaggataagtcctctgtctcctgttctctgtgggaagatagaatcctaacttcaataacttccagctaacacagctggcctaatcacatttacactgtccagccctttgtacttttttacttctctaactcgaatgaacccccactccttctccctccttcttgccttaaaacaaccaagtcgcctctgcacaaattagaatggatctcagctctcccctaatttcacgaggtattgaataaaatctgtttttacctctttaatatccagctgtgtttatctctgacaatatatatgctctcaaaagcattccgataaataaattttcctcaatgatcaagcataataaaatacatcagctttgttaaatcacctaaatactcaaacaactctaccattagtatgtgaggtagctttgaaagtatttctaatttttctttctctttaatatgccacaggaagggacgaggcatttatttgaaccttcaattatatgctatcatagtaagaagatgattggaccataaatgcaaagacatgtatttgcaattgcattgctcaagaatgccagttatgtccattatccatcccttcaatgaaacaaagaccatccattttcttttagaggtaatcactactgtccaatgcaagacacagaaaataggcaatttggaagtatagtaactagttagcaatattcttttaactttctatataggtatactttttacatgcattaatttcactgtaaaacaagtaaaattatatgattaaaaagaaaaccagcttctaagattttgagaatgcattgcatacaatggtcaatgttaatctagtcaacaaagaactgttcaataaaacatgtttgtttacaaaatcagtggaagacttcctcagaaatattttatgtaacaaatgcctagggtgggctgaagagaaaaatccagtaaaatggcatttcaaaatttatattttcctttacatgcctctaatttaaaataaatatctgatatttttcatagatttagtttgtagtacaaaatcatgaattaaatcctaatgatttgaactataatttaaaaaattatattccaaatagcaagccaatcgattgacatttacaatcttctgataaatgcaaagtaccaattccctaaacatagcgttttatggtgactttttcaaaataactacatcattcaaaactattgagttgcctgtaaaacctaaattgcttgaacattagttctggagaaattttcatgatgcctttaaactctcagtgtcaaattcaacatttaggctttaaagcctatgggtggtatttatcaccattcaacactcgcatttatcacataaggaaaatatgtttaagaaagcaaaactgaaataggaactcagggtttaaaacacttctacttataacctgtgtcgttcctctttgtgtaaagtctatgacctgctgtttggaaagacaccagatatggagaagattttgaaatgcccaaatctttataacaaagcatcgaacagaggatctgaaagaaagagcacaacagaaactcaatgaaatatctagcttatcagtctgacaattaatcatatctaaggccccacctctaatctcagtaccttagccaaaaattaaataccaaggacagttacagtttgctctagatacctagaggaaagagaacctccttttcctcatcttttccatactaaaaatgtatactgtatctttcagattaatatatcagctaaaattttgttacttcaataaaccatttttgcagcataactcttgactgcaaataaaagtatatatactgacaatcctcaaattttgtttttcagctttgcttcatcagattactagaatgaggcagtgtcatgcattgattcaataaaatttccaaagtcacctaataaaagtacattttatgatgagaaaacaacaccaaaaaatagttaccaatgcttgatacctcttgagatgtggacctcttagaggccaatttgacagtcagaagagtatgagtaatgtttttcaaaagtttcatgagtacaaaattaaaatcctacaatgtaataccagcttctcttcctacttaaaggagatcataacgattgaatcaggattacattcaaataagccaatgacaaatgtgaaatgaaagagttattctcaccaataatcattgcatcctaaaagccaaagaaaaactgctataagggacttctcaatcagtccctatagataggaattggtagttcctacagaaaaaatatatatacatctatatatatatagatatggagagagagagagagagggagggagagagagagagagagagagagagagaaaattggtaattctacagaaaacattatgtccaagattttttccttggcttctgatttcgaggccaacgagtttgggtcattttaaagggcagacatcagcaagtgcctgcagtgacaaatagttattagctgcaacacaatactttttatttccaaaggttggccagattgaccaaaggagaatcttttcttctatccttcctttctcatttttcaaagactttttttttttttttttggtcccagaaacctttaagtctttttaagctggcttttttcccccttacgctttagctttgctcttttctttgaggtctcagtgacatataggtcagggacgtctttaccaatgtaatattagtggagagttataacaagggggtgaggacactgaaggcttacacaggtgcctgaataatttgccttatcactccacactggtgcaagtggtgcagaaataagagcagattatggcttttgctacatatacttttggatttacagatcaagtgtaggttttcagaaagtttgagtgttacacacaattattaccaccatacccactactatcaatgccagaattatcaatggataaaatttgtttttattattttctattgacactgagttttatatatatatatatgtgaaatcttgtttctgtataaattcccataatgcacactccatccaagaacaaacataatttaactatagatcatatcacataactcctctggttaaaaaccccaatggcttaacatttaatttataaacaaaaaaagcccaactctttacaacgtcccggaagactgcacatcatctgatgcatgccagatctctcccttcatctcctggcacttacctctccatcaccaaaatccactcacacttttcctcaagtaggctaagttgactatgcaattgcacgctttttgtttcctttgtctggaacatattctttaggtatctgcctctgtcactattcaggttccttttcaaatgtcatttcctcaaacaaaagtccttctctggcttctctgtctggtgttatgtctcaactcacattccagttacactctaccacactgctcacttttctgtataagacatattgatatttaaaaattgttattactttttaatgccaggtgcgctggctcatgcccgtaatcccagcactttgggaggccgtggagggcagatcacctgaggtcaggagctcgagaacagcctggccaatatggtgaaaccccatctctactaaaaatacaaaaattagccaggcatggtggcgcatgcctgtaatcccagctactcggtaggctgaggcaggagaatcatttgaacccgggaggcagaggttgcagtgagcagagactgtgccactgcactccagcctgggtgacagagtgagactctgtctcaacaaaataaaataaaataaaatgaaacaaaaattgttattttttaacatctatttcattagcatataagatccttgagagtaagaactttttgcttctgattcattcctgtaattcagcacctagaaaaacatttggcatatagaagataatcaatggataggtgattgaacaaacagctctttgaaacaggtacgagttttcttgttatcttaaggataaaaaattcctgaagtttagaaggggtaagtgacaggttctagatcacatagcatccagcagagccaaccattgaaagtaagactacatgcctgtctagccaaataaaatgaatttggacacattgtgatggagctagggattgtcaagatcatgtatagacatcctaacattcttgtcgcattggaaaacgcagatattatcatgtattatgagaataatttcttagtcagggatggtcattagtgatgaagaaaaaaccctttaaaactaagataacttcaagaaaatgggtcatttaatcctctgttctactgctgctgttttacacgacattctcctctaggtattacgtattcagtggaaaatatttagtgcttgtaataaagtaagccaatggccatattgtgaagtatagtgctctacactggatgtcagaagacctcagtgccagaccctgcttcttcacacagtagttggagggtaaagtcatctgagactgtcagttccgtaattttaaaatggaaaaagcatatctgtcatatcaacctcaagggactgagagatcaatggagatgatggctataaaagcacattttaaatgccagagggatataaaaatggaaggtcccatcattgttatttagggatgaaggctttttaatctatatgtgttcagtaacatatattgcatgagaaaataggtgaatgatgaatattataaaataatacaaaaatacaatattaatagatataatgcttacctataaggtcaatttgttttgacctaaatttagattaggcaacatgttgcataaatgggtgggtcagtaacggaaatgtcactctaaaaaatgtgcaaggaagcaactgtccatcatggtcaaattacttcagatgccttgaattcatgaataaaacactccatcaaattttatgcatctcaagcacttctcacacatttaaatccacaacatcctagtgaggtagggaaggaggaatatttcatttttcttatttggtgaaatgaggataatgaggcacaaggaggttaatgatagatttgaagtgaatgcaatcagtcagcagcaaaaccatggttggaatttaggttccctgaattccacttagggttcttttcgagatactacgttaactacatttcattgttggaggaatttaattcagtcatgtagatacagatgctcacaacatcttttttcatcctactaaggaatcttgctgctaattcaaccactgagacaaataatacgtggacctgcgctggagatttggcttcggtgttcattcaagtcatttcctgagctaacttctgttccttttcctatgaatactatattttttcacattataccactgaattattcagattcattgaatacccttagagttattaacatgttatatctaaaaaaattactgctttctccttttggttatatagctagaaagtcaggatatagtaaaaggagacccaaaatgtaggttttgaaaatagaacgtcagtttttgaggacaccacacacttttgtttttcttcccatctcattgatcactccttttcttttcttttttttttttttttttttttttttttttttagatgaagtctcgctccatcgcccaggttggagcgcagtggcacaatcttttggctcactgcaacctctgtctcctaggtacaagcaattcttctgcctcagcctccagagcagctgggactacaggtgtgtgccaccacacccagctaattttgtatttttagtagagatggggtttcaccatgttggccaggctggtctccaactcctgacctcgtgatctgcccgcctcggcctcccaaagtactaggattacaggtgtgagccaccatgcctggctgatcattccttttcattatcctgtgctgttttctcctttgtcaatccacctcttaatgttagagtccttagtcacgttgtcatttctatctatattcttccttagtgatacaatctgatatcacagctttaaatgttatcttatacaaacacctccgaaatttaaacgtccaacctggaccttttttgctgaactctaaaggtatttattcaattgcctattcaatatatctggtgatatgtctaacagatatccaaatttaatgcctccctaatcgccccattctatctatagtctttattatttcagtttagggcaactttatcccttccagttaatcagagcaaaaacgttggagccattcatgactccatttttctcccatgccccttatccaattcatccagaaatccttgttggccccacttccaaacacgttcagaatatgactatttcttatcaccctggtctcagtcagcatcatcttctcacacttagaaagagaaaaacgtccttacaatggcttcaaaggtccaccctcacctcactaacattctctcctaaacctctctcacttacttcactctagccacactgcagataaccagccccaaacagcagataaaccgatggcttaggaattctgcattgactgtttactgaacccaaaatgagtttactgctgatatctacatgattcaaccccatgcctcattctttgagatctttgctcaaatgtcaccttctcaatgaagaataccatgataccctatttaaaattggaatgtactccagcatgagccatctcttattttacccttcttcttttttttcacagcacttatcacttttgaacatactatacaatatacttatcgtatctgtctttcactatttgagacccccaagaatccagagggcatacatcttttctgctttgttcactgacacattcaaaacatctacagtagtggctgacatatggtggtggctcaataagtatttttcaaattaacctgatgctaagtccagaactttcaactgcccagtcacagagctagcttcagggcatttaaagaactgaacaaacagataatggaagtgggttcatgtagatagagaagaaattaaaagaattctcattctcatgtagaatgagaagacaatggggaatagggatacacatgtcctttttttttctactgcaggcaaggcacagaagcggggatgtaaacaaaggagacatccgtgaagatgctaatataggttttcacaattctaaaaaaaagataaaataaactatgtgtttaacggtgacatggttttaaagagttgctgaatgatcagtctccctttccttttctttcttccagcgctatattatttcaaagggtcactggttacttcatgggaaccagacgttgttattgccacttgtataagtcagatgaataaagagaaattcttgataaatgaggtatactttgaaggcaaaatgttcagaaaatagggtatatgtgagatgaaaaagtatcctcagagatgaaaggatttgccaaaaactgatataaattccatgggtgcaaacagagttctaagcctactgcaataagatttgactttattggattatctatgaaatatattattgtagtaggggtctatttttatggccacatctggtctagacttcacaaaagaattacaatgggaatatactctaccaagatgccaaaaaacacatatctcttcattcctgaaagatattgcctagactgtctaaatctgaaaattaacaaggattctgtaattacttcattttcatctacatttccccaaactaaaaggtatcctagattatttgagctatagatgtgtttttatgtacagctttttaaattaatagtccactagctctatcggttacagcagtaataaaaaaacttttatggaaagttctctgagactaaaagtgatttacatgcaaatatatggaaatgattcccttcttaaaacagtaacaaaaggtgtgtttgaaaattcatgctttggaagaataaatgattttcacataatcattctagtaagttgtttatttttattgacatgcatcttttattagctatttaatggtggttcacaggggtgagtgcactggatcacgcctgtaatctcggcattttgggaggccaaggtgggcagattgcttgagctcaggagtttgagaccagatggtgaaacaccatctctaaaaaaaaatacaaaaaattagctgggcatggtggcgtgcgccagtagcctcagctacccgggaggctgaggtgggaggatcacctgagcctggatggttgaggcagtgagccatgaatgcaccactgcactcaagcctgggcagcagagcaagactttgtctcaaaaaaatgtgatccacaaaaaacaaatttaagttgttgaatattttaggctagctcaaatacttaactttaattttctattaaaatatataccttatttaatgctaatggtatctaatttgcagctatcgttactatacacataaactgcacaaatcaaaataaatagaaaacaaatattaataaaatttagtcattaacccttctggatgacatgttataattaggatattaattggaattggcattataaaaccatttagaattcgttgtattaaaaaaatctgattccataaatcatggggaattttttattttaatgacccatgtattagacttacagaaaattgtggaccttaagtaatgttttattaaaatgttctgctatttaatttgtcatatttaaaaatagctaaaatcatagttttaattttagtaatatttttcattgtgttctaagtaagccaacccttaaacatcaaatgctttcttttgggatatgtcttttcaacttctggttccctcaggtttgatccattgacattctaggcactgttggtgtgtcccacctagtatataccagccaggccttctttatcatgccccctgggcaaagaaaaactgattccatttatactagaataatatcattgttgtcactacttattacctaggcaattggtcacactctactcccttcttatggtactttcattaaggcatatgttcctttatgaaaaacattccattcctggcagccgaagtcaatctacaaatagccaggtagcaaatcaatgcagattacaagagaaagtgaacaagcaacagagattaaacaaaacaaaacaaaacaaaacaaaacaaaacaaaacaaaacaaatgttagagattgtgacttgaacgtggcacagcctagttccttgttctgccttgtccttcaaaaaacagggtcattattttgtgagattcaaactggttttgaaaattaatcatctcatggtatacaaattctaatccaccgatggatgaagtagaactttccatgtttcttccactgccacttagaaaataatattgggaattgaacaatgagaacacatggacacaggaaggggaatatcacactctggggactgctgtggggtggggggaagggggagggatagcattgggagatttaccttaagctagatgacgagttagtgggtgcagcgcaccagcatggcacatgtatacatatgtaactaacctgcacattgtgcacatgtgccctaaaacttaaagtataataataaatttaaaaaaaagaaaataatattttattatgtacagcgtgcattatcagcacagataacataaaactttttttaaaaatgtgggtttattctagatttttaaatctatgaggcttatttagaatgctgaattaaactatacaagttaatcttgaagaaccagatattggaattgctgctctcattaattcctcccacctgatttgtgtatgccatcgccagcaaaccacatagttggtgcctcctttacaaaaaaaagttgtgctaggagacaagcataaattacaaggtcagaggaataccttcaagaatcttaaacccatttgaacagtatagaaacctagggatggaaaaaactctaatagaagaaaactacaagaaccaaaggggtaagccagtacaacctctgcaaaggtaatcttactccatccactaaacatagcattatatgtttagtcactcacacacaaagatagtgaatgactgataaggagaacctggccaggcattaacaggggatggcctttcattgagtaaaagatattccttccagagtagagctggtaaagccgaagagaactgtattcaaatgaaagtatagttttttttttcaactttaattttggactagggagtacctatgcaggattgttacatgggtatgttgcatgatgaaaagcaaagtttttgatttcaggtttttggagaaacaagagtgcctcggagctgtccatggtgctgcatgagaccaggccttcattctgcagaattcctgcctcttgaaaattctctaggccctgacttacaaccctgtttgctgtatggttaacctgccaaccctgctatgtcccctataagtgattatttaacataatctataatttcagtactaaatatttcatgactaattataacagctctctatgtttccctgggtgatatcaccacacattccaatttggcagatctcggtgggcccaggaatttgtatgcaaatatacatcctcatataattcttatgagggactaaagtcctgcttagactctagtcttcccaaggtcgcccaccttaatcccgagccaactcgtccccagttggagacaagagcagaaattttgattccacaaagctgtttgattaggcctcacatacatcatctggaatcacacaactgaagcttcatttatgacactgctacagtgtaccaattcctttccctatatattttttctttttttcaaatcctatttatcctacttcaaatctctatagcaccatatttagagtcattcagatcttgatttgaatcaataactacattgaaacaactcacttaaccctatattcaagccttcatgaattcacctgtcaaatgaaaaaaataacacctacagctttgcagaattattttcagggtaatatgagacatggtttctaactcagctagcacattatctgatacacagttgctctacttgcatgtgagttctgttccctttccttctctaaatcttttttaaattcttgcatcatttattactttatttcatctaatgaactcttgtttctatcatttgtctcatcaactagctttccagatccttgactaataaagatagatattgcatactaagtgtgtggtggatggttgccaagacctgcacagagcactttacatatcttggccatgaggactcaaatattgagaggcagagttggaattctgaatctcaagctacagctcctgtcatgccatactacagtctattaccattccatttcctccaactgtgcctaagctaagtgcctggtatgtggattaactgctatcagagtcttttttactgtaatggagtagatgcattgtctatatcctatttgctgcatccacataattatcagtccgttcaaaaagcatagccaattgctctatcacttagtaaacgactaacttagaccactggacggaactttttttggaaaccaaaagaaaacagctcctaaattgctgtacctgctctcctcagattattatgtgctggaaaatcggagacgattattcattctcatacacttcacattttccagaatggaaaattaagtagcaaaggcagatgtcccctgttggggcaacgattgagctggatatagaagactcatatcctgtttgctaaactgggctgttcttactattctcaacatgttcacatcatcataataaaacaagcgccccttaagacaccataaatattacaatctcagtcaatatatttatagagtcaggaagagttggatattctcatattcatcaactgtaattcatcaggattattatagttagggagggaaacccaaagttatgacactgaaagacatgatcagtgagttttaataactcaaaacatacttgctatataacacaggaatggcttttgacacatttgtcattactttataaaaataatcctttaagttactttgtggtgatgaaacacttctttatcttgatagtggtagtaactatataaatctatagacatggttaatgtcatagaataacagataatgactcacagtaaaagagcatgtgcaaaaacaggtgaaatccaagtaaggtctacagtctagttgattgcactgtgccaatgtcagtttattgggtttggtaatatactgtatttggttaatatgtaactggggaaagttgggttatgtatacacaggaaatctctgtactgtttttgcaactccttgtgagtctatgaatatttcacaataaaaaaatcttaaaacattcttaaaactttatagaaattttgcctgccttcaaagagactgtaagggaaaatagagaaagaagagagaaaattaaaatgtctggctaattcctaataggaagttttctttatttttatacaagaaacggaaaacatagttgctatatcaacaggattttagtctattttcttcacaaagctgaagaaggtgtgaatgacttttctctgtgcaagtgaataatatactaaaattacttgttccacccttgtttttgtcttgtttacatcctacttccataaacctgccaatatttagtcactaatcttaagctatgacagaatttaaaacagattcaatgatatgatttgaattcaccttatgtaagatattgtaaagcaatatgatgccacaacacacatctagaaaactgtgtcttctctcaaatggaactgagttgttcctaagatgtttaactaaagtgattaaatgggctgaattataacatattgatttttaaatggtctagccacatttgcattgttaattttttacaagattgcaccatagatataaatcactgacaaaatattttaaaagtagcatacaaaaatcgtcaacactgggataaaatttaactttcaaaattaaaataatcttagaaaattcagttatccaaaggcattaagcaatgacttttcaaagttgataaggatatagtttctattgtgaaagtctattagacaagtacttttcaaaattatataggttattgtattagtccgttttcatgctgtgataaagacatacttgagactgggaagaaaaagtagtttaattgaacttatagttccacatgactggggaggcctcagaatcatggtgggaggtgaaaggcacttcttacatggaagcagaagagaaaatgtggagacgcaagagcagaaacccctgataaaaccaacagatctcgtgagacttattcagtaccatgagaacagtatgggggaaaccgcccccatgattcaaatgacctcccactggatccctcccacaacaagtaggaattatgggagtagaattcaagatgagatttgggtggggacacagccaaaccatatcagttattgaaggaaaaatggaagcaaggcattttcaccaccaaattttgctcaaacaaggcagatataacctgcagctgcagaacaattaggtttatgtttttgagaagtttatagttaaaaacatttgatacattgctctgcatggtacataggagttttggtcacctcattgttaagcccattactccctatgcagtaacatttaatatttttaaatgaataaaaataaggtcaggtgcagtggatcacacctataatcccaacactttgggaggctgagtcgggtggatgacttgaggctaggagttcgagaccagcctggccaacatggtgaaaccccgtctctactaaaaatacaaaaaaaaaaaacaaatagcctggcgtggttgtgggcgcctctaatcccagctgcttgggaggccgaggcacaagaatcacttgaacccgggaggtggaggttgcagtgagccgagatcataccactgcacttcagcctgggtgacagagcgagactccgtctcaaaacaaaaacaaaaacaaaaacaaaaacaaaaacaaaaacaaaacacgttaattctcttctaaatggcctcagtgtgctctctttactcaatggcaattagtatgcacaaccccaaacctgcaatttttattctcctttgctctctgtgcctcctaaaacatcttattcctatttttaaagaactatttttaaaattttatttataagaaaaaatccagaattcaatataatatagagtgcaacacacacacacacacacacacacacacacacacacacacacacacgatcttgcatggtttctcaaataatagacactcatgtagaaagccttaattttaatttaaaaattaacactctggaagttacacaagaaatgatgggccttggggccttttgtgaaaatggcaagataacaaggcaggacaagagagatggagataacagacacaatgaatatgtatcagatttcgttgatacgttcattcttttttctacaaatagacattgagggctcactatatcccttgcgctgctacacacgggggatatgctgatgcaaacactggcaacataccttccttcatggtgcttacatcataattgcagactcagacaaaaacaaggcaggaaacagaaacaaggagctgagctatagaataatgttagaggatggtgcaaggggggtagacagccctctccaggactctccttggagaggattacctacccaaagccctgaggctatatagaagacacgattgcagaggaggatgtctactccagagagacactctgcaaattgtattaaaacttcccacatcaagggggatttgctgactctccttttgtttgaatattgtcagaagactacataggaaatggtccatccttcctcaccaacctttacggcccttccatcctctgagaaaaagagaggttttgacaaagggctttaaagtttcattgttttacttgcacttgctgagtccccttggggattttatctacactatccatctcacagaaaagtcgagagcattaagcaaagtaacggttaagaatatgcactgaatatcatcccttcttcattaacacaggacattataattttaaaacatctgactaagtccatgataatatggaaccattcctatccttctctgcacaaaggaggagaaatatctgtacagtctttgaacttagttagatatgggtctgaatttcagatattttactccatgctacgaccttgcaaagcttacctaaattctgaaccccaataaactcatggatacattaaagtaaaagctctgtgcatgcttgttagaatagcacactatacatttaccaaatggcaaagtgcctggcatggagaatgatagttatagtcataaacactagcatcgtcataattgaagaaattactgtccatgggatctagtcaatcattgagtattcactcagcattcaagactgatattttatctgaattccacaaatcacccttcactcaacacggttttcttatcatcatccttcaggtagagcccctccatcctatctctggatttgcatacactgtttggaatatctttaccattttcttttcatcagatatcgacaacttttataggtctactagatcatgaaatcaagggttatgttcatgtattacttggtttttgttctgtcctcagcacccaccacaaggccctgtatttttaaaggagctcaatataaatatattgaatggaattaaatgccattgctaaagttttcctcctcatgttaatctttacccgtgtaaaagaaactatcctttacctagttacacaacttcataataatttattactctgaattttcacaagaacttttgacttaaccactcatttaaaaaaaatctgcagataatcctgtaatatatttctccagcacagttcaccctcatgaagcaggcagtattgagcaagaggctaggctcactggttagacaagtaattgacccctcacattaaatccatgcaatctaaataatgaacactaattgtatgctgtaggctgccagggtctctcgctgtagttaaaagtaaaaatacattttttttttttttctttttgagatggagtctccctctgtcgcccaggctggagtgcagtggcctgacctctgctcactgcaagctccgcctcccgggttcacgccattctcctgccttaacctcccgagtagctgggaccacaggcgcccgccaccacgcatggctaatttttttttttttgtattttttagtagagacgaggtttcaccgtgttagccaggatggtctcggtctcctgacctcgtgatccgcccgcctcggcctcccaaagtgctgggattacaggcgtgagccaccgtgcccggccacaaatacatctttatatgtttactgtctactagatactgaagactgtcattcactaactggtcactgtgtataactaaatccttgtatttcaatgtgattatgaggcccaagaaaatatgtttcgttctgggtacctaataaactcttaagacttgcccatctcccacaaactgtaggcaaataattcttctaatctgcttttatttctttattaagataaagcatttgaggtcacaatgttctatggaaatctagaaattcctaaggcaaaatctaggtgacacaattatagaagatgccgcaactgatttccctcaagcacatttctgttgccatagaatcatctcaaatctgccaactttgaagctgaactcctctccattccactcatatggattctcacatgggttttagtagaaaaatttaaactattagaacatggactgatttttctctggattattaaatgagaagggtctggattccccattacttttctaattaaaatagtatcaaaagcaaagacaaaccaatcctcagcatgtatattacagagaacctgttacagagacattatcaaggccatatttttggtaaaattacttaaaatctgattgaataaaagttgcctctaattcgtttatattaatagcactttaaagtaatacatacggatacaactttaaaaagttgggatttatcttattattatgtcctgttaaaatacgcttataaggaagaccaaaaagagtacactgatgaggatctttgagaaaattaaaaatgaaaacaataataaataaaattgtcatggctaaaaagcatatttagtcttcatgatgttaaactattatgcaattaggcaaggacattcttgtctttcaaaaataaaattcacgggctgggcgcggtggctcacgtctggaattccagtgctttgggaagctgaggagggtggatcacctgaggtcaggagttcgagaccagcctggccaacatggtgaacccctgtctctactaaaaatacaaaaaattagccaggcgtggtggtgcacatctgtaatcccagctactagggaggctgaggcaggagaatcgcttgaacctgggtggtagaggttgtggtgagccgagatcgcaccattgcaccccagcctgggcaacaagagtgaaacaccgtctcaatgaatcagtcaatcaatcaatcaaattcacactttgaaatctattttttgaaagtatataatcataaatgaaaaccaaacaaaaccctcactggctaaaacaacatgatggaaacataaaagtgacaaagtttaagacccatgacacatgtatgtaagttatttcaaaagagatcactgttagaaatttgctggaagtgtttttgttactgtgaataataacacaatttttgtaatttgcaatacatcatagataaggcatatacacacataaacattgtgaatagtggtaacacattcagttattggggctttcactataatatgcctgggtgtgcctccaacggatgctaaatttagtgcatttgaagtctcttggaaaaaaacagtcccaaggagtttgaaagggaaggtgttttaagttcagcacagcatgctccttgcagcagcaaatgtgtctgaaagcttcttgctctgttgcactgtgagagaactatattaaaatgtgttaatagtagaaagaataagttcacctcaaatactatatttccttgatttttgagacaacagtgatttcctgtatgttaaaaattatagagagcaaaatacagccatttcacgctaatttattatctccatgtgaatgtgcatttacattttagataatatatagattacttgtgaattataagccttaaaatgaattcaaacatgtcagtaggaagaagctaccatattacagattcttgaaaatcacaaattgaaattacctaatgatatgattataatttaatactagtatcaaaggtatttttcctattattttattttactaattactgtaaactatcggtaggattataggagcaagacgtcaagatatttattaaccatactaattttttattggaagccatattaaatttaacctgtaaaatgagaaaaataaaaatagtaacctcatagattgtggtaagagtcaaatgaaataacttacatgaaattgctttgtaagttttatagggctgccatgttttgattgtatgatactatgtatccctactgtttaggacatctcttcctgtttaggacatctctttcatatgtgcagagacctgtgtttactgctttttttattcacaatgtggtcttttgttaccataagttaatgaaaacatttttcagtcttgtaatttataaaatgttagtgttattaacaactatacatagatgatagagatagatagatgatagataaaccgatccatcgatagatagataagtaaaggagagtgacagagacagggagagggagagggaaagggaaagggatggtgggagagagagaagtaactgagtggatggatgggtagatgaataagtggatggatggatggaaggagacaggtagacagccagatgggtatatatggatagatagcgtatgatctttgtcctattatttaacttcccttgcttcaattttagaagatataaaataggataacaagagtacctatcttataggattgctatgagcattaaggtagttaagcctgacacatactaagagctcagcaagtgttaagtatttttcactgtagttggtatttggctcttaaagaatctgtcacatatttctatacagtttttaaattcatagattagatgtagcctaataatgagagcaatcatccattaagcaccctctatgtgtctaaacgcagatgttttacataccgtaagtcatataacatgagaataaacctttaagacacttactgctctccccattttacagatgagacaaccaagacttaaagtattgcccaaggtcttagagttggtaacttgcaaaggcaagaacaatgaccacaaaaccagaacaactgacagcagagtatctgttccagctccaataattactggctacatcagttctgtgggtcccttcatgatggtacctatacctctagagtttaaaaataaattatcgtttaatttttgcataaactctatgatgtaagtcaataataattcctcttctttcttaactcactagcatactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtatccttgagtcttactgtttgggtctgaattcccattttgccattttctaactgtatacactcaaaaaaatttcttcttttttttttttttttttgagatggagtctcgctctgtcacccaggctggagtgcagtggcgcgatctcggctcactgcaacctccacctcccgggttcacgccattctcctgcctcagcctcccgagtagctgggactacaggcacccactaccacgccaggctaattttttatatttttagtagagacggggtttcaccgtgttcgccaggatggtctcgatctcctgacctcgtgatcagcccgcctcggcctcccaaagtgctgggattacaggcgtgagccaccgcacccggccaaaaaatttcttatttatacctctacttcctcatttctcatatagaagtaatagtgccatctaccttactatttagaagactcaattaatccatgtaagttacttagacctgtcattttagatattattatgactacatcagaagatattatgttagtaataagaaaaacattgttaaagaatttgaaaataaggagaataagatttgttaaggtattttgaaaattaattttaaattgttgttttgttagttagtagggtcttaaaatccttcatatcacctccaataagcttctgagaaataaataaatataagactctacatatcccatttcagggatgacttacagagggacttaataaaaatgcagaataaactattgtttttgttttgttttgttttaccagaatatctcccctttgattaaaaaaaaaaagattattgtaaaagatgatgctctaagtctgctttacactggcaggccatagacattcataaataaattcctacaaaatgaaataggaattaatccttgtacaaatactatagctaactaagtacagtttctagaagtatattttgaaatgaaatttatgtatatcactggtgataacttgtactcatttaaatgcttctgaagcattctcttcagaagttaataacttttctaaaataagtcaaatcatgcaatttgacgaatataaattgcagcaattttaccattgctaaaatggtttccgagcattacaagaagagttcacttggctactgtctttacactgaatactttgatgaggttacaataataaagtgacaaagtgatatgcattttcttttataccattttctttaaaaaaaggagtccttaattttttctaagaactccaaaatatgaaagtagaaaaaggcagctatgactgaatacatttcaagaaaaatgtcattcatctttcttaaattgatctgctgagtccagcagaaatgtctccaaggttttctcgtgacgagccaaggctaaagggatacacggagccagcagttagaggcatctagtggggcaccggttaattaactttttcttctatgcttcaagtttcaatgcctataccaataccttttgttctttgcataggatattatgcaccgaaaatgaaacaatactcataaaaacagctaatatttaatgagcatgagtaattgccaattgtgattctcaacacttggcatatatcatttcattcgtttttaagtctactctatgagataagtagcattattgtgctgattttacagatgcaaaactgtggcccagagaggtcaatagaatttcaggtgtacagatataaaatattcatgaaccataatatcctaactatggtataaatataatatgccataaaataggcacgtggtaagtgtttgctgactaaagattgaagaatgtgttgtaatggagtctattaattaaagacagggaatttggacccagaaagatttggcttggtcttatattggccatctactaagacagtttggaaactttatcaataaagtttctattttagagaatatcttagtttgggttccctaaatggaggttctgagatgaagcttcatgcaaaaatgatctaatgggatgtgttttcaagaaacactggtaagggaaaatgaagtgagattgggaagggaaacagaccaaacacatatatggcataaaagcccagggtggcagtgccattcacacttctgaatttctcagttgggaacaagaaagctcacgtatttatgtgtctgcaaccagcagtcattgattaagggcttcccacacacagggacataaattccaggatagatccatctctctctttacacagaccaaataggctctggcagcctcaaggccaccctccaacagagcgattagggagctagttgttgggagtaaaagcacagcagggaaaatgttaaacggatgtgaaaggatatgagtggatcaatgacagcatctctacagagaacttgtttcttcattcaggaataaaaataacgtggaaagttatgaggataaaacagggtaatgtgttcaaagcccttagcctgggcactggcacacagcaacactcactggcactctcttgttgtgaggatggaatgtaatactgtgaagaactgacagcacctggcacatgaaaacatcagatagctggcattgccaatcatttttcctattgcagttgccggtgccgctggtggtggcatacctaaattagaataacactgctatatttaactccaaagtctgtaaaatgcttgaatacctgccaccgtctgtggaggtgagggtgctcgttcaggacctgaacaccatagaagaagcaattttctcaccatctttattgctaccatggtattaggtaagaacctcaggatgcaagaacaaaaggcagcaccttttttgctatcacatatgagatgctgaatttattgataacagtattaaggagaatggcagctgaaaggaaatttctgatatttctttcatgatcctcccagattttgacattcctttcaaaattattagtgagagcaatcagtaagtgtcttctgctaccaaaaatgtgagcccttgcttgaaacatctttaggtaagtaaagtcagcccctaggaaagcacttaagcaaaaggctagggaaagagagctatatcaggtccaaactaccgtgctgctactcctcactcttggaagaaaatttaggcctttgcaatgaaaattaatggagaagcacatgacacctaaatgttaatattaagggaggggatagggagaatatgatatatttctctatgtgactccatcctgtttcatttgttctagtgagtacatattactattatactttgtgtgtaagataaaagaaagtttaaaaaaagaaaaattgaagttattttagaacagatcaaactgcttatgagaggcttactaccttttaaaatattattttgattaaactaaaaataaattcttaaaaacccagccaaggtaagaaaagaaaatagttttccttctcatgctctcaaactaagagtatacataaattggctaagaaacggataggatgactcccctttttccagggacaagagtgggtttaggagataatccagttctctagttatatacttgtttaaaaaccagatgaggagatcacttcctcacccgtcttttgcctctggaggcaaaaggtatggtcagagttcagtgacaaagtgacaatcatcaagggagtttagtcagctgaggttatgtttctctaggcattcttatacagtcagaccatgaaacaagactactgcttccaggaaatgccacaatacctccttattatttacatttctggaagcaaaggcagcagaatttagccactggagtcctctccactgtcttctctagtacaggtagttcctgaacattactccaaatctacagagacccttattgacagatattacagagatactcaccaacatgccagcgaaacatggtttattgttttttgttttttattggctattgtagttttacttatcctcatctattttattagggtcttgttgagtcttcactatcgtgagcacctcagtattccttgtctccagaaagaaaatgtcttgaggttagaaattgtatgtaattaattaattttctcttccatcttaaaaaagatggctgttaattctatactgacatagtatctaataactgcttctttatatcttggagattttccctggcatattcaaataaatagctgtttaaatagccctgacctgtgagtatatatgcccttgtacacatgaatgtatatgtaaatatgcaaagatacaaaatgataaatacaaagtgaaaggcaaattgttaatatattttaactcattcaacagaagaaagaaggcaggataacttcctctataatttcaggttttcttcaggatgcataccacatatgggctacattacaatgttccctccaggtagcaaatatgttcaattttaaagtagacaactgtcggaaattgattttttaaagatggggggtgggcgttgagtaaatctattatgcttgtatattgcaaatgctgtaactattatttttttaaaagacttgactttcactaacaacaaattttcttctttatatgaatatactgatctcccatcggatcatagtgttggacagttcctaatgtaccttgagataagagatgctcaagggtttcattagatttttagagagagtaaaagccaggctgaaaatgttcctggattctatatttgtctcttcacttatctttttaataacactcacacacagacacatttttatactcaacttcaaataaaagtatgccctgccctttcttttgctgataataaatatgtggatggtatagtctccagagagcgaaagtgcccttaaacatttgttttaagatcataaaaactactgttatttttaaagtagaaaaatccatgaatattgaaattgtaaaatcaagggaaaagaaaatagttttaaatattttgggcaaaatcttcttaagaaaaagaatgtcctatttccaatgactctggcacgtttaaacataggaaagaattagaaaaacaattttagtatattttggaccctttaaaatttaagtaaaacattaagatgtattttatacctttactttgaatatgtgataattctcctttactccatagaatacaaaaactctgcaaatatcattatcttaaaaatgtatttgtatatatgtgttaaattgaatctttctaatgaggaaagttaacgttcactctcaggttgttcttatcagatgagtttgtagttgtattatgaagaaacaacacattccttactgacgtctctattagcttagttatttcagttgagaacaagggaaaacataagaatggtattattggagtgtattgctatacattttattcacatcacagtattttatatttctctttttttaagtttgtacacagacaatatctctggaattatttttattaagggatatttaatgattaaataagcactcttagcgaagacctttaagtgttattttttaccaaatcgtatatagcttccacatacaatgcaaacattccagtactgcagataatatacaggggtacacaggtttgaagtagtggagagactgatggaccataagccataaatctttttaaaaaaatcaccaaaatctcagctataatcttgatcatacaaaataaaaagaggagctctaaagaaataaagcaaaaaaaaaaatttataatccacattactgcaatcatctagtttgtgaaagaagagtatgtattttaaattaaatccttaatgatttgatattttgtttttggaacttcacaaccaagactatcctaaggaattcagagctttcctcacaagaccaaagcaacagtgcatgaaattgaactcaaaaagagccaccattctgtgtgacttcttggctgacacaatttagatatttatagctttacgaatgggccactggagaagaacttgaagctttctctagccaggaaggattaatgaacgtgcgcacctggtaattacaccactccatcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggagtatagaagaaagaaatgctccaggagagggaagtggatatgaattgccccctccagaggagccaaacaaattggctgtaggaagacttcaaaagctggacgaacagagaagctcaaagaccttacagatttgggctacttgcccttgctgtgttttttttttttttttaatttcccctagaatgaatatggtttaacttgagagcaaataatggaaggatgcatttttaaatgctttgattcccagctttttattctgcctctaactagctattacaataccacttaatccggacctcagcattccaagtaccaaagcatctcctcccacccactgctcacacgctcctgcatcagaatagaagacttacagaaaagctgccagacccacagaagagcactttcctctcaacagatgtcttccagcttttaggcacacacacactcagacacacttgcctaccttaataaggtgtgcaaaaacctctttcggtccccacggatgcttttagttcagagcagccagcaatgcctccgcacaaagctttgccattgctagtgtgaagagaaagagctgctgggatgctgaatggcacatcagccaactttgtgtgtagcaaaggctctaaagaaatcctgggctgaaactctgctggatcatggattggactcaatttcactccacacacagtctgcattacctgatggagattatttctggaagcacttagggcatgtttgtctacaaaaagatagggcctttttctttccttaacaatttaaaaaatacggtaacaaaccagagacctgatactttaaggaagatcatttattgtgagctccatgagggcctcaatggtctgtttcgaaattgcagccccagcatctagaacacagtcagcacttgataaatatttggctaaatattaaatgctcaattgatatcaggttcaaattagaatttgctaaattatttacacactgtaatgaaagtaaaaaatgcaaggtttgctgaacagctccagagggttaataagagtgtgtgtgtgtatccttttgtcattcaacacacacacacacacacacacacacacacacacacacacacacctgtatagctgatgataaatatacattatatcaatgagttaaaataaagtgtgctattcattcactgagcaatggggctattgcctgggcacggtggctcacgcctgtaaacccagcactttgggaggctgaggcagatggatcacaaggtcaagagatcgagactgtcctggccaacatggtgaaaacccgtctctactaaaaatacaaaaattagatgggcatggtgacgcacacctgtaatctcagctactcgggaggctgaggtaggagaatcttttgaacccgggaggcagtggttgcagtgagccgagattgcaccactgcactccagcctggcgacagagcgagacttcgtctcaaaaaaataaataaatttgtaaaaaaagatttaagcaaacccactgataacaatacttagaaagtttgttgaaaaccgtatgtattatttgcttattgccctgacaatttctaatatcataatagttcattataatagcccattcctcagtgaatgaatagcacacttcatttgaactcattgatacaatgtatatttatcatcagctgtacaggtgtgtgtgtatacgtatacttttgaatgacaaaaggatacacacacacacacacacacacacacacacacacacgcacgcaattattaaccttctggagctgttcaccaagccttgcattaaacctggattgaataaaagactcccattcctcaaggaaattttacttcttctatgaggacttctcagtaaccctaaattcacaggcatattctttacatgttactgtcccaaagcaaaatgcaagctggcatggaaccaagcccagaggttaattcctgaagctagaggaaaaggttccaaagtgccctacatcccaaggtcgcccaacagatccacacctggaagcaatctccgccaagcgcctatttacaggcacaggtgtgtgcctatcgggacagctgaggaacacacctaatttgatagatgacattctgatgtggcaggctttattgtgctgtttatgacaatatctgcagattatgatgtgcttgtttaataaacagcgtaattaagcacacacaaaacaaaacaggaagttaatacctaagtggtgctgacgtgtttatgtaccacaactgactagtgtattctttactgcctattactccacttcttaatatccactgaaggaatcctcagtctgtatacacacatctccaagttatgaacatcaacttcatgcatatcctcagaaagacctacttacacctgcagcctcaccacatatatctacacccttaacaggcattcaataaatacttgtcaaatgatcagataaatgataaatgaaggagaaacataccaatatttatatcttcaagattgctcctatgggcatataattttacaggagttgctacttggattgtctatcttttcagtctacattttttctctaaaatataattggcagttgccttatggatagattaaatttgatagagcctggtacttgaggtgctatttcagcaccatttctgtaattctggaactagttatcaggcttggcagatgcaaatgtatgcagttttgatcttcttcccgactctctaactgcagattttacaactgaagaaagcaaggggaacttttatttataaataatcgatacaatttgtaaatagaaatcctttccctctgagcagctcacagccagccagctctcagatgaaggtacgtcagctctctcttgactaatggtgtggtctgcatcatggaggttaccagacattccttggcagaatgcaaatcaaacatcttgaatggcaaaaggatcaaagcacggcatctaaacattgctcagacctgctgttcatatttttatgcatcagaaaacttgaaagagaaattagaattgaaagataatgcacctgcaccttccaaagtgtataatattgagatttttagcatatttgtccctctgggattagtatattttattccattgtagggcagcagctgaacaggggtttgtggaggcagaagacttgagagcctcttggctcaactacctgtaagctgtttgaccttgtacaagtcatttaaactttctggcttcaacttccacatccataagtggaattaataatacctcatcaagtgatgagaatggaatagatattaaagcactgctcctcaaaatttaatgtgatacaagccaggtgtggtggctcacatctgtgatcccagctacttaggaggctgaggtgggaggatcatttgagctcaggagtttgtgaccagactcggcaaaatagcaagaccccatctcaaaaacaaataaagaaaaatgcatcgaaagtaaagaaaaaagaaaaaaataataattgaatacaaatgaccttaaaaaaagcagagtttaattcattggacctgcggtggtgcctgagagtctccatttccaataagctcccaagtggtactgctgctctgtggaccccactgtgtgtagcaaatatcagtggaaaacactgttattcttccaaatgatagtgaatttgtgtcctattgccatttttatttggtgcatgttttccctcagtatctacccaaccgtcaattactagatgcttgtctacggcaggtgatgtgcaggacatagatattttaaagtttacaaagacattgccctgtcctcaggaagctttcaatctatgtgagaatgaagatcacttaccactacaaacagtttggacatggaggaccaaagctacctaccccttatgctcacatagctggctgtcgacattaacatggtttacctttccattgtcttcattagcataactttcctattacagataactcttggccaggcaaataatttgactgttcactaaagtaacttccccaaactcccatcaactcttcaacaaaaaacatcaatagagttcacaccttaatagtctctgagcctcttggctagaaatcttcactgtgctgtttccaccaaactaagttgtaataccatgatccttacccaatcctaattgtgcccccacagtgaaagaccaatcttaaaccaagcttcatactcccaatgaaatccaacctcacctttctccttatgaaatactaccaaagctttgtccaggctgtggtctttcttaccatagtaagcaataaatttaactttgtcttatcaacaggttgtattggtgatgtttagggagctgaaatttcccatatggaagaaatagacatgggaatcaaacgtatgttacaaggagataagcagtggtgccaaggggtggattaaaagactctagctccttttttgtcataacaaataaacatccaatttaattataatcagtacattttttctctgcaaacttagtttaacaacaagtcccctattctcctcttatttactcacccaggcatttggatgttatcactggtgccatcattgattgtgataaaatatttgataagttttatgtcctcaatgcttcattaacagtataatacatgagagtgacattaaccaagattaagggagaaggggaaatcttttggtggttgtgatgtcaaacctaaaactacatggaggcccagaattagggaaaattcagcatccagacagacaatgtaagatcacggtattttcagggaaaaacatgaaccggagcaaaagctcaaaatggggaaagagcgagagagaaactaagggtctaaacagtcttttatgtcaagttaagtggcttatgtctttgctacccaaagtatggtctgcaggccaaaatcattgctataaccctgagcacttgctagaaatgcagaatctcagacaataccccagacctactgaatcagcatcagttaattaagaaaatccccaggtgattctgatgcacatcaaagtttgagaagcactattcaaaataatatgctggaggctacgggaagctactgaaggattttaagaagggaagtgacataattgaatttgcattttagaaaaaaaattactctgtgtccattcattccttcaggatatatatgccaagcattgaccttagagctggaaattcagcactattttgagtggattagctgaaactccctattcagtattcattcaatgaacatttattgcattccaactttggttttttttttttttgtttgcgtgtttgttttttgcttttttgaagacagggtctcactctgtcatgtgggctggagtgcagtggcatgatcccggctcactgcaacctctgcctcccgagttcaagtgattctcgtgcctcaggctcctgagtagctgggattacaagcatgcaccacaaaagccagctaatttttgtatttttagtagagatgggggttttaccacgttggccaggctggtctcgaactcctgacctcaggtgatccgcctgcctcagcatcccaaagtgctgagattacaggcatgaaccaccatgccccacctgcttgcaaactttcatttgacttttccaaaagcttgatttggaaataatcccacactgatggctatgtttttaatggagtcaacctttgttgtccaggacaaataactgttaagaatcttctagcatactgtactcaaagtccttagcactatcaggctgttggctcaaacatgaaaggtttttttgatgtagttttgtagaattgttattgcaatggtatttgctgtattggaatttgacccacagtacaagttatagtacaagataccaatcaatattgttttttgttaatgaacaacataagatgtacagcttgccaaatctaaactttaatattagagattataggatcagtaccattttttgctaacctatgcagaggattgtcctttggtgactgaaaaggaaaacaataaattcctacttatgtggagtctctgtctttttaataatagtcagtgtcttattggaactcacaaagacttggtgtgaagagctctgacaagctagttagcctattttatgcttgttttattcttgcttcctatatgcaaacatagtgaaggacagcgggcaatgagctcgcacttctattttagcgattctgggttactcgggctgcctctaatctaccaagccaggattattataaggaaaataaccaatgtagctaaagataaagtcatcacttccctaactcaattcctttgtagctgcaggaacactaaatttcattcagaattctaactcccaaaaagctgggtaatctaagacccttaatggttttcttatagcctcatagggtttggcaggtgccctggacatctggcagattccctgagagaacaaaaactcagaagctaccaaagattgaaatactcccttcaatacccaccaactaggggagcttatacaagaccgtgggtttctttctactttgttcttttatttacataatagcaatgataatatctttgttgtagaattactcggaggattaaatacaagaaaatatttacagtacctagcacttaataaactctcaatatatattaattttccccactcccttctgggttactaagacccctataaaatgcaaatttatttacatcacagtagtcactaatatttttgaaaagttgagttaattgaattaggaagcctgttataaagaataagccctgagtaaagaggatgtgtattatgttctctaaggtatgtgaagtgtgtgaaaagaaggtccaaaaaaggagggcttgcttgagatgactgatatccaagaagatagtacaccctagctgtcagaaccattgactttaagggctgaagatatcataaaactatccattttgcagatgaggacactgaggctaagttcggtgaaataacttgcctaggccttagagttagaacactagcaaggcaggattgaaacctagtgaatgagaggcttcaaaaagaaagaaaacaatgtggacacagggaaaaggtgagggagagcattaggacaaatacctaatgcatgtggggcttaaaacctagatgacgggttgatgggtgcagcaaaccaccgtggcaaatgtatacctatgtaacaaacctgtacattctgcacgtgtatcccagaacttaaagtataataataaaaaagaaagaaggaaaacaatgtgaagaatgaaagcaggatagggaaggagggagcgctacagctcagggtgaagtcttgtatcccctttgcctctgtccccttagtagtaaatatttctcggggtgaatcagtaacatccctcagcctctcatacagaagtgccagagtgtgatctggctattctgccattaaacattcaagatcctctacaaccatgaacatagaagaatgatttatccttatgttcttgctgtatcaaagactctcagagattttcagagacatgccttttccatactgatcaatgaagatgggtcaccagaaacatcgtagtcaaagtgacagtttttgtactgccttcccagataattttacagactgacatgaatttgaagcaacaagcttttttttttttttttttttttttttgaggcggagttttgctcttgttgcccaggctggaatgcaatggcacaatcttggctcaattctcctgcctcagcctcccaagtacctgggattacaggcatgtgccacaacgcccagctaactttttttttttttgtatttttagtagagatgggggttcaccaagttgatcaggctggtctcaaactcctgacctcaagtgttccacccacctcagactcccaaagtgctgggattacaggcatgcaacaagcatttttatgaagaccctgcctgaatagccattcattccaaggggacttgaatttgaataatacctccacacagatgactctcaaatctgcatctctagcacatacttcttccctgaatcccatactttcatccaactgcactctttgtgactttactgggatgtctaacaagatttcaaacctaacaattccaaaacaaaattattgcttccacctttacccctctaccatctaacttgatccttctaccattttctcaattctattcaccttatccaccttggactcatcctgggctcttctctttctttcccaccccataccccattcatcagcaaacctggtagtgctaccttccaaaaatacccagaatccatgtacctctcattgttttcactgaaagcttcctggtttagaatcaccattatttctcatttgaattattgcaatgactccctctgcttcaataggtactcttactctctgttctccactccgtggctagaacaattcatctcctttctttccccaaatgagtttacttagaaaactcccttgaaaagacaaaatcatagagatggagaacagattaggggttgctagtgattcaggaagtagaatgggagattggatgggtgtgacaattaaagggtggcttgagatagttcctttgtgacgctggaactattcagtaccatgtatcaaaataggggtagttgttatatgactctaaacatggtataaaattgcatagaatgacagacacagataagtgcatgtaaaagctggtgagatctgaataaggcatagattgtgttaatatcaatttcctggtttttatattgtgcatagctatgtaagatgtgagatctgaataaagcatagattgtatcaacatcaatttcctggtttcctggctttgatattacatataattatgtaagatgtaaccattagctgaagatgagtgaagggtactcatgatctttcttaatacttttgcaacttcctgtaagtgtatatgtatttcaaaataacaagtttgaaaaatactgcatatacacggcattcctcaagactacggattttctgtttcttctacctggaatgctctttccccaaatatgtaaatggataatttctccccttccttgagatttctgttcaaatgtcacctcatagaggtctgcccagagtgtcatacataaaatatcaattttggctcggcacaatggaccatgtctgtaatttcagcactttaggggtggaggcaagcagatcgcttgagcgcaggagttaagaccagtggtactgaggtagtgaggtactgctataaagatacttgaaaatgtggaagcaactttagaactgggtaataggcaggggttggaacagttaggaggctcagaagaagacaggaaaatgtggaaaagtttggaacttcctagagacttgttgaatggttttgaccaaaatgctgatagtgatacgaacactgaagtccaggcagaggtggtctcagatggagatgaagaacttattggtaactggagtaaaggtcattcttgctatgactaacaaagagactggcatcattttgaccctgacctagagatctgtggaactttgaacttgagagatgatttaaggtatctgacagaagaaatttctaagcagcaaagcattcaagaggtcacagagcataaaagtttgaaaaatttgcaacctgacaatgcagtagaaaagaaaaacccattttctggagaggctggctgtagaaatttgcatatttaacaaggagcccaatgttaataggcaagacaatggggaaaatgtctccagggcaagtcagagaccttcattgcggctcctcccatcacagacccagaggtctaggaggcaaaaatggtttcgtggaccaggtcccccccccaaccccaccactgtgtgcggcatcaggacttggtgccttgtgtcccagccactccagccatggataaaaggggccaaggtacagttcggaccattgcttcagagggagcaagtcccaagctttggcaactgccacgtggtgttgagtctgtggatacacagaattcaagaattgaagtttgggaacctctgcctagatttcagaggatgtatggaaactcctggatgtccaggcagaagtctgctgcaggaatgaagacctcatggagaacctcggctaggacagtgtggaagggaaatgtggggttggagccccaacacagagtccccactggggcactgcctagcggagctatgagaagagggccactgtccaccagaccccacaatggtagagcgatcaacagcttgcaccacgtgcctggaaaagctgcagacactcaatgccagcctgtaaaagcagccaggagaggggctctaccctgcaaacccacaggggtggagcttaccaagaccatgggaacccacctcttgcatcagtgttacctggatgtgagaaatggagtcaaaggagacaacttcagagctgtaagatttgactgccctgatagattttggactggcttggggcctgtagccccttcattttggctaatttctcccatttgtaatgggtatatttacccagtgcctgtgcttccattttatctaggaagtaactaacttgcttttgattttacaggctcacaggcagaacagacttgccttgtctcagatgagactttggacttggacttttgggttaatgctgaaatgaattaatactttggagtactgttgtcaaggcatgattggttttgaaatgtgaaagggacatgagatttgggaggggccaggagcaaaatgatatgtttgggctttgtgtccccacccaaatctcatcttgaattgtaatccttataatccccataatccccaggtgtcaaaggagaggctatgtggaggtaattgaatcatggggttggcttcccccatgctgttctcatgatagtgagtgaattctcccaaaatctgatggttttataagggtctcttccccctttcctcagtacttctccttcctgccaccttgtgaagaaggtgcctcgcttccccttcattttctgccatgattttaagtttcctgaggcctccccagccatattgaactgtgagtcaattaaacctctttcctttataaattacccaatctcgggcagttctttctagcggtatgaaaacgggctaatacactccctctcttgagatttctgttcaaatatcacatcaaagaggtctgcccagactgccatatataaaacatcaatttcggctgggcatggtggttcatgcctgtaattccagcaccttaggaggtagatgtgggtggactgcttgagccccggagttcaagaacagcctgggcaacacagtgagactctgtctctataagaaaagaaaacgtgttagctgggtatcgtggtacatgcctgtagacctggctacttgggaggctgatgtgggaggatcatctgagcccagggaggtcaaggctgcagtgagccatgatcacgtcactgcacaccagcttaggcaacagaatgagaccctgtctcaaaaaatatatataaataaaaaataaaacatcatgttcctgtcactttttccctatcttgttagtttctcttttcttcttaacactttaatacttccatttgaaataccacatatttattttctcctttcctaacttcccattactatatgagctccttgaaaggacagcgtttgtctgtttttggttatccttgtgcctatattagtatgtggcacacaatagtcactctacaaatatttgatgaattaataaatgagtgaacaggtaaagctagtagaaggaacagtcatgcagattggcttaataggaaatacaagtctgacaaaatcacattccttggcagtacttaaaaaaactgggaaggaaaaagaaaacttgctcctgctgcttctgtgatacaaagaaaaacctcattattagcagtttttttaaataataaagttgagcattaccatgtagaatggtattatggacagaacacaccacatatgtataaaaataagtaacttccctgggaagaatcaatacagatagtccctagattacaaatgagttgtgttctgcacatttgaaagacagctgcttaatgatctgctcgatgctctctaaattttctgaccgggttcacttcacccctacctgtgcattcagtcatactctattccctggaatcaccaaacctgtacctaacagaggaattcaatgtggttacatttcataggttagtccacaaaataatagttcacttataaacgagctgaagtatagtgtaaataatgctggttttaactctgcacgttgtaagtaattcaaatgcttagagttgtatcacatttaatggtatatttacctgagaaaggcaatattaaacgtgcaaggaaatgtgggccttgaagtcaagtacactttgaaatcaaactgtcactctgatgctacctttgtgatgttggtccagtttcttaacttcttgaagccttaatttcctcaactgtgacttggagatgatcattgagactacccaccaggattgttttaggattaaaggagataagtcttcagcacagacttagtgttccataacattacatcttattatattgagcacttccagttagtctgagttacaaatgatattttacacatcatcgtaaaccaacggtctaacaacgtccctgatacacggttaatgctaaatatgtgaggtgaatgaatatttaacaagtacattgattcacatactggagagggatgaataggcatgaaggacaggcacgaaggcctttaatgtttgtgagcctatccatctatgatgttttccttttaccttcctcccattaccttctaattctctactcacaggtttgctaaaagatctctcttccaccaccactccttgtccccacagtgggaggagcatgagggaaattcaaaaataaataccacttatgtagcattttttggttggaattttagggtcaatatttagttttaaaatgtgttaaatgtacattttcattaaaaagaaaagaaaacatgatttatacaagataagcatgacttcttcactgctgcatctttttgaccttagtttatagaatctcaactgcagcctggggcctgccccatctctgaagaccgtgctgcccaaaggatgaggatatgaagtaccctgttaaagtaattcattggcatgactgcttggtttgtcctggattaatcatctctctcaaggagattttagcccatcggcccattcctgtgcaagatgcctaacctgattcctaggctcccaagctagaatgaagatactagctacaagtcctccccaatgctagactaacatacaattttgatctctggaattctagtcaatgatcctaccaatgtgagctctacctcttcatggcccctaaacgctgatatctgctttcagccttaccatataatgctcttatgctcttcctcttgaaacacatgttaagaatgacccatcttccctttggaagagtttaagcagttttcataatctctttaaaaaaatttgactggcatcaaatcaagctctgaccaatgacagttataaaaaaaaaaaaaaaaaaaccaacaaaaaaactaaattccctcagagaaaacaggaaagtatgggagcaactttaagaaaacacttggaataataacaaactgttacttaatatttaacctatcttttccccgaagggctcaagctgattattttcttgcttttgacggctagtgaaaataattggttcctctcttctttgtcacctccttgaactattaagttttcccttgatgttttctcatgcatgaatatgccagtaccacttacacaggtcttgtaaacaagtttcaaaagctattagacccacataaattacacaaaatatgtttcagtccctaccaaatttcctaaagccatagttcgtctgtccacatcaacccactcccttcttttattatccctgctttagctaccttgtcactcaaataaactgtgtaattcacacctgctttgagctgattggttgatctgtccttgattgtcccaggtggatttattctcccttaagcttcaggtaggaatcctgcaggttcatacctggagaaggagataaacctatgccttaaatgcaatgttcattaatggataaattcataactggcaatggtaccaagagttacagcatcttcctctattaaaagcagagcagcctatgggatggccaagtccttgaaggtgacagggatttgacaaaaatggagggtatgaatgggctatattatagttaatgatttgaaatcattgtttagaaataattgcctagacaagataagttaactgatctctacaaacttgcattatatatatttctcatcactatgcataatttttattatagatttgtcccttgaggtccagaagcacaaagcattctcatagtcccccaacaggcatctttctttaagagacaaagcaaggcaataaaaggggggtattttatttatcgcccaattcacagcatttctgtcttgactctgagaagtgtaaattcataacaggaggtttctagacatacatatagaaggtgatgctggtgatccaaaaaatattgacaattgataaagaaatgctgaaggaggtgtcactattactagaagtaaaagttttaacaataacaataaatgaggcctctttctgtgtccatctgtccacaatcccatgccatctaccccttctctagagttgccatggaagagaaagttccactacttcagttacgtcatttctatttggaggaaagatgggggtcattttttctaattgaagagtgttgtgacatttttttcctcgcattgtttcatttcatttcgacttatcttttttcccacttataatgtgcatattattttttgacatcaagataatgacaataaagaaaaaaaactcactgtcttctcaattttaaaagaaaaaatagcaaggaaaaatgatcagctaaaggatttaattttaatgttgtgataagctatttttctaaatgattttccacataatctgtgctttagcaaagatcttctcttttttttctagtttccatctgagattagataatgggctgtatcccattatgtgcatgctgtaactccaccacacctgttacttttgacatatttttatatttctcaataattaaaaaagaaagagtgggccaggtgtggtggctcatgcctgtaatcccagcactttgggaggctgaggtggatggatcatctgaggtcaggagttcgagaccagcctgaccaacatggtgaaaccccgtttctaccaaaaatacaaaaaattaactgggaggggtggtgcacacctgtaatcccagctattcaggaggctgaggcaggagaatcgcttgaatctgggaggcagaggttgaagtgagtcgagattgtaccattgtactccaacccgggcaacagagcgaaactccatctcaaataataataataataattattattattattactataagaataaatggtagcttatttttacctaaacgtagtagtggcttcatgccacagttgctaatctctgagccatctcactatcctttgttcagcttgttaaatgtctctatactttcgtaactagttcctcatagtaaattccttcttccagaccagtgtttcccaacctcaccacaactgacattttggacagaataattctttgttgtaagagactttcctgtgtcctgtacagtgtctaccaatatctctgtctctaccaaatgaataccagtaacactcctgcaattgtcacaaccaaaaatgtctccagaaattgccaatttatccctcagcgtgcagcagaatcacccctggctgagaaccactgtattagactagaagatctttacttttctgactgactcctaagtgatatactcctttcaagcgcatatttatacctgttatatgtaaaaataagattggaataaaataacatctatctatctgtgtccctataaaattagtcatactgtggtgatatctacatctctataaaactagtaatattggtaaacaataaaagcttattcagcaaatgaatatattgatatgaaaagatctgcaaaaccttgatctactttttccaaaattaatacatattttattttgtccagctaatatttaatatatttttatttaattagccatcatagggcctttgaaatagttcatacattatgatgccttatatactaaagtgagtaaaattaaacatctgttaatacggctgacacagaaaaacacagtcagataggcagttttagagaggagaaatatacaataatagttcttctttttcccacctcacattatgaacagggaagtttttccttagcactaacatctcagcaatacgtaaagatatcacatcccttattttgtatttattaatccttcttttaatgcttctgttgctaattttttaattgactttgtccttaccgaatactagtgataggatttataaaggatgattaagtcatggactaatttaaactttgttgaactcatataacagtgagtttcaatgaaatcacactaagaattctctgtaatgctttgttccagctataagaaaacaatacccaatttcatctaagagatgaaaaataaagaaagtatgtgaagataatcatattcaatagttattatattatgataatttgcatatgtagacatccttgaaatgtacatagacctttattcaagatctttcccatacatttcagaattcgtttttatcattcatacatttgataaacatattttaagtgtaatatttatcttatcaacatgtaatgcatacttaacaatgtgtaatattgatcttatcaatgctactctaccaaaattaaaagtagatcattaaagaaaaaaatcaaattcctcttaatgtcatagaaaaacattcttctctattaagataaaggacaacttaataaatctaatattttcatagctcatataaagaaatatagataggattagacaaatagaaggaacaaatgaaagcccagtagattaccagtgttttgagccttaatttaggaagttatcaaatatgtacttattcatttcagggaattgtatggtttcagaaataagaaaagcgacaacaaaacggtcaaatttgcctgaatgattggtcagctttgttcattctaaacttaataatcctttactaattcagcaaagtcttataaaaaatttatcaggtcattgttcataatgatatgagcaaaaaggaaatggaaatagataacaggtcatatgatggatttcattcaaatgttataaggcattttgtgttaaatatttgtcattcatattacatagaaatataatttatgtagaggaatgtaataaacattactctttttaaaaacatcagtttccgaatatgccacagaatcttaatttgattgaaatgccctccctctcccttctctcaacagtgagtcttattttgtgttcaatagcaactaaatgtttccagactgtgaagcctttctcaagtcccacaacgggagttatatctgtcacctatgatcccacagcaccctcttcatcctctattataaaatactaccattttagacttatactctatagtgttctgattttgcccatatgcctaactcacacatgagatcactaaggccagaaaccatatgttattcaattttctgtttatgtggccagttccttacaaccttgcttatataaagaggacattcacaacatgtttataaaattgaattcagctgaaaatttttaatgagtttgcactgagaaatgagataaaacttgaaggtatttgcatgataactgaaaagctgtggatcaaatcaaagatcatagaggtatcttggaatacaccacagtttggaggtatcagaatgatctggctaagtatttgttgcagtataggattttgttttaaggacattaactgctcaattaaaaaaaaattggactcaattttattttcagcttgtgatacctgattttggtgtgtgtgtgtgtgtgtgtgtgtgtgtgtgtgtgtgtgtatgtgtgtacttttacattttcagcagcatgtggcaggtggctttttagggtacactattcctgtgacctgttgacgtgacaaagaggtcgttggagaaaaaaatcactcctcatgagtacagtagtatcccaagagaggcagatcacactcacacatgacataagaatcaagttttactgaaaaatcatagaggtgtttttagtaaagcaattaagaaaataatctttttcttatatatttctgatgcttcctaaaaattattattatgattatgattattattgagacggagtctagctctgtcaccaggctggagtgcagtggcgcgatctcggctcactgcaacctccgcctcccaggttcaagtgattctcctgcctcagcctcccgagtagctgggattacaggcatgcgctgccatgcacggctaatttttgtatttttagtagagacggagtttcaccgtgttagccaggatggtctcgatttcctgacctcatgatctgcccacctcggcctcccaaagtgctgggattacaggtgtgagccaccgcaaccagcctcctaaaaattatcttataaataagactaatcaattaaaatattttaaagatatttttcttctaactatacttccaaatatttatatgtatgctttaggaaattgagtttttaagtgaaatattaaagacatctcattttcctgttacctgattactgttcattcaacctgttgctgtattgttccatttttatatgatataccataagaggctatgtgtgaataaggcaatatacatgatgcagcattactttgtattcacattttcaaggtgtatagaaaatttttaaaaagatgttaaaaaggtaaataagttcattgttaattgttatagaaagagtagacaagagagaagactgagtctacatttcggcaaaaagtcttcataaaaattagaaaattggtgagtaagtcaatgaagcattgtcaaagtcacaaacaaaaggtgactccacattattataattcccctgtcagaaagtagacatggcaaacttatgacttcaacctctgaaaatgaggatcacagaggagaaataagactggacaacaggcttccagctgtgtttctaacaagtataattacactggttggacattatcattaactacatttctaattcttctcataattcaaaaagtgagagagaaaaaggaagggataactctttttggtgttatagtacctcattgtaggtttccaaaaacaagtgactcctgacaacaactgttagctctgaagtgagagtctgcaaactgcagccctcaagccgtaactagcccattgccatttttgtaaataaagttttattggatcacaatgacacatcttcatttctctattgtctatgactgcttcaacattctaacagcagagttgaatagttgcaacagagtatagaaaacaaagcctaaaatatttactctctggccctttacgtttacattacagaaaacacttgctaacccctactataaaacaatgttgtctttggaagctatggtaaattaaaaacagaataaaactattgctcacgtatattttattttcaaagtaaaattacttttttccccttctatagatattttttttttttcctggaaggagcttccaatttcaagcaagaacagaagcagaagcactccaataagtgtgcttggttacatgaataacttgtgatggtttggatatacttcctggcaacacgcaatgttagaaacctagaaatatgtctgcctggtacttttaaggggaatatatagagagcctcttttgaaactttgaaaagatttattttctattctggagacattttagtatggagagttgaaggttgcataaaaatacagcaactaagatagttggaatagttattctctagggaaacatttggccctaagacaagacatgttggaaacacataaacaagcaaataaaattggcaaatgtaagttttgattcatatatgctcgtgaaactatattcttaatgctattgagaggtgaggccagctggactttctgggtcgagtggggacttggggaacttttctgtcttacaagaggattgtaaaacgcaccaatcaggaaccttcccgtcttacaagaggattgtaaaacgcaccaatcagcgctctgtaaaatgcaccaatcagtaggattctaaaagtagccaatcgtggggaggattgaaaaaagggcactctgataggacagaaatggaacatgggaggggacagtaagggaataaaagctggccacccaagccagcagcggcaacctgcttgggtccccttccacgttgtggaagctttgttcttttgctcttcacaataaatcttgctgctgctcgctgtttgggttcgtgccacctttaagagctgtaacagtcaccgcagaggtccgtggcttcgttcttgaagtcagcgagaccacgaacccaccggcgggaaccaactctggacacactatgaccttaagtaagtctgtcttcatggatcctagatatttcctagcctttgtatcttccttaaaggttaccttcaggtgcttttgaagttgttatgaccacatgtacagtccttaccttttgtacatgaaactcaacttttgattcctattttatgtttccattagatggctacgtatgtaaacaaaaaaagtttttgtgacactcaggcattactacggagggaggtgaacgttcattaagacatttatctcaaatattgcatccagaagaatgacactaagaataaactcaattgaagtatgagataatgtgcttcaaagactaagggactaaataactcatcctcttcctaattaccttatagataccttagttctctttatccttctccaacatacaaagctagttcatttttaaggtctttgcataagctgtcccttgtgcccggaatgctttgcccctacatcattacatggctgactctagtttgtccatcagttcttcttcaaaatcaccttccaagtgaggtattgaagactttttcaagatttttctcttttttattaattctgtgcataatatttcccactttctaaattgttttcctttctcagtttgtatcctatccctgcttactaaaattacagtttcatgagcacacgggacctatgcttccttgtacgtagtgtgcaggatattacttggaatatagtgggcacccaatatattaatgaatacaatcattgtagaaagttaaatccacagtggtccagatgtggtgttaagcatgaacctaaatcttctaccttcaaggtgctcctaatatggttgggttgatgatcacatacaaatcagataattataccacttgaggaacattaggtttacaaactaagcattattatatcattttattaaaatgtattcatatcagtaaagtggggacggtggagtcaaggaagaagtattgtaggtgacattttagctgagtatagaaagggaggttagggatgaagcaccaggcaaatgcttgtcacaagtgaccttgtgagtcacttgtgacatgaagtgagtcacttgtgacatgaagctgtataacgtgcttagaggaagacatacagttcatcacggtcacctttcgtcctgacatccacattcatttctctgactacccaacccctcacttggatttttcaaaggtatctcaaaattaacacatccaaaatacgtttactctctttctctgcaactcttttcctctccccttatgcatttaaccattcattattttatccaatacgtacttactgatcacttattattttcccatttcaaaagaaatggcagtgttatctccagaggtgtatgacatcagaaactgggaatgatatatgacactttcctcaaattcaactctgcaatcgttcaacttaacactaacccccgtcaattacgtctcctgtatttttctcaggtttgttgtcacattctcactagaactattttagtcaagaccaccatcgcttcttgccaagattacaataataacctcttttgtccattcagatttgcttctctctgaaccattctccacacttcagcgaaagaagtctctgaatcaaagctctaatcatgactctttcctgacaaccacgtgacaaagcccttctgggcagagaaaaaactcccaacaggacccgaaggaccctccaggttctagccccatctcctctttagcttggtctcttgaacatctttcttccaaacataatctgctgtcacattctttctgttcctttatctctgacactctcaggcttagctctttaaatgtggtactctgcatagaaaaatttccaccaccttcacggtagttttgtgtggccaagtctatatcacttcttcacagaagcttttggtgacccagatactaattcaaatttctaactcggacaccagtggttcccctttctctctctctctcaatctctctctctctctctcagaatctcatgagattcatcatggttgattacttgcataaagtctgacatccctgctgggattatgtctgtcatgttcacttctgtatgctcagcatctagttataattaataataataatactaattactgagggagctaaatacttatttgttggatgagtgattgtggtaaaaatgaaaatgaaatgatgtaaaatagtggaatgataaaacagagtgttgaaaatgttgatgagagccagattataaatgctttgagaaatatttcagaggctgtgctgacaggattttggtagagatttgggcaataaagagccagaatggatagggatatatgataactgcagggtttttcagagaaagtgaattataaatccatcagtcaatataagaaatgcagaaagaaaaacaatgttgcggatgttagaaaggattgagagattctgaagtgatgggatgttcaggaaatcgaagttaagatatctagtaggcaagcagaaacctaccttatggccagaacattctctgacccaaaagtctcaagaccattttttttttttttacaactaatgtcaataaactacttttcatgtacactagaaatgatagtgtgaaatatattaatgaggttaactattgttaaaaatcagaatatgcattcctaatatgtgtttgtaaaataaattttattgtatatatttaagggataccacataatggtgtaagatgcatagatatttatatatatagtgtaaaatagttaccattgtggagaacattatcatatctatcatttcacagttacccatttttcactctgtggcaagaacagctataatctattcatttatcaaaaatcttgaatacacactattattaactgtagtcctcatgatgtatattatatcttttaatatattaatatattttaatcatttgtatcctatgacctacattgccccatttcctcacaactaccctgaccctggtaaccactgtttaattcactatctgtatatatttgaccttttttaaaaaaagattccatatataagtgagatcatacaatatttttctttcttggtctggcttatttcatttagcataaggtcctccaggtccatccatgttgggacaaatgacagatcttcttctttttaaggctgaaaaatattccagggggtgtgtgtgtgtgtgtgtgtgtgtgtgtgtgtgtacacacgattcttggaccatatttctttgtaaactgttttctacatattcttagcccttccatagaaaccccagattctctctctctctctctctctctctctctctctctctctctccctctcctcctgctcctcctcctcctgcctacatctctctctcccttcctcttaaagtaactctaaaatataattttaaatattcttattttgtctggtgccagactgttttggacactagccataaaatatttttagctgtgttcatttaagctaccatacaagccaggcgctacatctacagaacacctttctttttactttgtaagttcttttataatattggatgtggtgatgagataaagaaaagagtgaggtataatggtcttcctaggtatcagaattttctttttgagaaactgtttttcttcctttagtaacgaaaacaagagccaacataatgatctgagttctgataatgagtgtgttttggcacaaactgtcacatgaatcaaaggtaacttgaacatgtataaattaacattccacagccagaaaatatttagattcactaaatctgttactctaagcaaaattcaggagttaagtcaatgatagatggccattttggtgtctggatcttaggagaaaataggaccataagaaataaacactgtccttacaaagaaataaacttttgtcctggagttaaatggtaaaaaggacgccccctcaggggagcataccttgataatattgatcatccaaataggatgatatggtttggctgtgtccccatccaaatctcatcttgaattgtagctcccataatccccatgtgtcatgggagtgacctggtgggaggtaattgaatcacggggatggttctgtgctgagggagctaaatacttgtgctgtccttatggcagtgaataagtctcaggagatctgatggttttataaagggcaattttcctgcacacgctcttgcctgccaccatgtaagccatgcctttgctaccccttcaccttccaccatgattgtgaggcctccctagtcatgtgagactgtgagtccattaagcctctttttacttataaattacccagtcttgggtatttcttcatagcagtaggaaaatgaactaatacataggattattgagaaatatacatcaaatataaaatgtgatttttaatgattttttctcgattgatgtctgatggagactaagtgcttaatatgaaaacagaactcatggtgttttcttctgcggaaagcaagttagtgtagtccaggcttgtaacttgctggtataagaaaagatcctagactttccaaagggaaaaatggacagaaggttacatcgtagggtcagcagtttcttagatgtggtcatctggttatagtattactctgaaatattacctccttctaggtttttgataggagtgggattgcagacaatttgaagctctactttatgatgaaagcctggtgagctctaattgagaaatacagacctggtttggatactaaatgagtaggtgtttattaacacactgttaggaaaattgagaattctggcaggttttagtgctcaaagtaaaacctttcccatttacagagagaggtgggcttggagagacccttcagaatgagttgggaccttcctgaagaaggagctctggatccgttcaagcatcactgtgacttctgagagacacgtctctattagtccattttcatactgctataaagaactgcctgagactgggtaatttataaaagaaagaggtttaattgacacacagttcagcatggctggggaggcctcaggaaacttaccatcgtggcataaggtgagaaggagcaagccaccttcttcacaggtggcaggaagaagtgcccagtgaagcaggaagagccccttataaaacaatcagatcttgtgagaactcactcactatcaggagaacagcatgggagaaattgctcccatgattcagttacctccacctggtctctctcccttgacatgtggggattgtggggattacaattcaaaatgagatttgggtggggacacaaagccaaaccataggatccatcaaatcccaggatgatggttctccatccccacaatgtgtgcaatattttaggagtcttttgttactcataatagctaaagtacagatctttgcaagtagtttcatcttccacgagtgaaagcagattcaaacaaaaacattactctcacctgcatcatacgttttcgagagtgagcagtgtgctggaaattgccccaacccatgctgttttatgtaagccatagtccttagaatgtaggtactcagagaagagcaggtacttttttgtgctaggaagaaacatggccaagcaatactgctatctgacgaggaagctgttgttctttaacctggaccattttcagagtaggcattttaaaagctgcctgatgagaactttttgaaactgtagcagagcttccatggatattctgattggatatatcattgcttcctgctcagcttgctaagataacttgaaaacagaaaatccttttgtctggagtaggtatttaattaaccaaatgttaagtattgtgtattttttcagttgcttaagtggaaagacattattacctgaatatagtttttttatgaacaacccagaatattaccgggttaaaggtcattggtttattacttaacctaaaaataattgctttgacatatatggaatattgtatatctcattattttttgataacttcagaagagctaatataatcggaggcagatctacagtggaatagggaattcagaatttatattctaacagaaaaggatacagtaatatgacaaggaaattcctaaaaatatagtatattttccatgtgaaaacatatttccagaccaatttcaaaagaatgatagcttagattcctctctgctgcagtaagctatatcccccacttgaaatacatcccacctttcctataattacctcttccaccagaattgcaattatacatttcttttaatcttttacttttcaaaaataatggaaatttaaattgggaattaagttgcatttaatttccagtttcgcattttaatctttgaaaatagcctagccacaggcaaggtgcagctgaaagcttcaatgacagcacacctaaaatgggaggcctgtcagatttgacatatgaagtggtggtttggcttccagcaaagctttgtccattatgctccctctcttgttcacctctccctctagcttttcttccactgtcagagagctgaaatgcgaataattctactccaggaaacatatttcacataatttctataacaccaaatgaaaagcctttagactatattatcatagaagctagtccttatttaacaccagattttattggatatgtaattttatatacatattgtattacatacctctacctaaatacagaaatactttacagccttattatgtgtaataaaaaaatctaacatcttctcaagccacattgcagatggtagtattatctggatggtgcctcatgaacaaacttcaaaaggaaatgttgatgtgagaagattcctatggttctggtaagactctacatccccctccccccaggtctgtggaataatgtataggcatataaacagtacatacatggcatcaattgttataaccatatatatgtgtgtgcgtgtttaaattgtattaataagatttttttatacactcagcacctaacagtgtctaacacattttatatcttccaataaatgaatgaagcaaatgaaaacatcagtaaacagaaaaaaacaggcattttattcagtttactttaatttgagtggtgtttggttgtaatatctgacaaaagttagtgctatttaatggtttaaaataatttaatgtgtagttttcccctttaagttttgccctgtatcttttgctatggtctgtcagctataatttgttcaatcttttgtgtagctttcttcccagtcttacaagtctaattggggaaagtaagggaattaacaatgatcaaaagtctattctttttctaaacattcacatatctttgaatctctacaggaatcctggaaaagaggatcattttgcagaaaaaaaacataggctagagtttctgaacaccttgtcccaaaggtacagccagagtttgaatccaagtcagtctaattccaaacatagatcttttcctcaaaccataacattttcaagaactgtattttatcatttcttatgatccctgccaacttactcacaatattatcagtagcctagacattcactaaatgccaactgtgaacaagtgaagcctttaagacttggatggtgttgaagttccctggtgtgatatttcagtttactcagtacccacctgaatgaatgctttgaagaaaataaacaagtgaagcttaatcagctaagtaaatgtttggataaaaaaatgaagcttgtttaaataagggaaagcccttattcttctctgatctactcatttaagtcaaacaattaccataaagctaattctcaaaattatgttttctttaattattgaattgggttagtactgtcctttgacccattagtccaaatacacacatgcacagctacacaaatatatatatatatataaatatatatatatatatatgtatgtatacatagagagaatctaaaaaatactctaactgacaagatggagatgacactaatttatgcatatatcagggcaatttcaatttctgcattttaatagcttatctctgatatttgcaaactaagagcttcatttacagactgtacttgtatcatgagttcccaaactacaactacaaatgtttaaatatctttttaaactgagtgtgcatgaatgttttttatcagaagcattatttaaaataattactattatcttttaagtagcatcaggctgttggaatttgctaggaactaccaacaaataccttctcttaaagatactgatcagggaactccaaacattcttgcttctgtatcccctaaaaagactcttgaaaaatgagtcaacccttgcagatttaaaatccgcattcgaaatgtacttttcattcttaaatgactgaaaataatataatttgagggacattgtaaatatcgatatcttaaaactaagatatatgtttatgcctgaaaaaatcttattgatcacctagtatacttttcttaaacagtatgtatacacaatgagtgttttttttctgttactgtaagtcctaaatgtaaaaaacaaaccttttcaattgaggtattgttacaattattaacgtgcaattgaccaaaacaatatatgtatattataaaatttgataaacataaaaataaaattttattgaaaatacatctcttaataagatggatgggtatttaacaatttatacaccttcagaagaatataaattaattctacaattggaaaggcttcagcatcaattctatccctaatttttgtctgtatagatgtaaatgatgaaaaatcttattcaaataggtgagtagaaagaaacggaaggaattgtattatagtagcattgcttaatcatttgtgctcctgctatggcatatgctaaaagtacatgatgattgcttaccaaaacgtatttttaatgatctatcggctgacaacttatcaggtcttctcttcgggttcagttgaaagcaaagagttagcaaccactcttcttgcaaaaagctatgttgccctgtcatgaaagtcattcatgcttcttttgtttgaagccttagtaagatcagagttggatgaaatataaggctttttttcttaaattgggagaagtggttagaaaaggcaagtggttagaaaggagaaacagcctgaggtcttgactacagatgtcttttttttttttttttttttttcaggcaattcagttttcaggaagagtacaaaataaagtagaagatctagaaataaattcccttaaaactatctgtgcctactccttggaatgccttcatgtactcccaggttactccactgtgaggacagctgttttaagaaatttcgaatcattacctgtgacaagaaatataaactggcacatcagaatctcctgataacttgtgtgtccacttcctcagttgtacctcacagctaaatagttatctgttaaaccaagagaagttgcagttctgggggcaatagccttattggtatttgtgcctgaatataattctgaactccctcttttctaccttctaggctttgagttcatttatttcagcagcaaaagatgtcaggagcaagaggcagtcccacatagtgtagattcattgaatgagggagccaaacagtgatttagaaacaacattgccagtaactatctgattagccttaggcaagtttctcaaccttcctgaatctgtttcttcacaataactcccagtctggctgcaccttcgactcacacaaagatctttaaagagatactgttgtccaagcatcgcccccaggaatatggatttgattctctgcttaattctaaagtgaaggcaaaacaggaaaagtcaaagttagaatcattatccatatagtctttcaaaaaatatataataagtgcctatcatgagcagtgttgcaagttttctgtgttaaaatatctacaaattatacttctaaagaaaaattgaatgctacttgaatacaataaatgatacatttgagcttatcagtcttgaaaatcctttgttcaaaaacgatgcaaagtagagagggcaatttagtctacaaaaacttttatttaaaaaaactgaataaatagcacagacacatccaaaaagtgtatagcatggaaaaattcaataatgtatagcacagagacacccccaaatttgtgttgtttatcatgttgcatcatggtcttaattccacatttcatgtagcagaatgtatcccttcattttgagatccagaaggacaaaagggttgcacagttcccctttttctgcctctcggagatcttaaaaatgaatgataaacaattaattctacccaggataccaatgaaaatctattttcttttctttttcccaaacaaaaacctcagaaggcaagtaaactgaccttttaaatgaacaagatctgacatgattgagctaacccaagaaagaaaattcccctctgaagtgaataattttttaattaaaaggtgaaatctgacacatcacactggttttgttattattgttgttttcttccattaatctcacactcgtaagaaaaaaaatgagtgtattatatatgactgtgttttatagatgcatatattctactctatccatttcagtccatcttttcttaatgcatttgtcctgtcacttttactcactgtaattcaattttgttaggaaatgtaactcgctgttttatgctttatatatttcacctgatgcaaaatggactacctgattgattctgcatttttagtccacctttgaatttatagataaagatcaacaattaactttaagcattatgctaaaaaaatcttagccagaaggattgcttcctgaaaatgatttaatttgtatttttcttaaatataataaaatgccctgataagaagtaatcaacaattttgattctagttttccatttgatttgaacatgtacattatttcagcatggtggatgatacatatctacagcttgaaatatgtgcattggggaggttttgttgaatgctagattgctgttttgctgtagtttgatttatttgtgtgagttattagcttgatattggaaagtaactaaaatttgaatatatgatatctctgcttctgaaataaatatagcgattgaaaatggaccttttatgaacgttgagtggggcaatttctggcaggtggggaagagagtaaagaagattcattgtatgaaagcaaagcaaatacacatagaacttgtaatttaacggaacatatcagcagatgtggttctcagaatgactcttacatttacattaatgactatctaaaaagaattagacagcaccgtgaacttcctttttcaaaattaaaagttttttttaaaataaagaagttcagattttagcatcaactgaccaaagcataaggggccatccaagaaaaaaaataatctgaagcactttcataaaacgatgttacaaatcaatattttagacactttgaagatcatctccttgcttttcaaccttcacacttccgagacaggggatatatatgtttatatcatctctttttctaaaataaatcatttctgattgagcatcttttacagaagagcccactgcaaatgtcaatttttataattgcccagaccatacttgtgggaaaaatgaagggacaagagtaggaaggtcattcagggtcactgaatacatttctaccacaggaaagcattacgtcttttgcactttatttcttcaagccattcccttccaacatctcatatccctgtccccccagaaagttggagtcacaggtgacacagctgggaaaactttctttatgaaaagattaacacatgttttaaaaagagatacatatgtatgtcaaaattattccagaacactgttctcagaagggcagtaactgcaaccaagttagtttctgctattgaaacaaaatgtgaagctcatggggaaatttcatcacaatatgctgtctatgaattaaaaatccatttaatataaagcctccaagaaacaaagaaaacttgttttttatttttacagaagacaacgtacaactttttaacccctaacctaattttttaaaccaaaaccagaattattttttttttctttttagctttcaatgaagcacaatcaaattcctggagaaaagatgggaaaacggcataaaacaaagcacgaacacggtatttaaatccaagtttgccacaaaatgtaaatgtatttcagtaaatgttctataggatttgtaaacaattgaaaagctgttatttcttttacaactgcaacataataaacattataataatatacctttctggtaatgatatagaattttttatctggtgacaaatagttctgccaaaagacagataaagtaaatcaaatgcaggcgtaacatctatattatgtagatgtgtgtagttattactagtggagattaatatgatttattatgcttataggtcatttgtttgacctttatagtaaaatgccatttcatatccttcttacatattgttattattaacctccattagtcatatatttttgtaaataccttctctaaatccattatatattttaaaacttggtttatgatttattttgctctatggaagctttaaactatcagttaattcagtctgccaattttatgttttaagtcttccaggcttcctgacttaccaaaaatctgtctcccatgaagcttataaagtcctacactttcctttattgtttatatgaatttatatttctagttagctccttaatctagtagggcgtttttttggtctatagttaaacttataggtacatgaatagtcaattacgagacactatttattaagtgaaataggctatccacacagaactaaaatatccaatcttatttggatgttttcctggactctcacttgtaaaccactaacccatttctctagccttatgccagcacactgtggttttgatcacaattacttcaaagtatagtagaaatctggaagtgtatgttgctgccataatatgcttattaataaaattgtttccaatttatacacacacatacacgcacacaatttccttctatataaactttaaattacatcattgcctatttcctttgaaattatattgcccccaaacacatcaaaagcattctgattataactgtattaaattcaaatgttaacttggctggtattgcaagtttaatgacaataaatcttaaatcctaaaacaatcctacgtagtcaatttttgctttttcttatgtatatttttatgcttttcacctatagggtctacaatttttattcctccttaatttatacattgtcatcagtgtgaatgaaatatttccatttgcatttatagtcattaatatgaataaaagctattatgtatctattcataaagtatttttaaaattatttcacagattttaaaattgagtctcctaggttttctctgcacaataatcctatttaacaataatttttcttctttaaaaatatttcttctttccttttgaggttatcattactattattattttagaggtggaggtcttgctacttttgacttatttcatgagctagaccaagcaaagcaaatttgaaaactttgaaaaataaaaatttgataatttttaacgttgacaatggtgcttctttactagggtgtcagcaaactacaaaaaaaaaaaaaacaactttgttttgcaaactttgtatttataaaattttattgaaagcacaggcacacctactaatttaagtattgtccatagctgcttccaatgccacaactgcagaatcaagtaaatgtgacagagactatttgggccacaaaacttaaaatatttactatctgccccattacagaagaaaaaatgcagatttctctttatccttctccttccttttactacgcagcaggcatacttctaggatttttttttttttcctatataaccacatattatttccgcaaagttattaggaagtacatgggactttccagccccatttcacattggataaaactgaggcatgaataagctaagtcacctgccaaaggtcacgtgggtggcaaatatcttcagcaaaattttgaccccaaaagcctaactatgagttcataactgtgcagtagaaccctttcatctttggtcccatagcacttatcatactgtattgttttgttacattttttttattatactttaagttctagggtacatgtgcacaacatgcaggcttgttacatatgtatacatgtgtaatagactgtagctatatgtaaacataccagctttcttagatgttacttcctcataaagacctccccctagaccagtgattttcaactagggatgattttgctccccaagggacatttggaaatgtctgggacaaatttgtgattaaagaagagagtactattggcatctaatgggcagaggtcagttgtgatgccaaacatcctatagtggacagggcagtccaccacaacaaagatgtatttggctcaaaacgtcagagattgagaaacattgccgtagatcaattgtcatcttctgaactttgacgtttacacatgcaactaattgtacaattatttaacatctgtacacccattcactgctttcaccactagactgaaaaactccatcagagaccacatatgttttgtgcaatgctataccgcctgtgccttccgcaataagtgacacagcagacactcattaagtataagcttagtgagtgaatagtggataacttaaagttttatagtgtatacatgggacttgtcaagagtctctgtgtttcataaacattgtcgtcatattctagctaaccatatttaaaattttatatatatatatatatatatatatatatatatatttcaccacaagatttttatggtggtgcttttatccacagttataagttctttaagagatattttctatcattaaaaaataaatttatgcctatttactgaagtatttgtgaaaaaagcccaactgacgagtaggttagaacattcgaaatcttcaggttttgatagttttgttttacatccgtgttaaagatgttttaactggctcttcaacattctctaagtaggtagggctggctctaggcaagcacctgaagtatagagttagcttcaggtctgccttccttttcttacctttaggatttcctggtatctttatcctatttctcccaatcccatcttctgctctgtacctctcttgttgggaaataagactcagaatcacagactcttagaacacaacaggactttaaggccacctctcctaatcacccaactgataaacaaattcccatgtataactcccaggtcccaatttttcattatcttgcctatgatcaggtatcataagtgctagaaaacacactattaattgaggcaccagttcctgcttttgaaagttctgatatttagatggctttttgttgagtcaaatgtcaccccccactttagcttctatcgagagactgtgtacctcttggaattattcagcacaagtttaaatttttgtgtccgtaacagtccttcaaacatttgaagacaactatcatctctcttcttctccctgctaaacttccctagatctttcattacctagatgacacagcgtcgaggcttctcaatgtatgaacaactaactaacttccaacttttctctgactggtttaaaatctcttgtaagatttgactgtttattcattacatgaaggaacagcgagaataaggggataatggttccctctgttctctcctcaatgcatatttgttgtatactctttgccaggagctatgctaggtcccgggaacacgattttgggcaaaatagacagattcctttccctcttgctgcttataatacaattgtccctcagtatccatgggggattggttccaggatccccacggatagcaaatccacaaatgttcaagtgacatataaaatgacatactatttccatacaacctacacacatcctcctatatactttaaaacatctctagattacttataatacttaatacaatgtaaatgctatataaatacttattacattgtactgtttagggaataatgacaagaaaaacacctataaatcatcagtacagaggtaggcattcattgtttttctgaatatttttgatgcatggttgcattcacagatttgtaatccaagaatatgaagagcccctgtaccaggtaagagggacattgatggaaacattacagttaaaactgaggttacaaatacgacaagtgttgcctgaaactatgagagcatataataagggggcctatatttaaaagtaacatctcacataatcctcacaatgacccaaacatgcattttcaccttaaatatcaggaagcaaaattgcacaggtattcttaacatggatgccgggtctgggcctcaagaagaatccctggttccttcactctatgagggaggtatgatacccaagactcaaagccaagtatgcatagtcttaactcatagttccttctgacaccatgctttctaccacaggctaggattcaaagtcagccataaagatccagaaatgagtaaaacatacatctagttaaggggagaaggcttaattgctctctaggttgccaatatgaaatgaaaaagaatggctaaccacatctctcagcattgtcaaaatagccaatgaacagagagagcactgcaaagacccccaactcaattcagacttcatttctacctatgtggaattgctgcagccagaaatttaagtaaatgttacttaaatgtaagagccatgtacctaactcttaagtggatatcctcaaatgcaaatatccatttaaaatatacaagaattactgtgatataaagtaacaattgctatgtatcttttacttttgtcgcccagtggcctttagactctggatatatgttaactggcatggctactttggaatatttactcatatatgtaaaccataatggccttaaggactacagataaggcttctttcatattaatcaactatctttcaaaatgtgtaccgcaggctgttctcggaatggagctagatttcagccattagcaaaggtctacaaagtaaaatcactgttactgttaacttttatttttctgattaaacatggatatcatttggatatgtgtccccgcccaaatctcatcttgaaatgtaattcccagtgttggaggtggggcctggtgggaggtgactggatcatgtgtgtggatttctcatgaatggtttaacaccatcctcttggtgccatcctcatgatgatgagtgagttctctgagatctggctgtttacacgtgtgtggtacttcattctgtctctcttgctcctgctctagccaggtgaagtgcctgctcccgttctgccttctgccacgactggaagcttcccgaagcctccacagaaggagatgctgctatgcttccggtacagcctgcagaactgtgagccaagtaagtgtcttttctcatccattacccagtctcaggtatttctttatagcaatgcaagaaaagattaatataacacaacacacagacacatgaataaactcataatacactaattaaaacaatattttgaacattaagaaaacatgcccatgtaattttatgaatgtctttcgtatatcctttcagggattggacgttcattctaacatacctcttatatattgtgcattaatttaaaaaataaaggctttatggcttcacctctgcctgtgtattgatggtgcttttagtgtttcacctttgctgttctgctaacatatcctcaataaatcgatcccaagtgccagaaagcaaataaccctttattttttgcacatttagaatgtttcccccaaaaaggagggagacggtaggtattagagagtgcctactgcgtggtgttcaatcacaataggcccttcgattaatatttattcattttgacatcccaacttgttctagtctgtgatggggtctttaacctggcatctgtggatgggattaagggaggtcccaggatcgcaggaattatattacataaggtaaatacctttgcgttgtgagtcaggtgttacattccatttcacagtggaagattattgagatccagcaacatacccacatcattgataattggtagacatggggttgtataccagctctgtgttactctaaaacacatgcttgcttcaacatgccacactgccttcttacagagctgtgaagaagttgaaatcgcgaaagctattaaagatcaaggcagataaacttcatattatgcagccttcttgtgagtataactttcaattatctccaataaccttaactacatacaaaactatcatacatcaatgatggatacagaattaatctcatttgaatcaaatctttaaaagaatttcaactgttgatataattttgaaaacaaacttttttcagttgaggcataatttgcatataataaagtgcaaaagtctaagtgtttggatggatgtgttttgacaattgaatgtatctatgtattcaccacctgaacaaaatagacaacatttccattaccccgaaaaagtcactaatgcctctgtccactcaattccaaccctcacccagaggtaaccactttcttaattctattaccgtaattgagttttgctgtgctttaacttcatgtaaatacccatatttgtgtctatgacttttggctcagcataatatttttgacattcattcattcatatggttgcttttaccattggtttttcctctattcactgccgagtaaaattccattcatggtttaacagaggcatcaactttttgtgaggtagtgagggaaggaggagggaatgactgcatttcatgtgatacgtaaatggaaagaagcacctagctacacaaagagaaaaggaagagcattctgggtctaagaacagagaaacacgtgcaaaggccctgagatgttttagaaagtgaggaagcactaatatgattatcctatatggattgagaaaggttgacttaagaagaaaatggtaaagatagaaatataatatattcattatgtgttgtaattcattgtattctaagccataataaagagttgggtgttcatcctaataagataaatccatgagggccttaagcacagaaatgcctttatctagctgacattttgagaagatccattttgctgcggtgtaggattgaataggaagagaataacaacagtagtaagagaatgtgacctaatctggcaagagggcagaggtgacctggcctaagatgggggagatgcagaggaagagaaggcaaattcaaaataaatttttggagacagaagttgcattgcattacttgcttatagattagatataaaatgggagataaatgatggaatcatgtggactctgcttaccaatcaagtagataagaagaagatactactgtgaaatagatgagggctggggaaggggaaagattttaaataaaatgtcaaagctgcatgtgcggcagccaatgaattgtgtcatatgctcaggtgaacaagcaggtttggaatcaagagaaatatgggatggaaagatagaggagttattcaactaaagatggcagttaagtccgtagaaatggatgctatcacctaggaggagagcgaaaccagaaaccctaggattgaaggtatagtctcaaactgtgacatacctacctccgaggaatttggaacaactcactgggacacaaaagaaaactgtgaatgcttctatttgtgtttgcatttatatttattgatttctattttcacatacgtttacatgcttagtcatattcatatatgatttacaaataaatgtacattttgtgggaagaaatgtgcttataagttttgtttcaattagaaagcagtcttgaaattttgaagagcattgccttagaggtcaagaggcggaggaggagctagcagaaacagctgaaaagaagccagtgagcttcaacagaagttattgtttcaagaagaaagggagtattctgttgttccctctttctatctgtgcagttgtgggaaatgtgaactcatagtttgtctcgtgtggtcctgttccaaatgccatacttgctggaaatagagtgcagagcatccataaaacagtctataagactaagcatatataaggctgccaaagaagtcatttgttactatctatcttcccattcattttctcaagtctagttcttctgctggcctgtggttagggggtttattctgagtatttccctgtgtctttaaaacttcacatttatatttgatggtattccatgaaatcatcaggttacttgtcaggtttcaaatattacatgaactattttggaaaaaaatgtacatttcaggctcatttccagtcctaaacaatataaattatagccaagtatggcatttagccattaatgctgtctttcacttcagtaatgtaaagaaataataggcttatgacaacttggataatacatttaagcttctacattattgctccagatataaaaaaaatttttcacttcacagaggttctaccttgaagaaagaaaaccaggctccagatataagcctgaaactttcctgagtttctgacttttgccagccatttcatcacactaacaacataaaccttaaatagttaaaacaaatgtaaggcatttatgttatatattcaaatggatataccatggaaaaaaagaacctattactgaatatttagtttgcttcaggcttcgcaatcattatagattccacatttaatatatatatgtgctgattgagttgtcttcattatttcttataaaatatctccaatgttcaatctattgatcatgttgaaagaaaaagggtttagatgagctgtacacatacatatatactctcgggatcatgataaaacaagacaggtggcctggcacggtggctcacgcctgtaatcccagcactttgggaggccaaggtgggcagatcacgaggtcaggagatcgagaccatcctggctaacacggtgaaaccccgtctctactaaaaatacaaaaaaattagcggggcgtggtagccagcgcctgtagtaccagctactcgggaggctgaggcaggagaatggcgtaaacccgggaggcagagcttgcagtgagccaagatcgcgccactgtactccagcctggggtgacagagcgagactccatctcaaaaaaaaaaaaaaaaaaacaaaaacaaaagaaaaaacaagacaggtgactttgaattttaatgaacaagttagaaccctcccccaacatctggttttaaatgctattactttcggtatgtattgcttatcttaataagtatgatgagcttaaatattagcttatcttcgggtccctctcttttttattttaatttttgtgggtacatcgtaggagtatatatttgtagggtacatgagatgttttgacacaggcaggcaatgggtaataatcacatcatggagaacggggtatccatcccttcaagcatttctcctttgtgttacaaacaatccaatcacactcctttagttatttttaaatgtacaagtaactcattattaaccataatcatcccgttgtttgatcagatcaaatagtgtgtcttattttccctgtagaattatttggaaattttctgtttatgttttcatgagctttgggatttggggaagaatttcagcatttttgacttaagatatagttggttcacttagcccagcagtgaacttcagggggtcaatagcatgcaaatatgtatttaaatattaaacatttttgtttctgttaacatcaaaaatttattggacatttaatcttttaacagaaaatatctcatggtttcatatgaaaagtggatgttcttcacattttatttatttcaaataatttacatttatttttacttattggaattggaaaatataagttgtatatatcacgtattatacaacacattgtattgaaaaatgtggactagctaaaatgagctaattaacatatgcattacctcacatactatttttttgcggtgagaacacttaaaatcgactctcttagtaattttcgaaaacatattattattaattatagtcactatgtcgtacaaaagatctcatgaacttatgtctcctatctaactgaaattttgtatcctctgaccaacacagcccttttgtatcctttgattttaaaaaaggcgttgtttaattttaacagtgtcaagacttttaatgataccaggtcctgaaaatgtcagactgtgtttcccatacagtttctttagcatgaaaggggatgtatgcatttgaaatatagtagttgatgaacatcttttagatttttcagtagaattaaaactggatgataaaaattcagcacatatcaactatattccaaaaatcaataaaagtgcctaggagaaacatttaaaaggttaaggaaattaagaaaatggataagataataagataatttaagaaaaattatccaaaacttagaagtaaaacaaaagatgatcgtgtgtgtttcaaaataatggtagcgttgttttctaacaaactcctcacaccctcacaagagcttcaatattttcagagtaaagcaactcttactgtttactattaatttgggcccacacatgttacaacgctatgaagttcaatgcaaattttagaaaactgatatgatgtaaatgactttttacccagtagaggatataaccccaaaggctgtagggtatcaacgagtttagtatcttattcactaatcttattccagaatacttttttaaaaattcactcattatagaagcatttgtttcttgtattctcttttgaaccagttttgtcttcctaccagctctccaattactgtattaaataaaacctaccgtgagttcactatgatttacatgaaaattatgtttcttcataaaatttcactgtgctgataggtggtagaattatgaattttctttgtacttttctccattattcaaaatgtccccagtatactctgaacaaaattaaacatttaattggaaaaaatacatgctatatgcaaatctatttagcttcgtgttgccttaggtatgcaagacgttacatatcatacaaaaaaaatctaagccaccaaagataaaacagttttgcaatcaatagtgtttttccttttctcttccatcagcagcacagcgatgtacaataaggaaataaagtaaactttagaaatatgaaatgtgtatacgtattgacgtgcttattgtgaatgcgatgagaaaggcaagtcaggacagtgagagtcaggttcattacactgcattctcacactataaatgaaagagtagcaagtattggctaaaattcaataacttccatggccaagatacctactataatttgaacattgattccctttgagaagctttctcctgaggcaccatcaagacagatattaataattagtagttcagctaggggttggaccacaaatatcaacctgaacaaactacagaacaccctccacatttgcttcagcactgacagttttgaacactccctggtggccaaactcacttgttttcacctttgaaatgagttagttttcactgagtgctgttgggtactgagccactagcagaagtgaggatgtgcagtctgatgactcacggttgcacgccactaaatactgccaattacacacatttttccccttgcaaattttggggaagggggaggggtgtgaagggggaggggtgtgaaggaggaggggtgtgagcagctgcatataaggagtgcctatactttctttcttttcttttttttttgagacagtcttactctgtcacccaggtcggagtgcagtggtgctatctcagctcactgcaacctctgtctcccaggttcaagcaatcttcccgcctcagcctcctgagtagctgggactatcagcaagcgccaccacgcaaggcttttgtgtgtgtgtgtgtgtgtgtgtgtgtgtgtgtgtgtgtgtgtgtgtatttttagtagaggtggagtttcaccctgtaggccaggctagactcaaacttctgggctcaagcaatactctcgccccagcttcccaaagtgctgggattacaggcttgaaccaccatgcttggccaggagcacctatagtttctacctcaaaaacatagccccctatacctttccacagattatattgttacttttgatattgaacttcttttcattgtaaaagcctggagaaaatttaaggctgtttatatatctgttttctaaatcagcacaccaactgtgaactctgcacttttgaattgggatgagagaatggaaagaaaaaaggttgggagaggagcggagctgggaagaaaggtgatctctagtcctttttcctccgctccctgctccagctcacttttccaatcagtttttataataagcattatttattctcctacaaaagtctcaaagtttactagttataaaaaactcatgatgctttattaaatagggtaaatttgactttgtaaagcaaaaataacaaaatacgtaatttgtaattttcaaaatatacacatgtaatttgaaattacatgtaatttcatattatgcatgtgtgtaatgcaagcacacatgtaacaatacatatgtaacgtgttatatatgtaacacgttacatatgtgttgcatacatatgcacgtgttaggtaacgtgttttacatgtcacatgtaacaatcaatttcacatgtaacatcagttacatatgtgaaaacacacatatgtaatcacacacatatataatttgaaatttttcatagccacatttttaaaagcaaaatgaagtcaatttaattatatattttatttaatcaactataataaaaccataattttaacatgcaataaatgagcatttacttcctttttggttctaagtattcaaaccctggcatgtgtgttatactcagtgcccatctcaattagtactagccgcattttaagagctcagtatcttatgtggctagggggcactgaattggactttgcagctctaaagagagacctcacattgtgatttttattgtcaggcaaatttcaaaattatttctctgcttggatgaggcaccacgtctcactccttgcaaatacatcactctcactaccaaatcctggattagttcagtgttgatgtcatattgttatgagctcacaacacctgtagcattcacacaaataggatacagtggtttaccccttatctgtaggggatacattccaagactcccagtggatgtctgaaactgcagatagtactgagccctatataaactatatgtacttgtgataaattttaatttataaatttggcgcagttaagagattaaaaatcatgaataaaaatagaacaattataacaatacattgtaatgaaaatcatgtgaatgtgatctttctttctctctcttaaaatatcttattgtattgtagtcacctattttcagacagcagttgaccatgggtcactgaaactggggaaagcaaaactgtggatattttgttccaccactgtggagatgtacattatgactacatcattaccaccatctgtggttttcctttaagggtgagactatttatatgcaaattcaaacaccccccccccccccaacaaggaggccatatttagattacctcctggaaagttacttaactctctggaatttgaatttaaataaagagtagacttcttatttcattttgggttttgagaactatatcaagagctcaatatcctgtgaatgaaatactgatcatgcaaacacagccaaagattgtctagggaaaatgctgaagggaactttccaaatccactatagttcttctttcttaccattccatttatgggctgtccacttactccctggcatctgtcctgtgcccctttctgattgtaagtacagtcaacaatgatacaggcaaagtcattcgcttatctgtttctttaagactccagtgcaatgatacaattagacttccaaattctcataagtcaaaaggtacaaatccctgaaaactgctgaatgagtattgaagtgttggcagttacagcttatgatagaatttttattttcaaaagagaaatttaattcagggatatcactatacgtatatccttttatttcctttttgggaactctataagaagccatacttgtttcattgctggatctcttatttcctggaataatacttgtcacacagtaggtcaacaaatatttggttaatttatgtattgagagaattgcttggcacaattcaaccctctcaaagtttatgcaggtgagcaccgtgcagtatagtctcctttggcagcaagagcttaatatctgattttgagagagctgagaatgatacgcaaaacagcattagtttcttccctatatttttaattacagtaatgctgtcttttaaaataagactcctgagtactttatgatcataataaatccatcttaatcgcattcactgctttattttcttttttatttcttttgagacagagtctcactctgtcgccaggctggagtgcagtggcacgatcttggctcactgcgacctccgcctctcgggttcaagcgatactcctgcctcagcctcccaagtagctgggactctaggcatgcaccaccacgcctggctaattttcatatttttagtagagatggggtttcgccatgttggccaggatggtctcgatttcttgacctagtgatctgcctgcctcggcctcccaaagtgctgggattacaggcgtgagccaccgcacccagcccactgctttattttcaagcagaaaacatacacaacaccttcagatggatgctaaagtagaaataaactgtttaaaaatgattgtcatgtggtatgtctgagaagaaaataagcatcacaggatcacaaaatctgttaaatatctgtctccaatcatgacttgaagttgcactctttcaagtatgctaaactgcagttttcctttaaagttcaaaccgtaattataatgtaaaaacccaggaagtatacagcaaaccgtaagtatcctaaacaaacttaaatcttgaaaagtgcaaatctcatccccaaaagcctttgctcaaacacattctgcaactgtggtttataggctaaaacacagacttgtctgtgtaccgtgtaatgtcctttgcaaagttttcctaacctacctgtctggcccatgctatcaccctccatctggaggcctgggatcccaaagcttttgccacttaatattggttgccattctccaagctggcttttccagactgaggtcatctcttctgtttctataaaacttttaaaatacagttattatggaaatttaaaactattatgctatatcataactttgaggtttatgtatctatctctccctgcactagactggctttcttgagtgctggaaatatgattgattccttattccctcacataaaggcaggcatctgcctccctgactgaggtagggtcactgcacaagtagtattgttttcctcaatgttgaaacttttggtctgcagcactgtcctgaaacttaagaaaactatgttgaatgagccaaagaaggctgatattcagggaacagtaaattttaaggaaaagcagttttgcctgtagggaaccatgtcttatggtgggcttttctcttgagggtattctgaaagggaggcaattactaaatccttggctatgatcttcaaagggcttctgccctgtggaaaccaagaggctttcttagagaccatcagcccttgccatacacaatccaatgctcatgtcctccatttgacagccgcttgctaaattcctccgtcacctcagtaacctatgtcttagagtgatatagaatccgccaaatctatatatcaaacagagattaccatgagagtaacaatgtaattgaaggcacttcttaaattatgaagtgctttgttatgttatgactactgttattatcatcaacaaccctaacatcatctctaataacaactccttttaacatccttcttttaatacactatgggtcaaattataattatattaataaatatgttatgtctcaactttactgatgacaatataaaataagtttaattagagctctactcataactaaataacatttttatgaataaaagaagtttcatcttcatcacttaatatatttaaggtctcttaggaagaccttgtcctgtagtcagtggtattattctttttattagtttcctcaagatttattaggcagagcagtgacttaatgtttttggcttaacatttctaacttctagctgatgaacagtaaaaaaaatatggtgtttgaatcccagattcttcatttattagctttatgatttgggataaagcgtttaaactttccgaaatttttgtctaagagttataagaataccttttctacctatcttgctgggagtatttcaaaatcacatgaagtcatattcttggtaatttttaaaacagcatgcaaaagcaaggcactaaaccaactttataaattactgcaatgaaataaatcttgtattacatctttctgtgtatattcttgtaaagttgattttgtactattttccaaaagtattagttttctgaactggcttcttaattttctaaaacttatacttccttacactcaccatattacaaccttgtgacactcaaccagaaatcacccaacacacacatacacatacaactgtgttagtcccttcttgcattgctataaagaaatacctgaaactgggtgctttaaaaagaaaaggggttttcttttgacttacggttctgcaggctgtacaggaagcatgtcactggcatctacttctggtgagagcctcaggaagtttacaaccaaccatggtggaaggcaaaggggagagcaggaaacaggtgggggttgaggtctcatactcttttaaacaaccacatatagcatgaactaacttgtcaccaaagggatcattcatgaaggatccacccacatgatccaatcacacctaccaggccctgcctccaacattggaaatcacatttcaatataagattcggaggtgataaacatccaagccatctctctctctctctctctctctctctctcacatacacacacacacacacacacacacacacacacccacacacacacagtcgcaattaaaacaaaaaatctgtgaaacatctatttgtgatgaatgctgatattttctattttgtttcactaaaaatcaaaggccggtgttgatccacaaactgagtttatgattcacagtttggacaatgaacactagcatactagatttaaaaaatgaaattaaccaaaacaaaaccaacaataaaataaaaaatgtcctcagcattattttgtgccatttctttccatgcatccaacacgcttaccaagagttcctctcatcttgtcattatcataccacaagtttttctgacaccatcacttttcaactttttctcattttcatggatttacaattctctcccttattttcatatcgctctctctatgaagctttcccaattcttctggctagttactctttgggttgcctctgctctgactcatcaatggtgtaccgacctctattatatctattagatgctatttttatggcttaaatgtccatttgctaattataccacttaaatgtttcaattgtttaaatgtccatcaatttcagcaaaccttggattatatgtgaataggttaggattgtatcaatttcaatatcctgagcacctagcatagagcctgacacagagcagctccaaaagtaaaagttttctgaataaatgtgttgatgttaaaggttaggtgaaatgtagagaagtgtcaaagtacacaagatgttcaggttttctaagataaaggtaatctccctggtgtgattctgtcctgcacagctgttctcttgagcagtggtcctttatcatcatctgccttctctcccacctaagtgcgtcctgccacctgatggacgatgatggacatgagtcctctgaggccccaaaactatctttttggttgtgaactaaaggccgacaaagatgatcactttaaggtggataataatgaaattgagcaacagttatctttaagaacggtcagtttaggggctggggcaaaggataaattgcacattgttgaagcagaggcaatgagttacaaaggcagtccaattaaagtaacactggcagctttgaaaatgtctgtacagcccatggtttcccttgagggctttgaaataacaccatcagtggtcttacggttgaagtgtggttcagggccagtgcatgtgagtggacagcatttagtagctggggaggaagatacagagtcagaagacgaacaggaggaggatgtgaaactcataagtatatctggaaagcgatctgctcctggaggtggtagcaaggttccacagaaaaaagtaaaacttgctgctgatgaagatgatgattttgatgatgatgatgattttgatgatgaggaaactgaagaaaaagcgccagtgaagaaatctatatgagatactccagccaaaaatgcacaaaagtcaaatcggaatggaaaagactcaaaaccgtcaacaccaagatcaaaaggacaagaatccttcaaaacaaggaaaaactcctaaaacacccaaaggacctagttctgtagaagacattaaagcaaaaatgcaagcaagtatagaaaaaggtggttctcttcctaaagtggaagccaagttcatgaattatgtgaagaattgcttccagatgactgaccagaggctattcaagatctctggcagtggaggaagtctctctaagaaaatagtttaaacaatttgttaaaaattttccatctgatttcgtttctgtaacagttgatatctggctgtcgttttgataatgcagagtgagaaccttccctaccatgtttgataaatgttgtccagattccattgccaagaatgtgttgtccaaaatgcctgtttagtttttaaagatggaactccaccctttgcttggttttaaggatgtatggaatgttatgctaggacatagtagtagcagtggtcagacatggaaatggtgggtagacaaaagtatacatgtaaaataaaagtattttaataaagtaaaaaaaatgataaaggtaatcacattagaagattcatctcttgggtgcaacagctagggtagcctcccaagccctgtgtggtagtagtcagtatcactactatggtttcaatgtttttccctccaaaactgatgttgaaatttaattgccattgtgacagtattaaggggtgggagctttaggaggtgattaaggattgagggctccaccctcacgagtgggtttggttcccttataaaagtgggagttcagcccccttttgatctttcttgccctctaatcgtccatcatgtgatgacatatcaagtaggccctcgccagaggctgacaccttaatgttagacttcctagtctccagaactgtgagccaatacatttttgttcattacaaattattacctagtcttaggtactttgttacagcagcacaaaacgtattaagagagttacctacttatcttttctgaacatcattacaattccatttcaaaatttctgctcttaatgatatcccaaggagactagaaaatatttcaacagttcagccactcttcaatgaaattatcttgcgtggtcatgtactcgttaaattgccctgaccattctttgaaggatagcactggttatgagattaaatttgaaagttcctatgaactatcagttgagtgaatttgcttattatagcatatatcttaatcatatgttcataagcctccattaagccaggctgcacagtttatttttttaacaattgcattgttttaaagttacagttgtttcagcaatccattactagtatttaaaagtacacacattgtccttttgtaaatacatacaacagccataaattataaaaaaatagaaattcaaggataaaatgtttgaaaaatgtgttatttaagattagcagtaaaattggattttcaaataaatccatgttaactaggatttacaatacaagcctgtactatgagttgtaaagccaggattttgagaactatgctgccacattaaatttattcattttcacagcctgcagacattttaatgcctgagtagcaataagaacaaattaccaaaaaaacttttaatagggtataataaattaagactgaatggtaatgcaaacgtgggtacaacaggacaaaattatgaatctcatataatgacccaacaacacttagagtgtggaaacaacgttggtattctgggatatacgaccacggttaatcctaattgtttttcccttgtcaaatagaaattgcacatcaatctcaaagtattacaaactgttcattacatgcaaatggttatgttctgcaggctctccaaggggactcaaccttctttacaaaaggagccaggctagaagcagagtttctctaatgacagtaagtatccattagagttcctcatatataagcaagagagactgcctctgattcccaaagtcaggttttcccaagtcagactaggtatcccagaggtgtaatggaggactgtcaattagggggcaggaaaaataacagctggaaaaacaacccaccatttgtcctaggccagatccagtactttctggagtgtttacttactgccctttgctttagacgttgtgccttaagacgttgaactcatgagactgtgagctcataaagagaaaaggagctcttagtcagctctgtattcctagcagcaagcagtatctgctttgcacacagtaggatcacaatatatgtttgttacatgggttctggtatttaacatatgctccaatgggtaagagaacagggccatcatattgttaaagtatcaggcaatgtgaaaattttaagtgctctgtacacagaagaggtgaaggaagctcaatgtaagagagaatgttttggctatgaaaagcaaggacaaacttggggatcatttgtctcaggtaatacaataaaagtatcatttttaaatttatttatgtatttattcgttctactgaatattacattttcaatatatgaatcaatttttctacgtaccgaggtatattggtgatcgagaaagaccaagtacccaaaatatgttcattctaatggaaaagataataaacatgaaaacacatactacagtttcagcaagtgacagagttatgaagaaagttaagcagatctcccagaaagagttcaattttgtgtgtgtgcatgtgtgcgtacgtgtgtgctttctttaagatgggggagttacaaaaggcatatctgtgaatataaaattagagcacaaatatatataaagggaagtgtacaaaaattctgagagggagtagattgggacatggtgagaaactggagatagggtagagccctctggtagagagaaaagcaaatttaaaggtagaaacaagcattctagggaacagtaagaagggatgtgaaaagaaaacacgaagatcaatatggctggaacatcgtccttgcaaaatattatttcatgaaaattacttctattaactttaatcttacatttcattaaatgacaatttctgcttctcattgcttccagaatgatggtgcgcagttttgttttgattttttctatttggaatttgcaatcagcattcttctcattttttgtagtctcttactctcttgataatttcatgctctaagaatgggaatcccttagggatgacatgtttatcctgcattttaagcagttctttaccgtggttactacagtaagttatgtttttttgttcttgcttctttccaataatgtatgaaaatctgtcatcttcttaaacatgccatgctggacaacggaagtctaataacaagccactgaaattatccaattattttaatatacttatttctgaaagatacacttgatgggcaaggattgaaagcccctctcggaatttctgcctggtaccacactcccagtaaattggttatttactacttctgaaaagatggataggggccaaaaagttgcagaggagtttccaagcagcaataaaagggtaacaatatttacgcaaggatgaagtgcccaactgtttaactgtattaagagacttaactctcatgccactaccagctaataactttgaaaagctcattttaaaatgtattcccacacttacacattgctgtaaccttaaagtaagtgactagagacaaattctcttagcagtaaattttccggctgattcccttatgctagtgtatgtcttctagttacagaaaccaggatagctttgtgaccacaaaacaaaatcttatgaaattttattactgctggggaaatataaaggacaagcaatggtatgaattattcttaacgttagggtcccagtgaagggcaacagatggtagaaatatttactccagtgatttttccatcaaagtttctatcagcatttgaatctcagcagtgtggctgttaagaagccgtcaaactcagcagccagctggtgaaatcacaatgtaaaaactgactatacagaaaatatacttgtgtctgatttttttacatcatatgcctttttctagattatcctttaattcaatctgtattaatataaattcacttacctcctatagagttctttgaggcagtagattgccatgttaggtgtatcctaataaaaatacgaaaactcattctctgtagcagatactgtcagtgacctatgcacatctattcagcactcatcatttttgtacaagtcaatgacctttcaacggcagtacctgttagataagggctttctgggctgcgagtgctgaaagcaaggcgagaagaatgagaaaacctgggtatttccattaagaggaggacggtcttttcatggactcgcttgtctcaaacttttgagcaggagtcactccaactccattgtgctctctgaatctaaactcttcagaattgggtcctttaaaaagtgctttagaattttcttcaatcactaataaccatggtaaggtaaagctgaagagcagctaaagggagagctgaagagcagctaaacttggctttgacatttttgtactctttttttgccttctctcaactccaaagcaccagtgtgctctttctttctcccttttgttcctcatctgagagatcacagcagggtcaccatgctataactacatgctttatatgtaattttccattctctctggacatttcacatttgagaaaagggagtgtatttttcttcaatagaatatgacgttaaactataagtttttcaacatttgatggtgggaccatgtgaacattaaaatatgacatatgtaatccatatttacttctgtatgctcaatgacaatgaataaatttttactttcatatcacaaagtaaacagttttttattacatttctttacagcaacatatataaatatattgcacatttaccatataacataggttatggagcagtaaaacacactaacattgcaaaagataccagaaaaccaattagcttaaccttaacaagactatattttttccctaaaaacagcagtttattcatgtcagaataacacactggtgtttcgctccccatgtctgcttaacatttgttgatttaaagcctaaaaaatttcatctaaacaataccactactgttaatgtcttaaggtcgatttcaaatggaataccttaagattttagggtctcaggcttgtatgtctgcgacaacgttctgcaggaaatactggtcatttttaatatggttcattcagcagcattatttcataaaacagatgccatttccattaataaaaatattcagctggtttaaatacttaatctaatggtaattgttattgtttctactggcaactacaaacattttccatctcattctatcatagcccatgttttaaaacttattttttcctagtctccaagaacatgctagctttaaatgttagggcattttataatttctactttcctattttcactgaagggacttgaaagcacacaaattcaccctgtcaatatatgagctaacattatttgtgtcactttccttcatggtgttcagcttttcctttgaaaactcccattaacatttcttcttgttagctaggaaatgagtaggcagaagtgtcagctatctgaaacagatgcgtttggctgaattggaattttcctcaattcctaatccaagagcccttatgctttgagaagaaattatactacataaaaataaggttttatgaaatttccaggttggtttttctgcagtgtggatgtttagagacgataattcagtaaataagtcttagtttgtattgatatgaactaatcacttataaagagtgattagttataataggggcttacatttaatgagtaattattttgtgcaaaatgctattccaagtggctttatacacatctcatttatatttccattttagagaagagaaatcagagacatgaaaagaattaagatattttcacaagattctacaactattaagctaaaggacctgggatttgaatccaatctttctgagtccagcatttaaccacttaaccccctttctaaacttctattagagcctcatgtggattgtcactgttttggtggatgataaaactttgtatatgcactcaattactgcttgtttagtgaatgcattaagagatgctgatatcattcaacgaatttaataaaccaatttgagtggcatataacatgatcaatatttttctcaggtaaaaaaatgggatatttttagagaggttctccatagtggcatggtatattgctctggaatatcttcaaaaagcactaattcatgtacttaattttgtcttttacttgcgacagaggaaaaaaaatagagttgcatggaaccagattatctttctactgctattggcagtcagtatattttgaatgataacactaagtctcagttaaagcactaaattctcttctttaaagtgaaaaaaatatgatgcaatttgatcaaaatacatagggacaagtttacaacatatatctatttgtttatttcatatctaaaagttatttctttactgaaaattgtacatatgaggcttcagactccaacgtgcttctgcgtgtgtttgtttaatatatgggctgcttggttgatttttttcacagtaaccattactggctcatgccaaacaattgcctgctaacagccactgtctacatcctgtcttctaaaataatttcatagtaaatattgaaactcattctcttattcattattagtcaatcaacaaaggccaagatagcagaaattaccaaagctttgatttgccttatcgatgaaggtatcttacggggttgattttacccattttacgataattactcagaatggaaagataacctaaggtacattatgtgcgtgtatatgtattcatgtgtgtgtgcacgctcatgtgtgtgcacatgttcatatgcatgattttggacataaaataaccaggaaagaaataccttaactgtttggggggtttgtgatatcattcacagctcttttctgaaagaatttttccttggacatctagaatgatttttcttatctcatctatagattgagaaaaaatagactaaataaaatggtctttttaaaattatccagttggccaggcatggtggctcacgtctgcaatcccagcactttgggaggctgagacaggcagaccacctgaggtcggagatctagaccagcctgaccaacatggtgaaatctcgtctctactaaaaatacaaaaattagccaggtgtgggggtgggcacctgtaatcccagctactcgggaggctaaggcaggagaattgcttgaagcctggaggcagaggttgcagtgagctgagatcatgccactccagcctgggtgacaaaagcaaaattccatctcaaaaaaaaaaaagtatccaattgaggggaaaagttttgataaaatgttcatcagtttcaactaaaccacactgtcaagaaatgaggaccattagacattctctgaaaattttaaattatgatatattcacaaaattgtgtaatgttaatgtattaaaagatcaaattacatcaaaatagtttgttttggacttgttttcaagttggagtaaaggaggctgaacttaatctcctgcctgaaacacctgaaacacttaaaaaaaaaaaaaaaaaaaaaaagacaaaatatatgctacaacggttttcaacacattgaacatcagacattgaaggacagtgatccttgccaggaggcttttgttaaaagatgaagctgagagtttcagcagcccaaggctgactagtgatcacagggcaaaataccagagaggtgatatatacacagaggaaattttggagatttgtagaaagctttattttattcttcatctgagtcttgatcagttcatgtatgcaagaaaaccactcaaagctaaggaaagaacttcacaaaagaattaaaggaaacaatcaccagagctcacacgtggctagtaataccacctgttcccacgagccccagtgaaaaattttatcattcacaggacatcagagagagtactcagaagggttttgcctcagtagtggggaaaaagtagccctaaacttacactgttctggtcataacaaagcataaaaggaagattctcaaaagatcaaattgtttccaagtgaattaactgtgttccagaacgaggtttgagaatatttatttcaatatatttgaatttatttgaagtatcaagcacgcgctaagttaaaattcacaatgtctggcatatagtcaaaaattaccagtcatccaaagaagcagttaaacaacacacttaatgaggagaaaaataaatcaatttaaattaacccagaatagacacagatgataaaattagtagagaagaatattctaacagttattatatctgtattccatatagtcaagaaagtaaagactgaacatgttgagtagacacatggaagaaataaaaagacccaacttttacttctaagagatgaaaatgtctgatgttaaaaatatatactacatgggattagccatagattagactttgaaaaagattagtcaatttgacaatagagattatataaaacaaattacagagaaaagagagaccaaacagacaatgaacataacatcagtgagtagtggggcactttaaggagcctaataaatgtacaattggagttccattttttttaaaaaaatggttgaaaggtttctaaatttgatgaaatgttaaatgcacagattcaagagcttaactgacttcaagaacaagaaacatgaagaaaactacaccaagttacatcaaaacaaattgcttcatcgtaaaagtactccctagttaaccttctacatacaaatctccattttacaatggctttccaagaaacccagcctgaaatatgtagcaaaattcatactgaacaactatcctccaaagagtagaatggaggtacttttacaaatttctatgttacttgatttttttcacaataagtactaatttgataataaaatataaattgaaatatataactaccttgggttggatatcattgaaaatggcaagtggtttctatatctaccccaaaacattttatataactctaatatgtttctgcctctcaggcagaaaccccattatgctacattagcccaaaattcacttcagtgctatttttaaaatgtatcttctatattaaagcagattgggaatccatacatttcctctctatacaaatgccaacgctggtgtgcatgcaagtttgattgatacacatataattacacaaggttttaaaaatattttctgtgtttaaatagcttatcatataaataggtgtttaaatgcttaactccttaatattaaagggcatatttactatggaaacatatttgagaatgaagacttgtaaagtcaaatgtgatactgcttttgtgaatccagcattttgaaatatctaaagtatttaataaactactgggtgttttttgccctcatctgtcttaatcagtattttctggcattaaaaattggctacaattcaaatccacttgattgactattgcaacatgaacaatttgagctaaaaaagatgcaaaaataattaagtcttcgtgtaataaacacagtgtttcttatgcctaaactatgtaatttagcaaccaaattatatcctggacaatctaatctatctttacctgcatattcaaaggacaccacaagttgaaattaaactacacactggttatcatccatatgctgtttccctattaacataaaccataaaatgtcaataagtaccaacaattaactctgcattgttttggcctctggactatttcagaaggcattttgtcaatagaatatatagaaatattgctacagcactacaaaattgtctttaggaaaacagaactgtaattttatcatgatggatatttctagcaacttcattttagctaagtatgccacaagttctccttctggaaaggttccaacataaagccgaaatacacactgccccaaagccacaaaacaccttgctgttacgatgcttccctctgtcacagattcaattatattttgcagtttatcagataaaccagctccgtccaggcaaactctctcatcctgacacaaaaagtccatagcaccgtgctctaatattatcattatgataattttctttctagtaatataatgatgacaacaacagtcaaaagtaatttccatcacccttcagaacctgatctttaagaagttaaagagtccagatgtgctgaagataaatacaatttcgaaaaaacaaatcaaagacttaccttaagataccatttgtatttagcatgttcccaattctcaggaatttgtgtctttctgagaaactgttcagcttctgttagccactgattaaatatctttatatcataatgaaaacgccgccatttctcaacagatctgtcaaatcgcctgcaggtaaaagcatatggatcaagaaaaatagatggattatgtaaaacagattatagagatatagcgtatattttttggttatactgacaaagatatcactctgatagtttcctgcatttgcagagtttagtttcaagtaacaaataaaaattaatatacacacctagcatgtacacacaacattttaaaaaaatactcaatataaaagctgattttaaatggaaggttgcaatttttccctttaaaatgaatatatttattgattaaaagaaagataaagcaactattttggactattggcattttctttcctaaaaatatatttttttaattctagaaatttacaaatatcttaacattgtaataaattatttggaagcaatatattccctttcaaaatatttttggataaaaattacttcataaattctatcactttcaatattattcttgatccaaaactgcctgttcatcaactgaaaggagtaataagttctagtgttctattgcatagtaatatgaacaaagttaccaatattgtgctgtatatttcaaaatagtgaaagagaattttaaattttctcaccacagagaaattataaatgtttgaggctatggatctgccaagaaacctgatttgatcattacacaatgaaacattacactgaaacgtcacactgtaccccataaatacatatagttattacaaataaaactttaaaaatataactaaaataccattatcacaccaataaatcaataattcgtcactatcattaaagattctgtcaatatttaaaataagatgacagatataattcatattgtaggctcacatgtaagcattaaataaccgatatactaaactatgcgatgccttctttaatccttcttattttattgtagtcactaaaattttagattggaatactgcaggaacttagtacaagtcaaatgtgttaatactacacatggaaagaatattaggaaacaagcatttggtcaccttccagtcataaaagagactgaggcagaaataatatgaaccagggctgtatgtttacctaagacagttgcacataagaatcaactggggcatttaaaacacagcaacaacaataaccaaacagtgatcctggggctccattccagaccaacttaatcagtatttctggaggttggacactgacgctgttatttttcaaagcatccaggtgatttcaatgtacagtcaaggtgaaaaacactgccgtaaagtaagatttgaaatcttactgggcttacagtctaccagatttcctggggcctgcccaagcaagcatttgtgagcacaaaaccaatagccatcctacagattaccggctatggtgctgcctcagagtacaggaatctgtcaagcttttctgaactctattcttaagaagcaatggatcatacttttgaataccatgatatcttttcagtcctctaccttcattcaggaatttaaagtaacactagaagttttaaattgctacatctgcctactgatgtcctgggcagagaaaggaattaacatttattaaacagttactaatagccaggcaccgggctctgtgcttttatagtgccagacacatcatttcattgacacctacaataaccctgcagcataacaattattattcccattttccattggagaaaacagaggccaagtaatttgccaaaaggtgaaaatggtattaaatagtagagagaggcttctaacccaaatatctcttgtttcaatggcacttttctaccagtgcacatgctctcttgtgaaattatttttccaagatgaagcttcactttatcagttaaacaattaaaagtgatagttctagaggttttttccccttatttttattaactacccaaaatttaataatgtatctacatgtacattgcactcattgtatttaatgaataattatatgcttaacctttaaaatcttgtaaaacagacagcattttggtagcataaaaaaggcaaccgaaggtagccgaagaggtattctctaactgtagttagtgaaaaataagaatgttgcctttgatgatttatggtattctagagttattcagatacaatatatccttccacaacaaaatgatcttgccaatgtttttgcatgtttactaataatttagcattcatatattttcaatggtatataacacacaataaatgacctatgaatatatcgtaagtttattccctttaaaaatgaattgcacattgcatatgttacatgcatttgcatcactggagtcaaagagttgcttttgaatgagaatctaaaaatctatgcaacatagttagcattgttccatactggtgagactatattttcttatataatttttctatatttttcaatttgtctacaatgtgcttttcatattgagagtcagaaaaatgaaataatttaaaatttttttttaaatggcagtctcatatgcaaatgactgctaactccaaccctcctcctgctaccacagtctgagaaacagtcagcagctaaccagagcacagagaagtaccagttggtcacgacttaccactccacctttgtagcaaccatcagtctccactcttggtttgctgtttttcctacccaatcacttgaactatacttttgccaacacttttagctactaggaggtgactgtttctctgacatactgctataaatgcccattcttcatttcaggatcctgtacacctcaaagattttcgatttcaaacctgttgcacagacttgtttctcaatcactcatcatattggtaattgccatcctctatcaaattcaacaaatccccctctcaccctgaattcttttcctttttacaagttatctacaagtttctacaagttatctttcctttacattctcccaagagaagaaaaccgtaagggttcatacacttgctcatggtatccgtagctctgtaagacagagctggaggtaggaagagaaggggaacaggccttccacttacaccattgttccaggcccacaagagggaggcaggatggactttctgcccgacccctgctactgtcttaggacttgtgaatttgcatatcggtagcatatttctgaaatgcccttcttccctttttctctcgtctcctcgtataatccaaacttttgcatcctcaaggacctaataaaaatgacttatgctgtcactttataaatatataaatatgaagtatttattacagcatgcaactgctaaacctttgaaaactgtaaagttgatttaattttattattgaaattactgttgaaataagtaactattcaaacaaaatattaaagaataaaatcatgggctttacatgtgatgacacttaatgtgagtaataatactttagactccatttcaagcctcacataaaattttaaaatacacttttcagtatttaataggtgctgttaatagcacagtctaaatctattcttgaatttactacgtaaaattacattttttatcatgactacttttaaactcttttccaccaaggaaaattccaaatgaaaaaaatatatatatattttttctggttttacaaagttagatttaccaatttaatatctaattagtcactgtgctccctaaatttgtctcgctccattaattgggctgcccatgaatgaagcaaatggtaacaatgagaaacaagtagagacatcaaaaatagcattcagggaaacaaatataatttttgccttctgtaatatttctaggaaaaaaagttttttttcttggcagtaagaagaaatatggatggaacttaacaaagggcaaaaaaatgtcagtataaacataaggataataaatcaagtgattttagaattttgcaaatattaaaattctcattcaccgtgcaaccggtatttaaaattacactgctgcttcatttatgtgcagcataacttattttctgatgttctaaatcaagttagtcagattattctcaagcataaattacatttagggagtaattcggtactctggggcatactttaacactttcgggccattaaggtggtagtaaattccatgaaatagatttaaataaataacaccctagtagacttctgacatatccattgttgctttatacttcggtctggaaactcagcattggactgctgattatttcatcccatcccacatatttcatctttgattaggtgaggaggagggacctgagctcgtgtctcatggtccaaactgtatgtgcgaataaataagttagttatctgccccaaatcatagtaccttgctacttctccccaaccctcaacttcccaagtaatacaaatatttagtaaaagataagtatactaccaattatgaagtacttacctcctaaggttaattgtgggagctcaataaatgagtatatataaatttctttttttacatcttttattttattaatgtttttaaaaaattcaaattcaatagtctttggaatacaagtgatttttggttacatgaatgaattgtatagaagtaaaatcagatattttagtgcacgtgtcacccaagtagtgtacattacaccccaaaggtaattttttatccctcactaccttcccactctgccccttctgagtcttcaaagtccattctaccactctgtctgcctttgtgtacctacagcgtagctcccacttataagtgagaacatacagtatttggttttccattcctgaattacttcacttagaataatggcatccagctccatcaaagttgctgcaaaagacattatttcattattttctacggctgagtagtattgcatggtatgtggctgaatagtatttcacggtatatgaaaatatatgccacattttctttatccactcattggtcggctggcacttaggatggttccatatctttgcaactgtgaattgtgctgctataaacatatgcgtgcaagtgtctttttgatataatgaattctcttcctctaggtacataatcggtagtgagatttccagatcaaatgttagatctacttttagttctttaagaaatcttcatactgttttccatgtaggttgtactaatttacaatcaccagcagtgtacaaatgttccgttttcatcacattcacaacaaaatctattcaaaacctctgggatacagcaaaagcaaggctaagaggaaattttctagcaccaaatgcctacatcaaagagcctgaaagttcacagtctgactacctaacatcacacctgaaggaactagagaatcaacaacaaagccaacacaaagctccagaagaaaagaaataacaaagatcagagcagaactaaatgaaattgaaacaaaaatataaaagatcaatgaaacaaaatgttgattctttgaaaagataagtaaaattgatagaccagtagttagattaaccaagaaaaaaagagagaagattcaagtaagctcagttacaaatgaaaatgcaaatttcttaaaacagcatctggcagtgttccacaagtatgagtagtagtagttgttgtcattattagtgtacctctatttggcttaagactttaaatgcaaataaaatgaccaacatagaatctgagccatgctagtgtctctctggtggggaatagacccacccataaattagaaattccttcttgagaaattaccttctttaatttcaggacttaaagtatttaaataggcagtgtcattagcctgctgatgaaatctgaatcattatttcagcatagaatccatggttggccatgcctatccctgagtacattacatatatttactttttaaatgctttttgttgtgaaacataatatagggaaccattcatataaacccatggtgaccatcacccagaccaagaaataaaacttccagcagccaaatggaacactctatatcatagtttcaagattaatctacctctttgcttattagttgttgattaatttctcactgtatgattgtcttagtctgtttgtgctgttataacaaaatgcctgagactgggtaatttacaaataataccaatgtattcactcacagttctggaggctgggaagtccaagataaaggctctggcatttggtgtctggtgagggccttcctgctgtatcttcacaaggcagaaggtagaagggcaagagagcaagctgactgaatgctgcgtgaagccttgtttataagggtcttatttttattaacaaagaaggagccctcatggcctaatcaccacttaaacaccctacctcttagtactagcacattatcgacacctgaatttggaaagagacacattcaaactatagcaaattttactattaataaatactgaagtagttttggtttggggctattactatgctgctatgacattcccaaacatgtctcctggaatatgaacatatgcatttctgtagagtgtatatatagaagtgaaattggtgggctataggttatgcagatctttgaatttactaaatagtgccaaatggatttcactccaagaagcagtagtgtaattttacacttctatttacaattcacagaccaagtaacattgtgtgaaatttctaattgctgtatattctcaccaccacatggaattgtcagacttataaatttcaatgattctggttggtaagcagtgatatttcattttagttttaatttgcatggcctggaccattaatgggacttagaaattctttatatatttattggccgtttggatttcttattttgtaaagatgacaaaaatcttaacgttactatgatgcataaaacacattagttatttactataaagtgatcaccttaaaaatgccatccaggtcaagatacagaatattgccagcaggccacaagccctttttgtgccatggttcacttttcaagaacttttcccatttttctattggattatctgttcttttctgaaagatttgtaggaattctttataattatgaatacacacatttcatccattatgtgtgtattccaaataatttatcctactctgtgggtttcatttttactctctcagtgctgtcttttgatgtatagatgttattaatatacaaggtagtccactttattatttttattcatgattagtgcttcatcatttgtgtaagcaattttttcttaccctatattaattaacatattctcctctattttactgtaaaagctttatcaatttgtttttttctcatgtcagtttttagtcacctgggattttatttttgtatatagtttgaaacagaatatatacttttttcctaagcaggagactccattttaattttttaggtaaaacatgtgcactgtacaagataatgcatgaacagcagaaaaataaaagtgtgtgcagtgaaaagcatctgtcccaattttgatctgctcactctggtagttctgctctcactgttaataaaaattttataattttaaatatttatagaacaaggcaaagaaataaacacagtgatataaaatgatagtctcctcattcagttttactgctttcaatatattcaatgctgatatttttacaactctggattgacattatactttgtaacactctattttattgatccctaatcctccctaggttgtgagccttgttctcaggcttcaaatacgtttggagtcatactttgattttaagtttctcacagtgtttataatacttgagcttaggaactcattctcatgcctttatcccctctcttcgctgttgaaattctacacattttttcccttatttctcataacttcacttattgcattctgaataaacagcaaagataaattttctttgacctgtaccaccaacatcaacacctaaagtgacctctttcccattataggggactcttctactgtgcttaatggagactaggatgtgttcccctcaaaggaattctagtttttataggtaaacttgttaaatgtcttgtatggacactgccttatgaaacctcatttgctttcaaagcttcaactaacatctacagcaggtattggcaaactttatagataaagatcttgagaacaaatatttcaggctttgtgggccgtatggtttttgttacaactactcaactctgccttgaagttcaaaaaaaaggtatacatggagcataagcaaatggatatggctgggattcaatactactttacaaaaacaagtggtgggtgtaattggcccatgggcaggagattattgactcttaatctaggctgattatgacatagctccaaatttcagcccttatctgaggtatatagccaactgctacttggactatcctcatcagaacatttgatgtgaacctcaaagatgttatgtcaacaattccttattttcccatgcaagtctttgatatgatttggatctgtgtccccacccaaatctcatattaaattgtaatccccaatgttggaggtggggcctggtgagaggtgactggatcatcagggtggtttctcacggtttaataccatcctcttggtactgtcctcatgaaaatgagtgagttctccaagatctggttgtttaaaagtaggtagccacccacccccaccaccaactctctctctctgctttcgccatgtgaaatgcctacacctgctctgccttccaccatgagtaaaagctccctgaggcctccccagaaacagatgttgctatgcttcctgtagagcctgcagaatcgtcagccaattaaacctctttactttataaacacccagtctcaggtatttctttatagcaatgcaagaatggcctaatccagtccttagttttaattttagtcaatgatttccaagctagaaatcttgagaccatcgtttacttctcgacttctttcttatcatgcttgtctctatattttatcaattctaaaccagaaatgactctttaatttagcctcttctctctagccccactgtcgtggcctttcttgaaaactcctaataacttttcctcagcatattccaactcatctctccctattttcggtttctcagcgctctctaacagacaacctcacttcctactttggtccctatacaaacattcacatagcccaccatgtatactgtactgaaaacatagaaaatctgaaaattttcataacaaccaaaattccttttttactgtgggccttttgctgtattttagaatgacaccctatctaaaatgtcactattccataaggcttctctcccttggaattagttacttcataagacaagcttccacagctttgtgaaaacctctattaacatactacttcatgttctaattatgtatttacaaggctgtttgttccagtacactatgtacctcttagaataaggaagatgttttatgcacctttgaattcctggtactaagcgctgttcctggtacatgataaatgttgaatacattttaataactgaatgaatgaataaaaaagtccatgagtaatttcacaaaccccttatatcttccatttaagagccatgaatgcttggatacactattttacctctgagtctcagttatctcacacataaacccagaataatactgcctacctcattcagctttttcaggaggatgaaagtacactccaagttataaatagcaataaaatttagtattatcgatattaatacagttagtaatctataaatttttaataccgacacagaatttagaataaaaaaatcaatctacatcagaaatcattttccaaatatatcagcaatcacataattgttgttttcattaataaaagacacaaaatgatgattcttaaagataaataatttagcaagttcaacaccatcctaaaaagaatacactttgcacaaatttactgagacctaatttaaatatgaggatgcacatttagggactgtgactcttttaaggtgagtgttttaaaccaaaacaatattgataaaattcaccctaaagaagtcaatagcattatttaaaaacagatgattggataaagaatatgtggagatatatctccacatattcttttatttatatgtgtgtgaatgaatgtattccattgtgtagtattccattgtgtgtctatcctagcttctaagtctaagcatatatatatatatatatatatatatatatatatatatatatatatatgtacacacacacaaattgcgtatggaataaacaatttcatatacacaatgaaaaatactacaaagccatagtaaagaatgaaatcatgtcttttgcagcaacatggatggaactggtggtcatcttaagtggaataactcaaaaacagaaagtcaaatattgcatgttctcacttacaagtggaagctaaataatgtgtacacatgcgcacagagtgtggaataatagacactggagactcagaagggcgagagggtgggatgggggcgaaggataggaaattgcttaatggagaaaaggtacatcatttgcatgatgggtacacaaaaaaccagacttcgccactctgcaatatatccatgtaacaaaaatgtacttgtataccttaaatttatacaaacaaaaaaataataaaattacttaaatgttgattgcattatttgtaagaactcacaaacaattcaggttatcactaagactattaaaataaatcttaaaattctttagatttctaaagtgttgtttaaactttgctggactcttattgggcttaaatctctagacaggcagatctgtggaggaggacgctgtaacagaaaagcctcatcaataagctgaaattgctttagataaacgaggactttttgatctgaaagtgcacacaaaaatacatatactttaatatgtatataagtatacacacatatcagaaacttggcctgagtgatttttagggggctaaggggaccttaattaagcactctattttggcttaggggaaaacaccgtaaatatccttgagataaattgataagtactcaaatagttagagattcatttctttacctatgcttggtatctgattatttaactccttagtaataacaaagaaagcaaaagtgtccctgatattactattgtctagaactccgcaaattttctttgcccttctcttttataaatctctttgacacaatataatgttccagcagacaactgacaatgtaaaggttgtgatatttgaaaattccatcatgatggaaaaatattcagggtgtactattcctgcactgcttctgaaaaaatatgtaggattatgctaatattaacctaaaattatgcaatttcaatgtcttgatttggcacaattagcaccctgtaaaaatacccaaagtagcagaaatagtttgctattagtgatctgtaatgctacttttaataccaagaccttttggagaaatcagctacagaaactgactcagcaggctaagttaaataatttaaatttcttaataagtttaaactgacatactctctgaggatttgatatattcaagggtctcctttataaaatgtgagcatttaattgagtcttaatttacatatcctctactatatagtccacatgaagaggatatggtgttagacatcctagcttccaagtcttagctttcatttgttggctagaggggatatttgaaataatgatgcctttctcttcattcaaacacaaaacatatataataggtgtaggaacttttacccagaaataggagcaaaagcaaccacaaatatatgctatgcactctaattaaaacttcagattaagtacatgattaaatatactccacagcaccttggggtaggtactatcattttattcattttgcaaatgagaaaactgagactttgggagtctaacttgtatgtttctaatcaggaatgcaagacaataacatagctgaataaggatagcttatagtgtatgttttttgtttcttgttttttttaagtgtcatttgaatcagtaaacactgtattagcttgtgaaagagaaaaaatcctacttctcctataatatactatcctcttggaaataaatcatgttgttattggatagttacactcacgtgtttctgatcatgaaatttatatttcaaaggaatggattaataaataacctaacctcctttctaagcagcatttgctcaaaataacatatttctagacacttctcattatatatcatgacaagtacctcatactctcaaatcaaaatggaatttctcttgatttttcagaaacatccttggtggttcttcatcttttggtttatttttgtttatattattccttttcttaaagtatcgttgcttatattgtcctaaatttttctataccttcctccatgagaacctttctgatactaccaattagaagtaatccctcccctctttaataacactctttttattagggtgattatttttcttgattcttttttgtaaccaccttaatgaagtatgattgacatacaaaaagctgtacatattttacatatatatatatatatctcaaagagtttcatcatatatatatatatatatatatatatatatatatatatatatataaaatcaaagagtttgggaataagtatacacccacaaaaccatcgccaccatgaaggctataaacatatctgtcatcactcaaaatttcctcttgtcccctttattattgttgttactggtggtaagaacacaacataagatttcttaggaaattttaagtgtccgaaacagcattattagctataggcactatgctgtataatagatctccagaattttatcttccataactgaaactttgtagtctttaacactccttttgtcctgctttaaagaatttattctactctaatttacattagtgtcattacgtctaaaccacactaaatgctccctaagggtagaaactatattgaatcaccatttttacctcctataacaggtgccaaaaaataatgttgcacttaatttttgcagattcaaatttatccataagtaattttaatacaaataattggtatccacttcaaatgagtataccttctgaaaagaaacatggttttttttgttttgttttgttttgttttgttatttttgagacggagtctcgctctgtcaaccaggctggagtgcagcggcgcgatctcggctcactacaagctctgcctcccaggttcacgcctttctcccgcctcagcttcccgagtagctgggactacaggcgcccgccaccacgcccggctaattttttgtattttttagtagagacggggtttcaccttgttggccaggacggtctcgatctcctgacctcgtgatccttctgcctcggcctcccaaagtgctgggattacaggcgtgagccaccgcgcccggccaaaaacatgttctttagaactcccaaagtatcatcttttagtatgaagattttttttgaaattaagaacaagtagtaaaacaatcaggttgtacagcatacaaaatttgaagacaagcaaacgtgagtttgaaattctgttttattgcctaacagtgctttgtaaacttcagcaagtgatttaatttcctgatttcagagttctcatttgtgaaataggcataatatatatttcacagggttgttataagaattaaaaataatacagtgaagttttctgagcccatagtaagtgctcaatggtggcaataacaataatcataatatccaaatatatatacagtatataatttctgttatttagaaaatattaagttatcaaatacatgtacacatatatgaatattttcaatatctatgaatgaggaaaatatgtataactgattttatacatttcctcattggcacatgaaagttgtatatcttcagctaaatttagtcttcttgccctttaaggctcaaacattttactatgtgtaaatgattttactgctattgtaattgggcaaaccaaaacaattacagtaaatggaatcatatgtctttgtttcgttctcaacgagggaggaacagtacacttaacacagctacaaaaaaatttaacttacttttttctgctaaaggaaaatgagatgaaaaagccattttattttaaaacgaatggcagattttgatttcgaggcaagtaaggcaatttcgtgttatcttcccaaaagtatggtgagaatacgaattccaaatatgcggagtatgaataaaaaatagaaaggtatgacatttttcttcttaggcagccaaaatgatatttcttccataggctgctgcggcaaatcaaaatacaccacttgagatcagcttacgaaaatgtcccttttacatgggactcattttctttggccataaaaaattaaagattaagatctctgtctatctttgaatatatatggcatgagaccacacttacaaatacataaataaaactgaaacaattcactttttacttagctttattctaaacgggaaattctattttctctcttactactattctactttctctattttctctcactggcaccattaccttccacaagactgtttttcctgtgaaggtagttataattaacaagagcctatacacacataaaagttttcatttaccatattagtgaacatatcaagctatcatttttcttaatgtttactaagttttactttattgaaaccaatctcaaaggttgcagcatttaaaaaagtgacatttataattctcaattataaaataattttccaaagaaagaaaaaaattccaattttacttttataagttggaatttactatatatacacacaaatatagtatgatttgtgtgtgtttgcaacacacaaatatagtattattgaaaaaggaggaatttagatgttccaagtggcattaacagaaaattagttctgaaattatgccagattagcatttcaactagaaattatgccagattagcatttcaactagaaatagcaaggaaaaacttctaggctataagaggtcataagtagtaaagaaaataagaactattttcaggagacatgacctattctgccgggagttgcacccataaggcagagggaacgggtccaaaatattttcttataaaaatagagatacagtaattaatttcaaggcagatttcagtttatctatttttgataaatttgttaaatcaattaaatatgccaggggccccttattaggagtatggctgtaaggctaattttagtttgaatctactgacaccataaacattaagaggatttcacccccactcctacccactccctagcctgtatgtaactgtgggagcagggcagttccaggatgacaccatgttagaaagacaacttcactgcaaatttactgaactgaaatctgacccaagtatagcagctctaagtcaaagaaaatgtcatcacatctgacttactaccttatgagtaaatatcatcacaaaagtcgggccccttttgctattttatattctatcttattaaaacacaggtgcacgagggaaatgttcttggcataaaactactacattcattaaattttttctttcccacaccggaaggcacatgtctaaacctgtaggggttgctttattatttaattagagcagattcttttctatcattttaggtgtttcatctaaagtttgattaacatcagtatatgctgtgctctcaggcaagtaaatatagctgccgtagaaagagaaataagcagaagcaacattttaaaaaataaagaataacatgaacatggaaagaaaaagaacctttaagaaataaaatatccacaaagctcactagaaatgcttcctaaacgtgtatgaagcgtatgtgtttgtacattttatttcaccactgattcatttactcaatcttttgataaacatttattgagcgcttagtcctgaggctagcagtgtgttgaattcggaaggtgtaaagctgaaaaagatactatctctatcaatgggcaattgacagtttagttgcacagtattttaaggagggtatgaactgaagttgtagcacatgctgtacttgctccatgcacttccccttgcctttccatttcaaaatacactggtttgacttccaaatgccagcatttggatttcattacctatggaatctttctggttgcagaggtctgatgctgatgttactggggtggggagcatatttttcaaccagtggcatggaaggaatggcccaagggctagttgggcaagatgtactagatcaacattatgaaggttcatgaatatcaaagtttttgagttcatttatgcagaagtagtttattgcaaaagagtaccacacaaaataaatagctgcagatctttcacaatacaataaattaaaaaaacttcttggagggggagaatatatagagcattcccaatccacttcctggtacaatttctttttcttttatttatttatttatttatttatttatttatttatttatttatttattgagacggagcttcgctcttgttgccccagctggagtgcaatggtgtgatcttctctcaccacaacctatgcctccagggtggaagagattctcttgccttagcctcctgagtagctggggttacaggcatgcgccaccatgcctggctaattttgtattttaagtagagagggtttctccatgttgctcagtctggtctcgaactcccgacctcaggtgatccgcccaccttggtctctcaaagtgctgggattacaggcatgagtcaccacacccagcccggtacaatttcttaggcttcattttgtgccaaaattgtatatatatgtaagctatacttcaccatgttttccattaaccctacaactgcgatttcggcagcttcatgcttctcaagagccatggtatgggtcacagtaaaactggctggtccaccaaatagacagcagggacggcagtggtgaatagtcccatgaccacgagagaccagaaagaattagttgtctatagctactcttgtctgtgagattatagttcattttcgccttgaaaggaaggttttagttatgttgggtcaggaaaagacagatgggttattatttattgcctatcagttttaaccacgtgcaaatgaacgttatgcaagatgagagcataggagaagctagaagtctaatcagttcttgaagaaggaaagtgaaattgtgacatttgacatttaaaaatataattttgtaagctataaagaagggggtggtgagaagttagaatagtggtttgcaaacttgctgtacaatggagtcatccaaggatcttaaaaaaaaaatacaccagagatctgattcaactgatttgggacatggccagggcatcagaattttcacccaatattttaacataacaaatttcaaaaatgcaataacatttttaaaaattacaagtgatatctatatatctagattccaccatgaacattttactatactcgttttgatcacatatcttttccttcctccgatccatccatcaatcaatcatatttttgatgcatatccaggtaaactgctgacatcagtatcattcaccttaaatacctcaatatggatatcactgaatagaattcataaggtttctttattattatgttattatttactgtatttggtgtcctctttaccttatggccaattcaagtaataactctgcaaggtagttattacttagaaggaaaaaaagattcagagacattaagtcatcttttaatgttcacatgggaagtaaaaggtagagttggattcaaatccagctttcacttatcccataaaacagtggtccctgacccttttggcaccaggaactgattttgtggaagacaatttttccgtggaccgggttggaggatggtttccatatgattcaagtgcattacagttattgcacacattatttatattattatcacattataatatataatgaaataattatacaactcaccataatgtagattcagtgggagccttgagcttcctttcctgcagctagatggtcccatctggggggtgatgggagacagtgacagatcatgcagcattagattctcataaggagcatgcaacctagatcccttgcatgagtagttcacaatagggtttgtgctcctatgggaatttaatgtggctgctgatctgacaggaggtggagctcaggcagaaatggagtgatgaggagcagctgtaaatacagatgaagcttccttccctagcccgctgctgctcacctactgctttgcgaatcgggtccctaacaggcaacggattggtacgggtctgtggctctggggttgaggtaccctgccataaaatactatatttttttcatttttccaaatgtctctaatgctatgagggtagaagtggaaaggagtcgaattagatatttaatttgaagtctacccattacaattttggaaggttagaggccaaaagggggtgtatcttgttttattttttcaactttttctaacatgacaactgttgaaaaataagtatcatgtacaaaaggtaaataaaagtggccttcactttgttttcatttggagtatttattcatcttataatgccttaacatggatttttaacttaatgaaatcgcccttaaatttgtcattaacagactattgttttagttttagtgttttttaactatgaaaatattgtcattgtattaaaaaataagaatttccaagttacaaaatgacagtgaaaaaaaccagccataccattccaccctcacataacagctatcaggatgaagaataatttttctctttatcatttattagttctctaacctaattttttaaggaattcatttaaaatcatggtaaaataaaatgaaaatataactaataagatagtatttgaggtgataggatttcctcctcagcaatgaaaatcttacataatcatttaaagaccggtgaagtgctgaaaatcagacaaaattacaatgtgaaaatcatcaagaggaaacaagtctattttaaaggaatgccaattagactgacaacttaccgttcaacagaaaatatggaagcctgagaacaatcatgctatcttcaatgtgattaactggaatgctgtttggtaggacatgccatcctcagtttaactagattattgctaaattacactctaaattggttgtaccaacttaaatttctacaagaatgagagtttgtgacctttcacaatcttattttattttttacttgttccagtccgatgggagtacgttatctcacttagtacgatatggtttggcagtgtccccacccaaatctcatcttgaattcctacatgttgtgggaaggacctcgtgggaggtaattgaatcatgggggcaggtccttcccatgctgttctcgtgatagtaaattagtctcatgagatctgatggttttataaaggggactttctttgccttctgccattcatgtaagatgtgacttgctcctccttgccttctgccaagattgtgaggcctccccagctgtgtggaactgtaagtccattaaatcctttttcctgtataaatgacccagtctcatgtatgtctttatcagcagcatgaaaaccgactaatatgaagtaatttttccaataataaatgagagttagcatctattcataagtgtatttgacatacagatgttctgtgaactgtctattattttttaaactttaaaaatattttcctgttaggttatttttattttgttctattgataggtaaatatttttcttaaattatgacataaatcctttattgttttagtattgcaaatatactatctgagcctatgtcttttctttgtttatgaagtctttgcattgtacaggtttttaattaaaatgatcaaatatatgtctttttctttacaatttttgctttgtgctgttgcttaagggacacctcttttgccctacatgccccaaaatatttttatatattttaatgctttgcctttcatgtttaggcaatccatcaatttaccatttttatgtttatgtacagtgtgagatagggatctaattcttatgtttaataaaattttaaatggtacttctgtctgtcatacatgtcatatattatactcttacacaataagaataccacctctcaatacattcgaatacattagattttttttttcttggtaacaaaattcctggagcactattttcttctccaatctgtacaggtttctctctacaactgttatacagctgttgttacaggatctcctccaccatctttctggcaccactttgcatcttcctcccacgttgggttctctgttttccggatcctaggctttgcaggtaatactaatgctccaatattttcctaattctcttacctctcttaaaaatattagtgattataatcccctgtcccctcagagttaggcatgaccacgtgacttcctttggatgatgaagtgaaatgaaaatgacatatatcactcctacatagaggcatgtaagagtcagtttaaaattttccacgcatttttgactgacatggtgaacgctaaagcttcttattgttacggtagaatgatagaatactagagactgaatcagcttagattcctgagtgactacaatgatcagaacccttgactgacttgtgttggatatgttgcaaagatacaaaatcaacctttgtgtttctagccactaatattttggaattgcttattattgcagcataacaaggcgaatcatgcctaaaacactctccttctgatctccaatcacaactaaacattctttgtctttcttggtttctttcttcacttggtagagtatatttttgaaaatagatttctggggaaaaaaggtttaggggagtacataaggctatctctgaaaattattttctccgcacaatttatagtttatcagggtgtacaatttatatattgttgaataacaagtcattccaaaatttagcagcttaaaaacaaaaatgtttattatttggcagtttctgaaggtcaagaatctgagagtggcttagcagggtgggactggcatagcttattttatgaggttgtagttaagctgttgtctatgcttgcagcctctcgagatttgtctggtgttaaatgatgcacttctaagctcattcttgtggctctttgcaggaggccttagtttctcagcatacgtgcatctccatagggctgctcatgacatgtgttcccacagaagaagcaatgcatgagagagagagagagagagagagagagagaaagagagacacagagagagataggcgtggatggagaacacaagacataaaccacagtctttctacaacctacacttggaaatgacatatcatcacaaaagagtcactgaatctagtccacactcaatgacagggacatttagctgtaactcttgaatagaagagcatcacagaatttgtgaacataatttcatataggatatgaaatcaaagccaaagttaattattcctagaagtttaaaggaagtgttcctttctgctattttccatggctattgctgaaaagtccaaagccattctgatttctgatctgtgaacttctctttgtccttgtttttgtaaaaatttatgatgatgagccttggtgtagatttttagctcatttgctgtgctgggcatttagtaagccctttaaacctggacactcattttcttcagttctaagaaaactgatgttgtcacttctttgataattttctctccacagttgcctctcttctgttttatttttaacatctattatttgaatgttggattacatagaacaaggtttctaaacataaacactattgacactttgaaatgagtaattcttggttgtggatggctgcatggtgcattcctcttgcgtcactcttcacaagaggccagtagtacatcctttccttatttgtgacaacgaaaaaggtctccgtacattgtcaaacgtcctctgcaggacaaaatcacctctatttgtgaaacacttacctagaatgatcttctaagattcttatactctcccattttccatgcttttggctatttatactgctttatgagatatttcttcaaatttatcttctacttttgaacttttatttctgctcttcatttttaatagacttgattttttaaagcaattttacatttatagcaaaatcgaggggaaagtacagagatttcccgtatactctctggcccccttcctcattacacacagcctaccccgctatcaacatcccacaccagagtggtacatttgttataactgacttacatacattgatatatcattaacactcgaagtccatagtttacattagagtttgcttgtgatgttgtatcttctatgggtttggacaaatatataatgaaaggtatccaccattatagtatcacacagagtagtttcattgctctaaaactgctatgcataccatgtatgttattccagtggtggatatactaaaagctctgccttcaccactataaaatatattcatataacaaaattacactggtaacccataaatttatacaattaagaatttaaaaacttaacctgctatactattaatttaaataacccttatctttctcggaaataccaccttctatagtctcttgttctttcttatgaatacagtgactagtctcactgtgagataataattttatagctatctttaaaaagttttcttaaggtctatgccttgtctctctttctgcagagatttctgtttcatttatgtggctattgtttttttcccaatatttctgctttttgtttttatgttggtttctgtcttccatctttgagacatgttcaaatatctggaaatccttgattgtctcttaaaactgaggcattaaatgcttttggaaattccttgtgcgtatgtagggcttatacttggtgggcttcaatatatggtcattaggcacagatctggctatttcactggtggatcattacatatcattaattgtaggttactatgatctgagtgtgttcttgcaaaatttatacgttgaaatcctcaccctcaaggtgatgacattaggaagtggggcctttggaaggtaattaggtcataaggccaaagccatccagaatgagaatagtacccttacaaaagaggcccaagacagttcccttggacctgctgccttgtgaggttacagtgagaagacaggaaatgagctttcaccagacaccaaacctgccagtgccttgatcttgaacttcccagcctccagaacggtgagaaataaaggtctgttgtttataaggcatccagtctatggtattttgttatagcaataaaacttgactaaaaatagttttcgtattgcaggtaggctctcaggagaataaatttataatctactgcccagaggatagaaacttaagagccaagaaggtgaagagggactgctggtctcaccattaaatatgttgactttaacttaatcctgtattttcagtatggtggctctctcttccatcaactaatcctgttgtccaaatgccaaaagttgtttcagcctcaccagaaagcaaaccactcactcacgtctgctgggatgagagaggagtagtgtctaattaactaccctgagctggggacatgaaatgtaattgccccttttaagggattcaaaacaacccctttatttccagcccctctcgggaatatatggccttctaaaacacctagcgtcttcaatccacaagtttttctgggatcctgaaaaacaaattggcttacttgtcctaattttcatctcattgacttgatatgtctgtgcagatgtctcttcttccattttatttgtcattttatgactgtattgtttttattcccttagcgtaatctttgaacaatttgggagagagagaagataaatgtatgttttcgattgtcatttctattggaggtccatgttcacgtttgtgtcttgttctctctcctcaggtatcctcatctagcatttagtagttgcatgtgcatcgcgtcccgtggtctccagccacccctttaaggtttaaagttcttgcactgcaatgttactggggataatttcaatccattcatcaagcaagagaacagatgcaacacagttcccagcagcaaggctatgtctttattcttacacctacataggcccataagtttaggcaagccatagcgtcaggctacagcctgaagaagcactttttccccaggttttctttcacgaatgcaagcaccacagcccagcctctggttttgaatactgagtttgtctccagttccacaccttgcttgaagcaattttaatcccaactatcccgcagcatccaaattcctggcttccactgttgttttgtggttcagtgtcaagtctgtcagggacttccgccccattctctgctttacatttctgtaaatatatttctgtaaatacacatcatgatttgatatgtatttgattatcttgtcatcaacatatatttctgtaaatacagttctgtaaatatatccttttttattttctattttttcattgctgtattttgggagcagatgaggataacacttggattagaaatctctaatcattttgcattggtttttataataggtaccagcataacgtatatttttccataaggcatatacccaatagagggaccactattttatagccttaagtggaagctctgttatgagacatatgtgtctcaacccagccggttctatacagtttacaagaccaggtagatcatcatgctccccagagagacccaagataagatgattagggttatttttctagcacataaaatagacttccttttctgacatggaggcctgaatcctaaccaaatttccttggtaactgcaacaagaactgtctacatattgttccaattccaccttcagtccttcagggaacagtgtctggtgtgtggcctatgtaacattacacagcactctggagattccacagatctgcaggcctagtaacaaaaatagaagttcaactaaccaatcaaccaacaaggatcactctgggccacctaagtcctgttacagaagacaaagtaatgatcagtctcatcactcccctcctttaaacttcagtgtccttggtactaataacactcatgttggaaataaagccaatagaatcattctgcatatgctttattacctgaaataccacctttaacattaccctctgatgactttttaacagttaacttcaatgtctagcacgttgctatatgtctattttttttcaataatggaagcactagaagggaaatggcattattatgtacacgaaagatttatatacaaagagtatgtaacttattttatttgttaatacttttgctacttttccaaataagaaaaggtaaaacatgcaccctataaaatcacatggaacattttggttaaaaatgcttctgtgtgttctaaaacattataatacttcatttcttgagggttggattctcttatcatcaataataatatcatgtagttagaacgcattggcatagatatataatcattttatgggtccgtgaaatgaggatagaattgggaggtcacaatttttgtagcaatatttttgttattgttagtttttttgtggtactgaaaagaaagcaagcgaagaaagcaaggaaagcaaaggaacgcaaaggaaaaggaaaaggaaaaggaacagaaggaaaggaaaggaagaaggaaggaaggaaggaagaaacaaaagaaaggaaaggaaagcagaagtaaagaaaagaaagaaaaaaagaaaaaccaagcaagcaggcagacaggcagacaggcaggcaagcaagctagttaagtaagattttagataaggaaataaataggaataaataggagatgaaattatatgatcctagggctagggtaaagaaaagagcaaaaaggccataaaatctttctgtagcgtaataataaaaataacttcaaaagtgcttgggttgatgatagcctgacaaggattagcttgggtacataccaattaaagacagctggtctagaagctggtttcacatgatgctacagtaaactggtaaagcaagtattaaaacctaaggaacaaactctcctgtgatatttactggctcaacatcttaaggataaaagacaattatatgatgttaattaagacagtgctatgctggtaaatgtctaacaatcagatcccctgagaggaaggacatatttgaatattcccagtatgtttaattttaagctatcattataatgtcaccaaacatgaagttagcactacaccattatacagtcattccattatacaggtaacaaacccgtagataatagtgaaatataataaaagaattaggtagtgatgacttttgtgcatctagtacatttgtgaacaatatatttcatttaatgtaagttaccataatttaatttttgataatggttgtgtttaacagatctcaaaattcttgaaaatttaacaagtatttccagcacatcgactcaagttaaacattagtttatcacaatgtacacaaaagaagaggttcttatcagtacctatcccatacatcattaatttttcctattcttctcaggtattagtttatataaaattttgttttctctttgaaaataaggagtcttgcatttgtatgaaaattctaacaagaggaacgaacttttttttttttattatactttaagttttagggtacatgtgcacattgtgtaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccaccccacctatgagtgagaatatgcagtgtttggttttttgttcttgcgatagtttactgagaatgacggtttccagtttcatccatgtccctacaaaggacatgaactcatcattttttctggctgcatagtattccatggtgtatatgtgccacattttcttaatccagtctatcattgttggacatttgggttggttccaagtctttgttattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcattactctgatggccagtgatggtgaggattttttcatgtgttttttggctgcataaatgtcttcttttgagaagtgtctgttcatgtccttcgctcactttttgatggggttgtttgtttttttcttgtaaatttgtttgagttcattgtagattctggatattagccctttgtcagatgagtaggttgcgaaaattttctcccatgttgtaggttccctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagtcttcccagcaccatttattaaatagggaatcctttccccattgcttgttttcctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcagctagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttctgtacattgattttgtatcctgagactttgctgaagttgcttatcagcttaaggagattttgggctgagacgatggggttttctagataaacaatcatgtcgtctgcaaacagggacaatttgacttcctcttttcctaactgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtatgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgacggtagtttgtatttctgtgggatcggtggtgatatcacttctgttaactctacaagtcaaacctgaaatcatggctcacaaccagcaccacctaatgtcaggcattggaattgcatatgtagagcccagaattggttttccacgtacttcagagtcaaatgtgaagctaaatgcacacacacccacacaccctacagatatggccaggacccaccccagaccaaataaccaggatatctaatttatttttatagccatgtaggtaatttaaattcagttgttgaaccaagtttgaaaacgattgtcaaagaaagaggtattactgtaattctgattttaaaattttacatcatgaaaatcttcaaagacatatataagtaaagagaacagtatattatggacccccatgcacctgtcaccaccttgagcaattatcaacatttgcgaatcttgtttaatcttcctccattgctctttatattaaaaataatttccttggaagtttgtcaaaacaaaacccacgaatcacattacttcacctgaaaatactttggcatgtatctagaatttctctttaaatagcacaatctattatagtagcaataaatgccaaaaatcgttaagtatttcttttaaatattgagccagatatgatggtagttgctgcagatgtgaaaaaccttagtgacaattattttttaattttatcttacataaagccagttagattcagagacacatttggtcaaactttgtccttgacatataaatagtgtttctttcctaaactttccattatctggttaatttctcctaaactttccattatctggataatttctcctcattttttagaactcaattcaaggatcatctcacccggatccttccagactgagacccccaaactgtgttagacagtcctgctttggtatatgcctagctcccaaggcagacatgaactgaggactcgtcactgtgcattaaaactgtgagttcataattcctttctgtatatataaatacagaaatcagggtttatatgttattcagttttatatttctagccctcagaatcatagtagggtcacactaatctttgttgaatgaataatgagtctatgaatgaccagtttgacagagtttaagtgtggatgtcaaggataaatgaagaaattagccaagtctgctaatatgaagatgtatatttaaatgagaagattttataatcttacactttcataattatgaccacattgatttgaaggttttatgaagagaaagaggttatactaattatttgagctgtttcttttcataagtgattgtggtcagccaaaattaaacaatgatgctacgaagaaagattaaggaaggatattatcaaacagccccaaacctgccagtccttcatggtttcactgtaaatgctcaggtacagccaatacttatatatgaattttaataatcaatatttaatgaaaatgccgttcttaaatttatctcatatttgtggtagaggagatttacaaaaaaggcattgttaacattagttaaaacacttatacaactgttgttaaataaaacttctgaagtcatatagttatttatttacttgtataaaccatcttatcatattcttttttggagctgtttacatatcttttaatctctgaactaagaaattaaaattgtatttgacaacaattagtgactcaaattataattaaaatatatgttgttacacacctcgacaagcaagcactcagaaacccactttatattctgtttctattaggatactaattatggcactattccaaaaaaaaaaacaaagaaacaaagtaattaactcattgcaaacacaatactattaattttaactccttggttctcaataaaatttgagctagtaaccacgtaattaattattaattgctcagtgcactccactatgccaagttaattatcaagaataacttggtgtgacttttattatgaatggataattacaaccttgtttttctagaattatcaggattttaaacatgaaaataataatgaaggtaaagatataggcattgctcttaaatatgctgatatgctaatcattatgaaataataggatgttcatttttataatagtatcattcttatatagggaccaagacaggatagaaaagtacttagaaagtactaagctaaacaaataagttaacaaaggatgaatcttttatatataatgatatatattcgtgaagtgaaaggccaattcttagttagacattagttttattccagcctaggagaattctcattcattcccatgctctaccataagaattacaaatatctaagtacatgtatgtataaacatttgctgaacctattttggttatgcattaaataatctttaaatgtgaacacaacagtaaaacatatgttttgttttcatcaattttatttcagttactgagtcagaactgcccaactgaataaagttttgtaaacatatagctttatagttccttaaatctaaatctactctaattttcaaagcacaaaaaaatacaaagcttatcaaatatcctactaaaatgttcctttgaatctatggtctcccatttgtttggtgatcaagagctactgttcataatttcaaagaatcttgaaataacaaagtggaaaagtgcttgaggaagagaccaggatacactgacaagtagctcagagtgctaatggcaagggtcagaatcatagctgtattatgcctattttacttatgagaaaattgaggttcagctaaaacttgccaaaaattcacacaatcagagattgatggagccacgattcaaactcaggtcaatctaattccaaagccaagctcttaactgtgtctgagactcacttatccctggaaaagctacaaatctggctttctcctgtcaatattcgacacaaaatgaaggcaacctttatacaagtggcttttatttctttctattcttgtccttggttcaaggatcgaacactcaaggagacctaaatattttggaataggagccaggataacctgtcctcagagatgcttccttggctgcatcacctagccataagtactccctttttgcaggaaaacttgcaaccctagaaccataccataccaaacttccttcattttctgattaaaactattttgtacataatgtcccactttttttgcatcacaaacgccttgaaccattaagtacacaagtatattcctgggaagatgaattaaggtcttcatcttgttcttagaaagtatgtgtttattttctgatagcagaaataataatactttatagttttatagaatcttctcaatggaggatttttaggagcttcacatgtatattactgattgcggagtgtttttattgcatatatctcagtgggagtattggaaatgggtttttcaacatttaaatatatgccatttaaaaaatcccacttcctcttctgcttacaatctattctctgtcttcaaagtgataatattcacttaatgtcgactttggaaacacataataaaaatggtaaatgtggattttcctcactctctttttagctaatattgtggcaaatgtcttcttccctttgtaagcaatattttctctcttttctattaagctttatttgcctagtttagcaggttttatttttctcctgcttatcgtattcctatccatgcgggtcaaaaggaaattaatgagctcttgtttcctctgacacaaaacatttttcttggtacacagttctgcctccccagtgttttcactctggacatgacggaaacagtgaaaagcaataggagatgggagaaggcattgcattcgcaatcaacatatggtcagccacttccaatgagttttcagcactgatgaacactatcactgctgtcttaagcttatgctggtgtccattactgtccactggctgctttgtgaaactacatctcctggctttcttcatacctcgatggtttttgtgctccttttcagggttattccttacccagtcactaaatgcattaaaagtacctcataaaacaggatgacttcatgtcctttgcagggacatggatgaagctggaaaccatcattcttagcaaactaacacaggaacagaaaatgaaacactgcatggactcactcgtaagtgggagtggaacagtgagaacacatggacacagggaggggaacaacacacactggtgcctgttgggggtggggggctagggtagggatagcattaggagaaatacctaatgtagatgacgggttgatgggtgcagcaaaccaccatagcacgtgtatacctatgtaacaaacctgcacgttctgcacctgtatcccagaacgtaaagtataataataattaaaaaaaaaagttcctcaaagatttgtcctgatcaatcttctacctacagtctctctttaggttattgcacccactcacataactttaaatattatttacatgcctaggtatcccacgtatgtatcttggtcacagatatttcatccacgtttcatgtagatgtttcagatgtatctcaaattgaatataaatctagaaaggtctccacctccaaatctgccccttcttttctgttctccagctcaatattatctaatatgctcagggatcatccctgacacttcactgtctttcaactccactttcaaatctgtcaaaagttgctactaatagctccattaacataagtatcaaagacatgtttatttccacttccattgccatctcaaggcttggtctatgctttggtattctaagtggccattctgttttcagggaggttccctaaagtacattgttttcagcaaaaacaatgattatgtcactaccttgctgggtgaggtggctcatatctgtaatcccaccattttaagaggatgaggcgggaggattgcttgggcccagtaatccaagatcagccttagaaacttagaaacgtaacaagaccctgtctcttcaaaataattgtttaaagttagccaggcatagtggcaaatgcctgtagtagtcccagctacccaggaagctgaggtaggagggtgatatgggaggattgcttgagcccaaggagttcaaggctgcagtgagccgtgatcatgtcactgcactccagcctgggcaacagagtgagattgtgtcttgaaataaataaataagtaaaacaaaatttaagaatcaaaaaataaacttgtaatggttttccgttgcacttagataaaatctatacttatttttgtggcctacaatgacttgtacaacgtaaaacttgccacgctctccctctctcaccataccccatacacaagggctttcttttagaatttcgaacattccaagatctctaccaacatctcaagactttgttcatgtgactccctacactctttactgagttgcaggtctctgcttcaatacttttcctcacagataattactctcagtctctagactgcagcatttctttttgttagaatatctcatagctccttatacttttcattcatagcacctactgcggcttgtaaatatacactcatgtatatgattattgccttaaaatacattttcccccactaaacattcagctccaaaaaggcagaaacaatgtgttctttgttaatttctgtagagtttttgagacaggatcagaattactatatgttgaataaatgaatacagaaataaaaataaagattatgatgcctttgctcactgatatatagtgccatatatatatatatataaacatatataaataaatatataaatatgtgtatatataaatatatataaatacaaatatataaatatatatatataaatatataaatatatatataaatatatataaatatataaatatatataaatatataaatatatatataaatatatataaatatataaatatatataaatatatataaatatatataaatatatatataaatatatataagtatataaatatatataaatatatataaatatataaatatatataaatatataaatatataaaaatatatataaatatatataaatatatacataaatatatatagatatataaatatatatatacataaatatatataaatatatatatgtttgtgtgtgtatatatatttatattcaacggtaaatggtttataaaactttcccgatcgattaagtattggtatggagtcagagaagtgagggaaaacagttttatctaccatctttgagatatcatggtgagatttaaggatacagagattaaatatattgtccaggtctttaagaacctcatagacagagtttatgtgtgactctaaaaaatagatgaagataagaagataagtatttaaatgaaaaaattgaggcggccaagggtttggggagcttatgactgtctttaaccctatcgacactaagagaatagaagttgcttactaactggtcacttagctgactgaaacagcttctctctttgtaggaagtttaagttccacaattactcggtgccaaaaaatactgtgtgctattcaaatttctggaggatgaaaagctacatagggcatatggcagaacgatgtaaagtgcagaatatgcttagctgaagattgtcccaaagctcttgggagatgtttatttggtgacaatcgcattcactttatattgtcagccctttgttagatcatccttactcatcagggtctgatccttgctttaattgtacttagggaattatttatctctatatcaatctaaaattgatttaatcttttttttttttttttgagatgtagtctcgctctgtcacccaggctggagtgcagtggcgtgatcttggctcactgcaacctccgcctgctgggttcaggagattcttctgcctcagcctcccaagtagctgggactataggcgtgcaccaccaagcccggctaatttttgtatttttagtagagacagggtttcaccatattggctaggctgttttcgaactcctgacctcataatctgcccgtctcagcctcccaaagtgctgcgattacaggcgtgagccaccacgcctggtcaattgattttgtcttacacaattttctcttctgggcatcactatcgttcatcctcatcttctttttcctctatgtttaaaaatgaaaactcttctgcaaaagagtttattaaagcttatttattctttgtttgtttttgagacagagtcttgctctgttgcccaggctggagggcagtggcatgatcttagctcactgcaacctccgcctcctgggttccagtgattctcctgcctcagcctcccaagtagctgggattacaagcatgcgccaacacgcctggccaatttttgtatttttagcagagatggggtttcaccatgttggctgggctggactctaactcctggcctcaagtgatctgcccacctcggcctctcaaattgctgggattacaggcgagagccaccacacctggcctattcttttttgttttatataagaagtgtagcatataataatgtgtggtggtgtggtagagataagaagtggtttttgaaaaggaaaatgatcacatatacattattcacttgctagttatgcttactgggtatctacttggccaaacaatgaatcaagtaacgaaaatgtaactgtcattctaaagaagttcacagtgtgtatgttgtttgtacatgtacagagtcatagaggtgagagagatggagaaaagtgatttaataagtaagtacacaaataacaaataacatgattcataatgtgaagggtgtttatatccacaatggaaatggaaattggtgagtaccaatttttattagatgttacccaccattgcattacatgcaattgttccatcttaaccatatcagctgcactaaacatggctcattactgctcactaataggaatacagatttatatcagcaatttgggcacatgggcttgtcttttttaactgtgggaaaatatacaaaatatttcaaccattgtaagtgtatacagttcagtggcattagatacattcacatggatatgtaaacatcaccaccatctatctccaaaactcttcatctttctaaactgaaactctataccaatgacacaagaactgctcatttcccctacccctccctggtccctggcaaccatgcaactatttgtctaagaatttaactactctaggtggaatatctccaaagttcatccctattttaggatgtgacagaatttcattcctttttaaagcagaatactgttctgctgtatggatacaccacgttttgtttctccattcttggtcagtgtacacagtgtacatttgtttctaccttttctctacagtaaaatatgctgctatgaacttgggtgtacaaatatctgtgtgaatacctgttttcaattattttgggtatatacccagaagtggaattattggatcatataatagttctttgttaaattttattttaagaactagtcttgtagtttaaaaataaagttttattggaatataatcacactcattcatttacatattgtctatggttgcttttgcaaaaaaaaaaaaaaatggcagagtttaatagttgtgagatagaccatatggcccgcaaagcctataatatttactatcttgttccttacagaataagtttgctaacttctgtcttacaaaattgcagtagcaattccttggtttcacatgaaacatatgtcttcaaacagttaaaagacctttcatgttgggaaatagaaacaggataattttattctcggcctacatatgagaaaacaaggaaagtgctgaatgccacatggaagttgcaatctcaaaggaagttaatccaatattaatatccagacctcattgttgcagctaaatctatctcatcacaaatcacagagttattttacttctttatatgctatatagaaaactcagatatactttccctatatcaatgcgatgtttcatgctttcttcttttattgaagatggggtgggaatactgcatcaagtgagagacttgagtctgggagaggctgagttgtataactgtgaaatcatttgtcctccaaaagcttggatttaaaatataacagattcacgtactatgtatgactgaaaacatacttgcctggaatgttaaagatcagggtaattttctgtctcgttaatctaatattgacagtggagtataaaagtctctcactattactgtgtaggagtgtaagtctctttgtaggtctctaggaacttgctttacgaatctgggtgctcctgtattgggtgcatatatatttagaatagttagttcttcttgttgcgttgctccctttaccattatgtaatgtaatacccttctttgtctttcttgatctttgttggtttaaagtctgttttatcagagactaggattgtaacccctgtttttttttttattttttttaattttttatttttttgctttccatttgcttggaaaatattccgccatccctttgctttgagcctatgtgtgtgtttgcatgtgagatgggtctcctgaatacaccacactgatggtcctgactctttatccaatttgccagtctgtgtcttttaattggggcatttagcccatttacatttaaagttaatattgtcatgtgtgaatgtgatcctgtaattatgatgttggttagttattttgcctgttagttgaggcagtttcttcatagggtcgatggtctttacaatttggtatgtttctctcagtggctggtaccggtttttcctttccatgtttagtgattccttcaggagctcttgtaagccaggcctggtggtgacaaaatcactcagcatttgcttgtctgtaaaggattttatttctcctttgcttatgaaacttagtttggctggatatgaaattctgggttgaaaattcccttattgaagagtgttgaatattggcacccactctcttctagcttgtagggtttctgcagagtgatccactgttagtctgatgggcttccctttgtgggtaacccagcctttctctctggctgcccctaacattacgagcaacttcagccaagtctcagaatacaaaatcaaagtgaaaagatcacaagcattcctatacaccaagaatagacaaacagagagccaaatcgtgggtgaactcctattcacaattgctacaaagagaataaagtgcctaggaatacaacttacaagggatgtgaaggacctcttcaaggagaactacaaaccactgttcaagaaaatacgaaaggacgcaaacaaatggaaaaaacatttcatgctcgtggttaggaagaatcagtggagtgaaaatggccatactgtccaaattaatttacagattcaatgctatccccaacaggctaccactgactttctttacagaattaggaaaaattactttacatttcagatggaaccaaaaaagagcttgtatagccaagacaatcctaagtaaaatgaacaaagctggaggcatcatgctacctgacttcaaactatactacaaggctacagtaagcaaaacagactggtactggtagcaaaacagatatatagaccaatggaacagaacagaggccagaaaaataatgccacacatctacaaccatctgatctttgacaaacctgacaaaaacaagcaacggggaaaggattccctatttaataaatggtgttgggaaaactggctagtcatatgcagaaaacggaaactggaccccttccttaccccttatacaaaaatcaactcaagatgcattaaagacttaaacctaaaaccgaaaaccatcaaaaccctagaagaaaacctaggcaataccattcaggacacaagtacggggaaagactgcatgactaaaacaccaaaagcaacagcaacaaaagccaaaattgacaaatgggatctaatgaaactaaagagcttctacactgcaaaagaaactatcatgagagtgaacaggcaaactacagattgggagaaaatttttgcaatctatacatctgacaaagggctaatacccggaatctataaggaacttaaacaaatttacaagaaaaaaaaaaacccatcagaaagtgggctaaggatatgaacagacacttctcaaaacaagacatttatgcagccagcaaacatatcaaaaaaagctcattatcactggtcattagaggaatgcaaatcaaaaccacaatgagataccatctcacaccagttagaatggcgaacattcaaaagtcaggcaacaacagatgctggagaggatgtggagaaaaaggaacgcttttacactgttggtgggactgtaaactagttcaaccattgtggaagacagtgtggcgattcctcaaggatacagaaccagaaataccatttgacccagcaatcccattactgcatatatacccaaagtattataaatcattctcctataaagacacatgcacacgtatgtttattgcagcactatttacaatagcaaagacttggaaccaacccaaatgcccatcaatgatagactggataaagaaaattggcacatatacaccatggaatactatgcagccataaaaaagaatgagttcatgtcctttgcacggacatggatgaagctggaaaccatcattctcagcaaactaacacaggaacagaaaaccaaacaccacatattctcacccataagtgggagttgaacgatgagaacacatagacacagggcggggaacatcacacaccggggcctctcaggggatggggggttaggggagggatagcattaggagaaatacctaatgtagatgatgggttgatgtgtgcagcaaaccaccatggaacgtgtacacctatgcaacaaacctgcccgttctgcacgtgtgtcccagaacttaaagtataataatgaaaaaaagatcagggtaaaatatattttgtcattgttttgaacatagccataggtaggatcataaaatagcacaacttaaatagaaaaataaatgattcagaatcaggtctcaggtacaaacagccaaaataattcaatgaaattatttctctatactacaaattgtggactcacatggcatcatatctgatataaataatagtttattttaaatgaatatagacaggagtggctggaaactaaaagcatgtatttcttctccataagatgaaagaggatttaggatacacttaagataacatactaaatcttgttttgccagtgtagcttctgcttggcatttaaatatctgttacttaatagaaacattcaattttggaccctaaaatatcacacaatattattcattaaaattatacctactcaaatctgtctagccatatcatatagcgactgatatttttagatcaaacccacaagtgtgaaatatttttcattttaaagactcttttacatttaatatgtattcatgctaactttttaaatttaaagcaccttctatgaaatgtattttaatacaaataccctatattgtataatttacttcaacgttgtaaattttccacgacgatgtgtatcattcacaaataatatgaaatataaaaattcacttaaacatatataaaattattggtatatttactttgtactaaatgtaatgggatttgatattattatattaaatttatattcatgatgaatataagtaaacattgagtaagaaatgttttaagaaatttgctatctgcatgaatgactattcaatacatttttattgaacatccatcgagttcgttgcgatgaatacagttttagaaaaaatactaatactctggcttcgaagactgctatgtattgaaggtctacaatgctttgaatgctgtaggaagacaagataaattaggacttttgatcaccgtcccataaaagcttataatttgtctaataaggaatagccaacaattattacaataggagacagtaaaaataagtagaatgcaatgttccagatgttcagaggagttggagatcatctccttatgggttggtcaagagagccttaatggaaaatgtagcatctgagcagggcatggaaggatcatttagtggatattcctctgtcccaaaattttttgtctgtccaatatcccttctgtggtgaagaaaattagtactctttggatatcttggtattgatttcattatgtttctcatgttcccttgaggtttcgtgagtgcaattgtgattgaatcctggaaagtgggaaagtgtaggaagtgatgcatcacttcttgcctgaggtacttgatagttagtgtcaatttctcagctctcctttgtcaatacctctgaagtttcaatgttgacatggcagagccacaagatgaaagcaatttaggtccctgagtcactgtgaaggaatgctacctgatttatatcagactttatatgagcaataaataagcattcattaggccactttgatttcagggttagtttttttgtggcatctaacattaattgttctgaataagtatctccactctttggtgaatggtaccctgcttttccttggatgaaattactcttccctcattctgcatgatcttagggggacctataatcatagtgctctgtaaactctataaactggtgggacaagttcctaatttatgccaattacatttagaaatttgaatctagaattgagaaaggtagagtcagtacaatttgaagctgaagcattttaatgacagcatccaaaaagtaacttccctggagttcctgactctcagtgctgccctccctctgccacagttgccttcttttccttcatttccaagaactatacattatccctccagtaagtttcatttcacttcagttaaatggagatggcttctgcttcttcgaatcaaagcttcctaatgtttacaggtggtgaggacttttatatataaaattacactccaaagaagtatggaataagggtattttagagaaaataagtacattttgctgtagagttgcatagagatacaagtgacagaagctaagttagggtttataagtgccagactatgaattctggatgttagcctctggcctaggaggttagaaaatcaaatgccttcaggggacacgtgggacacataaaattgtaaagccttagaaagtatagcaataagtgctaaactgatggtgttgatcagtccagtctctgcccggtttcattgccttttaatgttccttgcaggtcaaacaaagcagccaagcaaaacatatccttcagctctcttttctcctggggctacccgtttgaaatcaaagctatcaacagagaaacactgaaggttcctgtgctgggaaatgtgaagcaggagtgctgcttcagaaaggttaactctttcaaaagaaacagtgatttgggtggagagagatctcttacaaggtatctactgacttgcgattgatgtccaggagaatgaaaagggagggcatgaaaacataaaaagtgtacagaatccagtaaatggcaaaatattcaattaaagtgcagggaggtataaagaaaggacaacacatgttttaatctgaggacattataagaaataatggtggtatgttcttggaattgagaagcctaactaagtcacaggttataggaatcaaagtggtggtgctattgacttggtaaatttaagagaactttataaaatttgtgaattcgttatttctttatcttaaatgcaatagcactaatgcctcaaaagaacaacctacaaatgtctacccacagaagttatacaggctattttgtttcaatgaatggctggcccgagaaaatggttgcactcaagagagaatgtttgcgactgtttttggaaattcttctgtgggttgggtaataatacactcaagagacatgtttgtgatttttctgggaaattttttcgtggagtgggtaataaatagagcagaatattaggtgagaaatactcaatttcaggactagttattttaaactgttgtaaattataatattaaattataaaatttaaacattgtgaatatgttctttttctgtactcaggtattaaatcaaatatttttgggtaattagtggaaggtgagcttataaaaagattgatagcaaataaaacagtaactgcctcaactccagggttacttgatacctaagggctaatccaaacatgatagtatctttaaatacataatgtagacccataaactagtatcggaatcaaattacaatgtttttattgactttcttaatgtgtgtaatcacacggagatcatattattcacaaaatgaaagttagtagtttgtgagtgaaagaaggcagaccagaaataaggtacatacttcatgattctacttttataaaattctataaaacgcaaacttatctataatgccagtcagcatcagtggtaacctgggaatcaagggaggggcaggagagagtgattaccgaaaacagacttgtgaggatattggatatgtttattatcttgactgtgctaatagtttcactggtatttgcatatgtcaaaacttatcaaattgtactatttaaatgtgtagcttattgtatatcatttataccacaatgaaattgtttccaaaaaggactagcttggccaatacactacctaaatgcattactaggtatacaagttttacttaaaaacaatatatgtctcaataagtataaagattaccgtagcgaacactgtggtgtgccaccgagattcaccaattacaaatgaagcattcattctcccagttgctgggattgttatctactaacagatcatacctaagctcttccaagaaatttctctcagcagacaggcacttctttgaccaagatgatattgcccggaagctggtagttgggaggctcacatctaatgactaatggattagggatacaatggtccaccttccttgcttcatacggtaatactctaaatggtcatcccaaccccacatgggaccagataagatcttccatttcactgcatcatcattcaactcctctctctcctcaatcctgctgcctttactccctcccaggcatttttcttaaaagcactcactaagaaaccatctgcatggaaatctctgtcttagagtctatgtcttagaaaatccaatctaagataacaacctaatatgttgagaagttaaaatgtagaaaacagaaatacatatctgaagtaatcatttaaataacattatgaaaatgtacatcagtatttataaatagccattatatacaatgatacaattttgtttatcatttcttcaacttactgctagatttcagggaaaaatacaggatacaagtacttaaagaaagctcaagaaggagatatggctgattgcataatagaatattttgcagactgtcaactattgaggacgctggcatgtttggaagaataactgttattaaattttagaacataaaggtacaacatattgttatcaatcttaataaatccattcagcatttcagaataacatgaaaatatgccaacagaaattccattttactattgttactatcaagaacttggcaaaatttggttttttactttgtgaatgtattaaatgatacaggtaacatatatggaattaactatatgctaactgtagcaggtttcacttttcaataaacgaaatagccgtgacaattctgtctttaggatgaagagagagcattttccatgaaaatctgaattgattttcactatctaaagacatgaaacacatatgctagctctggacgacaaaagaagatgaaaatgtcctctataggaaggccatccaggatgttgaatggtaagagacaacttccatctaattatagacacattaaaacatggtccgttaactacaacccttatcctttccctttctaccaaccctcatttatccctcagccattgattttaaaaaatattttatatatttgacacccaaaggaaaaaatgtaaatgaaactcacttccaagagactactgctctcagcaaaccaaaaagagaataaaaaacaaatgtctacaaatttcttcaatgtagaaaaacaattcatagatcttaaaggcagtgatagggtttggctgtgtccccacccaaatcccgtcttgaattgcagttcccataatccccagatgtcatgggagggatccagtgggaggtaactgaatcatggggggtggtcactcccgtgctgctgttcttatgatagtgagctctcatgagagctgatggtttcataaggggcttttcctcctttgctcggcacttctccttcttgccatcatgtgacaaaggatgtgtttgcttctgcttccacagtgattgtaagtttcctgaggcctccccagccatgcaaaccagtgagtcaattaaacctcgttcctttataaattacccagtctcaggtagttctttatagcagcatgagaacagactaatacagtaaattggtaccacagagagtgggatactgctataaagaaacccaaaaatgtggaagcaactttggaactgggtaacaggcagaggttgaaacagttgggaggactcagaagaagacaggaaagtatgggaaactctggaacttcctagagaattggaggggtcagaagacaggaagatgtgggaaagtttggaacttcctagagacttgttgaatggctttgacccaaatgctgatagtgatatggacaataaagtccagactgaggtggtctcagagggagatgagaaacttcttggtaactgtagtaaaggtcacttttgctacgctttagcaaagagactggtggctttttgcccctgtccgagagatctgtggaattttgaacatgagagagatgatttagggcatctggtggaaggaatttctaaacagcaaagtgttcaagatttgacttgggtgctgttaaaagcattcagttttatgtatccacaaagatatggtttggaattggaaattatgtttaaaagggaagcagagcataaaagttcagaaaatttgcagcctgaagatgcaatagaaaagaaaaactcattttctgaggagaaattcaatctgactacagaaatttgcatatgtaacgaggagccaaatgttaatcaccaaggcaatgggaaaattgtctccaggaaatgccagaagttttcatggcagcccctcccatcataggaccagaggcctaggaaggcaaaatggtttcctgggccgggcccagagcccccctgctatgtgcagcctagggactaggtgccctgcatcccagccactccagccatggctaaaaggagccaagatagagctcagcccatggctacagagggtgcaagccccaagatttggcagcttccatgtggtgttgagcctgtgggtacacagaagtcaagaactgagctttgggaacttctacctagatttcagaggatatatggaaatgtctagatatccaggcagaagtttgctgcagagatggggccctcagagagaacctctactaggtcagtgcagaagagaaatgtggggttggagcccccacatagagtccccactggggcactgcctagtagagctgtgagaagagggcttgatccaccgtgtgcatggaacagccacagacactcaatgctagcctgtgaaagcagccaggaagggggctgtaccctgcaacgccaaaggagtggagctacccaaggctgtgggagcccaccttgcatcagcgtgacctggatgtgagacacagagtcaaaggagattatcttggagctttaagatttaattactgcctcattggatttgacatgcatggagcctggagcccctttgtttgggccaatttctcccatctggaatgggtgtatttaaccaatgctggtacctccattgtacctagaaagtaactaacttgcttttgattttatggctcctaggcagaagtgacttgccttgtctcagatgagactttggacttggactcctgggttaatgctagagtgagttaagactttgagtgactgttgggaaggcattattgtgttttgaaatgtgaagacgtgccatttgggaggggccagggatgaaatgatatggtttggctatgtccccacccaaatctcattctgaattgtagttcctgtaatccccatgtgtcatgtgagggacccagttggaggtaattgaattacaggggcggttatccccatggtgctgttcttgtgatagtgagttctcatgagatccaatggttttataaggggcttttccccctttgctcagcacttctcctttctgccaccatatgaagaaggatgtgattgcttccccttctggcatggttgtaagttttccctgaggcctccccagccatgtggaactgtgagtcaattaaacctctgtcctttataaattattcagtcttgggcagttctttagagcagcatgagaacagactaatacagactgtatgatcaatatattttactttctgagtttacttattaatgctaaactgtatttttacctttttacttttgaacgccattgtcatattaataagagaatttttttgaccaaagcattttaagttctgtacacttgcagtatttgatctacagatttacacatcatggacagaaatgttatgaaaatcatttacagaattatttaatggaaaacgtttcatatttaatatattttcatatgttgtacatgtaagaaatctgattttatggccattgataagagcgataatggcagccttcatataagatacatttctgtctttttatttttgattatacctgcaagaagacacatggtcctatgcagccaataaatagttgtataataataaagttatgataataaatgtttatacctttcatgttttacatacaccaccaaatgcaaaggaactatgaagcagtttgcactgagaccagttaaaacctaaattctcccctttagctatgcggtgatctatttcctgctacatacaaaatcctgaaaaaatggggctggaagtaattccagtgcttttaaacccaatctacaatttaatttcctttgtgacctttgaaacatcactgttatagaagttccaccattcctaatgccccagatttgccactgttgtttccttattaagaagcaaaacaaagtaaaacaaaaaccttcacataattttgagttctctttcttctcagtaagggaaggattttcacttaacttcacttatctcatttttctgtgttcttcaaccttaaactacatccagccttgttcatgtctctcttaaactttcttctttatacatttcaaaagctttgctctttttctgtcatctaattgggctagatctctattcatattactctttatgttacaacctattaaccaaaatattttcatgtggcaaagaattctgatcatgaggcaaaatgaactaatgagaaaaatttgtcttcatttctagtgaaaactaatttattcttgctttctctagggatatttcaagaattgtacttttggtcttttaggactttgaaaatgttggaattggtagtgaatttctaaccaaaactgtgcataaagtcagctgcttcaaagcaagtcatagaagcctccagcaattctgtgaccaaagaaaagtaaccctaatattaacctttcctttgactttaaagacaataatttgaataatttccaggagacttgaaaaaatcttcacacaaaaataaagttttgttaaatcaatactttgagaaatacccccaaattatttctatattggtgatagtaaaagacaaattcaagtattttatgtcgttcaagaaattggcttgtgtaggattgtgcacgtgacctttaatttccacttctaattttgtcactaactgttatgaatcacacttaaaaaacaaaccatggctatgatctttttaaagctgtaaagcaagactcaataattcacagagctaaccaaaggtgagtacataggaatatcaaaggtatacattagcaaaagattaaacaagtaagtcaataaggaagaaatagaaagacacagccacacaagcctcagaatacaaaagctgatggtgaatcaggatccagaggaatgcaggagtcagaaaagtaacacaaatacgcagaagagtgaccagctggatagggaagtgcagtggcccttgctagggtaataatgcccctccctcacattgccacagatccaggtggagctcacccattatcttgggcctggacactccagggtactctggttgatgtcctacagccggaaactgcatgtcttagcctaaagtctatctttgacgcagaaaaagtagctacaaccacatgcaaaaacaggttggaagtagttgcaagaggaaattaataccctgacaccctgagcggccctttaaaagtgactaacaagagttgaaatataaacacctcagctcctgcaccttgtctaagataactctgagacaagtgttttatgccttcccagactttctccagggaattaagccctagttctcacagtggtgtttggcttgataacatactctttacaggttgctttctcttaactttctcacaactccaacatcctaccacagcttcctagaatcactgcccaaagaaactatttgaactcacatccttgtctcaggatttgcttatgtaagaacccaaactgagacactcataatgcaagaatttatattattaataccagaatcaatccttaagcatggctagtttgacactctacatagaggtaaggaaaagcacttaactggagcagaaaattcactcattcttttgaaaaatgaataaggtactcttttttgtaatagagagtgagtgtaatgggatacagacatacctaatagtagtgttacagtagatagctagtcagatatgagcagggtaggagaccccccacccccgccaccccaaccaggaatgtcaggcaaccatcaagtgatggtcagtcaggtggttattaaactgtgtctttaaaataataattggtcacagccaataccagggaaaggcagtctcccaatagataaaaacacctgaaattggtgatcagcagcttcccgataagatcgcaggagttgggcaaatgggctcccgcgtgcgcactaagaggcaaaatgtcatagtgtaactggtatacgaccttcctctggaaacacttgactggtaagggaacacctcttgaatacaactccagtaaatacaccgtgcatgctcccctcccaagtgtcagcagaccactgtgcatgcagatagccccctaccccaagggaagaattggggagaaggtatataagaccatggaagtatgccaaaatacaaaaccataaatcaaagttcaaacaggacacttaatatctcaagtcgcccacttggcccccttccagatgtactttatttcctttcatttctgctctaaagtttttaaataaactttcattcctgctctaacacttgcctcagtctcttcttctgccttatgcctccttggtcgaattctttcttctgaggaggcatgaattaaggttgctgaagacccgtatggattcactgccagtaacaggaggagagagagttattcaacgaattattatataccgactatatagtaagtgaccttactcattccggctcaccatcacaatatgagtattagggttcaaaggacaagcttttatgaaatgtaaatctcttaatataaagaattaaaataatatccaagtattagattctaaataaatacttttaaaactagttattacaagactgtatctaatcacaaacaggtttttattttgttttgtttttctcactatctcaagctgctgaaacaaatttaatggagtccttccctcatcactgaattctgtagatttttctttcagttgtaagaaaataatgctttccttttgaagatgttggcttggattagaaaaatgctttattatgagtattgcaaagctacttatttaccacagctagacagagactctttcttactttgtcatgcagctgcttgtttttaaacaaattttgccaagagacataaaccagatggtcttcttcaagggtatcctgtgagctgtgatagtcagcttatggtagttttgagcagcagacagctgggtatggaaagtcatgatgctatttggaaatccaactaccaagtgtgctgaagcacaaggagattctcaagtcagtaaataataaaattgtgacttaaagtttgtttcagtattctatttttacagggggcattaactttatgctttataatattacttttctgggtaaaataaaagtaccccaacacattgaattagaaagaaaacttgtgaaaaaatggattcagaatacctttccaagtgggatcaacaaattgtaagttgggctttctaacagagttgtctgtgttttatcaaaaatgtttaattaatactgtaataaaattctactagaatggtgtggtatttcaagttgcaagtctcagttctgttttgtagtagtgttatacacccacactcttgaaatgggttcactaactgccaagtgtatttctctatccctgatctttggatatgccacgtgacttgctttgacaattgactatggatggaagagagaacgctagttataaatctgggtcttaagaaccatcatgtgtttctgcttacccttctgagatctttagaactcagccatggaggaatgtgccccaaatatctactgccattccagcttgagccccagaatgagacacatagatcagacatgtttggtcaacctacagtcagattctgaatcagagattactcaaagtaggcctgtgaatatgaggataagtgcttattgttcttttggggtatgcttgtcacacagcattattgtggttgtagctgactaatattgattgactttggtgagggcccaataaacagctaccttgggtcactcctacattactgagagataggggaaagaaaatgagataaaaataaaagttagcatctacgtccttatcaggatgctactattttatggaaggtacccaaagaaattccagaattatatctctgatgattccaaaattccttcaaaacaaaggacacagactggaccatccttggttttcaagtactatgctataattttgaatattacagaaagacaagtgaaagaactgaagaagaaactaaaaaagcatttcaagacaaacagacaaaatttgcctttttatgaacaaagatagtttaaatttattcaaacatataaattactcaaaggctaagaattttcaaatgtgcatctaaattgtcatttcctacaagtatctagccatactaggaaactacaaagaatattttaaaacttgtatttcaggcagaaatctctcaaaaaaccacatctgtggcttgtaatgggcagttttcccttgagaacactgatattttcaagaggaatttgagactatccacggataaactaaaactaatatgaaaataattcttgtgaaaattgccttacaggcaagaatttgcaactttcatagggtaaacagatttttaaagcgttagaatttcataattgtgacaaacatcctcctagaatagaaggtgaaacaagcaagtaagcagacaagcaagcaagcaaacctttcaccagaatgttatactgactttagtgactaatggatatatttttctctatgagagactgttcatgtatctccaattccctaattagaaaaacatatatccaggtcttagattattttatatattgctgtatccacacctaaaagtcatgatttgaccttagtatagcgaaatgaaaggaaatataaggaaatttaccctgcattaataatttattgaatacactatgatggaaatggagattctgttaaccaaagagtttctcaagaaacttattcattctagaatattacagcttttgagtgagaagcttattatatacatttaagggctcatcaataaaatattaacatgtattgaacatctaacatgaaaccatactgcattccacttaggggtgacaaaaggtatatagtacagcctcttccctgtaggaaaaagtactccactgaatggtaacatgttgcaaacagctatgtaagacatataaactcatgataataacctgtaagataaataggtaaacagagagttctatgaatccagacaatggaataattgatcaagaacagagaaggattccaagaggtggtatttgcactgaatgctgaatggtgtgtaggaatttgctaaggagcaagtcaggactcctcaagcacatcagaaaatcctttaccacttggctttgctaagcatcttgtaatgaattacaatccatttctgctactgatctcgaacataaagatatcaccttcaaaaatttaaacatctttttaaagtactttggtcttgtatatgagactttaaaaagtcattatacgtatttgtgttgtttctactgatgtctatagatctggaaggaagaacataatccttgagcataagaaatcctatgtgaaatgccatggaggcaggctatgtagtggaaaagaattcataactggggtcacgatatagactctggcacatacttcatgtgtgagcttaagacaattatttattctaaaactcaaaattattcgtctctaaaattaaggttctcttgagaatgaaatgatatatgtaaggctctgaacccatgcctggcacataggtgtgcctaaaaataagctcttttatcttatgcaaggtccatcctacgtgtccagaaaaagtaatgtcttgaaatttcagtacattgtcataatatcagctttaaacttaggtccttgttttatagtggttagtcagtgaattagtaagcaaaacttgctaattaaatttaggtaacttatataacttaggatccaactttagtaaaatttaggaaagcattagccctctaagtaggagcgctatgacaaccaaattctccatttctcacatttcctaagcagtagcttaaatctaagtcagacaaaagttgatgaatgagaaattactttgagaatatggagaaacagaagagtaggtacctagggaaatgatgaaaacttctactcttatattggcagaatttagtaagccagagtaagatgcgggctgaatcagagttcataaaattaggaaagaaaaaaaaagggaagggttaactaaagacaaagttgccctttttacactcttcttagggctccttaaataaaacaaaacaaaacaaaacaaaacaggagccgggtgcagtggtgtgcctctgtaatcccatcttctcagaaggctgaggtgggaggattacttcatccagggagtttgagaccagccccagcaacactctcactcaaaaaaaaataaataagtaaaagaaaaataacgctctttttaaatatacatgttgaagactgttagttctcttccaatattctttttttttttttcatgactgaacagtttttagcagagcacatgtgaaataaacacatttcccagccccacttgcagcttagatgtggccatgtgacagacatctggccaatgaagcgtaagtggaaatataacatggcagctcccacgaaacttccctaaaagacaattggtatgcaccctttgacccttcttctggccttcttacatccttcttggaatgtggatgtcatgagagctccatcttgcaacatgtggatgaaattccaccaagtaaagataactcactcagtagaaaacagaaatgagcggggccaacatatctgccttggctgcaaacttccagggtttttcaggagaaagaaataggcttctcttttatttaagtcatttctaccttgagcttctgtaacacttagccaaagcaaattataattgataaaataaagagagtttctgggaaaagtacatttagcacagttttattttacagtaatgtcttttaaaactcatctattccaggtagagaaaaaatgcatatttagagaagggaaatttgtgaaatgacaaaaccaagaaatacacaatgaataaagtcaaatattaatatcagcctccaaaatgaggctagtcctatggacacaaaatttctttctgtattagagtctttttcctttgacaataataaaaatgtttatttagataacaagcaggcaaatacagtcccctcatatactgaagaacaagaatcatctatggtgaggatgaaaatgcttgtatacaactatcctgggaaacaaaaatgttcaattactttgagaaaaagactggggatattgatctatggctaactctgagattatgtgaattttatatctagtcaatttcttatctgaagaaagttttaaactaacctctaagtgaactgtgaagatttataagaatctgaaaatgttgaagatataaggcaaatgatcctggatgaagcggtgatcataaaaagcaaatcactctgcaactcttaagtgctttgaactataaataggaatatgcagaagataagctgatgggcagaaacaaacttctatttaatgcatttcaaaaagctctttcacttaataaatacaacaaattttcttctttaaattctttcaccacctgctcttaacaactaagaattcagaagaaattatatttaaaactaaacaaggaaatgtaaatgaaggctagtttagatatctaatttagacggtatagtgtgctgaatggttcatgttttttaaagagtttcaataagtcacaataagataagaatattattcattgataattggtttgttgtaaggagacgctttgatagtccaatatacattaaatacctcatgacaccaactatatggggttaatcttttgcagtttaaagctttgcctctggtagtaaaacttccatgtaattggcatcaatagtcaaatcacacaattcattttgggttgctgggtggaaacaaaatctcctctatttggctcacaatcactctctcagtggtgtgcaaaatgcaatgactggccagtgaatgatatttacaatagctagggattatcttagattatacagccttcagcagaaacataaacacttgaacagagcagtgtgaaatagaagatagtgtgtgggaggaggcaagctctaatctgaaatatacaagaagaaacttacatatggcaaaaaagacagtatatagaggctacgcttgatggagggagattataataaatgacagattaatgagacttgtttttctcgaagtttatgatggtttatttctggcatacatgccaagttgatgctatcaaattatagtgttcattaccattattatcatcaagtcgtattgattaccaatgtgcactctactgggcattatatatacaagcaaaattcaggtggtttctgacattcaacaaccaataaaataaatcagaccaaagattgtagacatatgtaggagagcgtatagtgcacaagatactcaaatggagaaaaacttaaaggttaaaaataaatttttaaatactttcagtgtttaggtgaactggtaagtgttttggtgtgtcagtttataagaacattgcttgctatatctaagggaactacttattcattattttcttaaaaatgaattctatccaactagttacttagtaaatcatgattttcaaagaagatcttgagggtaaaaaccagaacagaacatttccccataaaccatggtttcaacaattcaaaaaagtgagacggagtggtgcaagatgtcagaatagaagcctatataactaatctccctcactgaaacatcaaattgtaacaactatgagcagacagaaaagcactgtcaccagaaccaaaaaccaggtacggaatcatggtacctggttttaacttcatcttgctaaaagaggcattgaggaaaggcaggagacacagtcttgaatcaccaacaccacaccttcccaatcacccagcactggacgtgcagtgcagagagggaatctttgcacttttggaagggacagtacagctactgggggactttacattgaactaactgctgtgctgtcacagtagagaaaaaagccatgctggcctcagtcagtgcctgtgcacggagggaatatttgaactagccccagccagaagggaatcgcccatcccagcagtcagaactcaagtttcttggcaagcctcaccattgtgggccaaagtgctctggagtcccaggtaaacctgagaggcagtctgggacacacgaactgcaattcctagataacttctagtcatagcctgggctaagagctagaggactagggtggcatgtgacctagggagacaccagctggcatggctaagggagtgcttgcaccattcctcccccacctcaagcagtgcagcccacagtaacaaaagtgactccttacttttgcttaaggagaggagagtgaaaagtaaagaggattctgtcttgcatcttggataccagcttagtcacagtaggatagggcactggacagtgttgtgaggacccatttctaggctcagctcctggacaacactctccaatcaagagagatacagtgtctcgaccaggcatggtggctcacgcctgtaatcctagcactttgggaggccgaagtaggtggatcacttgaggtcaggagttcgagaccagcctggccaacatcatgaaaccccaactctactaaaaatacaaaaattagccacgcgtgattgtgggtgactgtaatctcagcctcttggggggctaaggcacaagaatctcttgaacccaggaggcggaggttgcagcgaactgagatcctgtcacagcactccagcctgggcaacagagtgagatgctgtctcaagaaagaaaagaaaagaaagaaagatagaaaaaaaagagagagaagaaaagaaaagaaaaatagatacagtgtctgaatggatgaaaaaataagacccaattttgtgttgacctcaagaagcactcttcacctataaagctacacacagactggaaataaagggatggaaaaagatattccatgccaatggaaacccaaacatagctggactagctctacttatatcagaccaaatcgatatcaggacaaaaactgtaagaagagacaaagaaggtcattatataatgacaaaagggtcaattcagcaacaggatataacaattatatatgcactcaacactggagtatatatatataaagcaaatatatatacaacactggagtacagatatataaagcaaatattattcgagctcaggagagagaaagacctcaatacaataacagcaggagccttcaacaaccccactttcaacattgggcagatctcccagacagaagctcaaccaaagtagtaacattggacttaatctgcactatagaataaatggatctaatatttacaggacatttaattcaatgagtgtagaatacacattcttcttctcagcacacagattattatcaaagatagaccacacagtaggtcacaaaagcagtcttaaaaattcagtaacaatgaaataatatcaagcatcttctctgaccacaatggaatgagactagaaatcaacaatgaggaattttggaagctatacaaacacatggaagttaaacaatatgctactaaatgaccactgggtctatgaagaaattaagaaggaaattgaaaaatgtcttcaaaaaatgaaagaaaaaccacataccaaaacctatgggatacagcaaaactagtactaagagagaaatttacagctgtaggtgcttctatcaaaaaagaaaaaaacttcaaataaatcacctaacaatgcaacttaaagacctagacaagcaggagcaaatcgaacccaaaattagtggaagaaagaaataataaagatcagagcagaaataaatgactttgtaataaagaaaacatacaaaaagtcaacaaaacgaaaagttggtttattgaaaaggtaaacaaaattgacaaatcttgagccagactaatgaagaaaaaagggagaagacccaaataagtaaaatcagaaatgagaaaggagatattacaattaataccagataaattcaaaggctcattagtggctactatgagcaactatatgccaacaaattgaaaaatctagaggtaatggataaattcctagacacatacaacctaccaagattaaaccataaagaaatccaaaacctgaacggaccagtaacgagtaacacaactgaagccttagtaaactctcccagtaaagaaaagcttgggacccgatggctgcactgctgaactctaccatgtgataaatattgatgcaaaattgatgcaaaaaatattgatgcaaaattgatgcagagtgaacaggcaacctacaaaatgggagaaaattttcgcaacctactcatctgacaaagggctaatatccagaatctacaatgaactcaaacaaacgtacaagaaaaaaacaaacaaccccatcaaaaagtgggtgaaggacatgaacagacacttctcaaaagaagacatttatgcagccaaaaaacacatgaaaaaatgctcaccatcactggccatcagagaactgcaaatcaaaatggattaacgactaaaatctaagacctcaaactaagaaactactacaaggaaacattggagaaactctccaggatatctgtctgggtaaaacaaatcttgagtaatatcctataagcacaggcaacaaaagcaaaaatagacaaatggatcacatcaagttaaaaagctcctccgcagtgaaacaatcaataaagtgaagagacaaccaacagaaagggagaaaatatttgcaaattacccatctcacaagggattaataaccagaatatataaggagttaaaacaactctataggaaaaagtctaataattagatcagaaaatagacaaaagattcgaataggcatttctcaaaagaagacatacaaatggcaaacaggtgtatcaaaatatgctcagcatcactaatcatcacagaaatacaaagcaaaactacaatgggatattctctcaccccaattaaaacgacatatccaaaagacaggcaattacaaatgctggagagagtgtgaagaaaaggggactcctgtacactgttggcaggaatgtaaattagtacaaccaaaatggagaatagtttggaggttcctcagaaactaaaaacagggctaccatatgatccagcaatcccactgctgggtatatatcccaaagaaagcaaatcagtatatcaaagagatatctgtactcccacgtttgttgaagcactgttcataatagccaagatttggaagcaacctgagcgtccatcaagagatgaatggacaaagaaaatgtgatacatatacgtaatagagtactattcagccataaaaagaatgagatcctttcatttgcaacatcatggatggaactggaggtcattgtgttaaatgaaataagccaggcacagaaagacaaacatcacacgttctcatttatttgtggcaggtaaaaatcaaaacaactgaacacttggagatagagggtggaaggatggttaccagaggctgtgaagggtagtgggggggttgagggggaggttgaaatggttacttggtacaaaaaatagttagaaagaatgaacaccacctactatttgctagcacaacagggtgactatagtcaaaacaatttaattgtacatttttaaacaattaaaaaaatacaattttactgtttgtaaaacaaagaataattgcttgaggggatgaacatcccattttccatgatacttgcatgcctatatcaaaacatctcatgtaccccatatatatatatgtaccccacatatatacacatatatatgtgtaacccatatatatatgtaccccacatatatatatatgtaccccacatatatatatgtaccccacatatatatataccccacatatatacactatgtatgtgtgtatatacatagtaaatctatttatatatagtatatgtttatatatagtatatatttatatatgtgtgtttatatatacagtatatatatatatatatacagtatatatatatatatatatatacacactatgtacccacaaacgttaaaaataacatttaaagataaaaaattttgaaaagtggaacataaatagaaatttgtacttctctgtctgtctactgtatcttcttctgcattgtccccatgactgaatccacgggattcctttcttccagtcagtaaaacagtggccatggaataggatatgaacaactttcttaagttcaggacttgcttgttttttaccccttacttcctaattctaccaagctcagaaaccaacagtaagtattttgtattggcacatatacctatacctgggttgtggaatgaagatccagtcttgcataaaaatcttcaaatatggtagagattaattctaagactgcaatgataatccttcgtgagttgtcagcatcctgtatgtgcttatcatgtatcttcccaactacatatggcattgtgacaaatagaagaggctgctaatgctgctatagctgaatgtctcatttaggaacaaacaattctggaaaagctcccagattatgcatctgtccctctagcttccactttaaaagataaaattctatagtgataacgtgaggattagtatactattctttccttatatgggtaatgtgaggttatttccttaccttgacatgaaagaaaattatttattgaatgtctcagtagaaagattacaactgagatagcaaattcttatcagaaactcacattaggaatgggcttgcagaattgcatgctcattccctactgtctgaatacagagacgattagggactttctcttcgaatctgatttatttggtttctactcctgttttctctcctttcgtttctttcattttctcatttttcttcatgtagcacaaatggcagccagagcctgtgagtgctttaatgctgcaggcttactgctatgagaactgaacaatggagaaatccctggggaagcagcttccaactgtcccaccctcagcatcctaatgacctgtggaactgtggttccagaatggtggtgataaatttggaaaatactttctctaaagcagtagtgcccacatatttatctgacaggctgtactgggcaattataaaatgttcaggggtccatggtgaaatgccaaaaatagaacaatgcggtatgcttttcctaaagctacaccttctttattaaaacaattatgatttatgtccctcctgtacttaaagtacatatttattatttttaaaatgtaagtataaattttagttcagtccagcattcacacagaaatgtgtacacatcacaagtgtatggttccataaacttccctaaaggaaacacatcaatgcaagcagcatccacatcaagaaacaaaacattacccagtccctagaagcctgcttcagcccttgttaatcacaactcacaaaggtaactcctatctgacctctaaactccaaagtgcctaattttttagtttcatataatagattcatacagtaagtgttctcttatttctgacttactttatacaacactgtgttcatattttatttttcaacatttcctttattttatgaaatattattaataagaacatttgattaattaaatgcccttatacttctttctctaatttttttagaggtttctttttttgctatagaaatgtaataatatagaaataaatactcttagtctcatgtctattttacatcatatctaaagctcagaaccatcttgaatttaactacttatatgggtgggtaagtcaacccaacatatctgactaagtagaattccaagaaggaaatactgattttaaaacattactttcttgatgtttgacagggaccttgttgttacacaataatgccatcttatggctgtacagcaatttgtagtctagaaactgccttcattttgatgatagcatttgaactgttctaccctcttagtctttgggaagtcattttctaaaagtgggaaacactcactaatggcttacaggatagtaaagatggtatcagaaagaaactaacgacaatagagtataacatctgacatttagtaggcccttcttaagtgttcattgaaagaagaaaagagctttgtttctctaatcccagatagatcttatgtaaattctttgtttttacatgtttcctataggtatattttataagcagttagttacccacccgaaaatcaatgaaaactgaatttagcagtaatattaatttcccaaaaagttaactagtaatcttacatataggcatatctatccatacgttcatggtgcttgtggatttactgttgactgtgttgactgttagtgaacaatcagaatgtccgtgaaaataaggcttttaatactttgatgatgtgtaacttgttgagatacatgttgaaattctatttgctgaaagacaatgtatggaagcaggtatgttagataatgaatgagcagtcataaattagtctggctttttaaatatcttcctgttctcatctaaagcgtaatgtctgttttaccttatgacatttaatagagatgactgaacgagaaatacgcagatgtactatttagtatgtgcttaggcaagtcacataacatctttgaaatatagttttctcccttataaaataatgaagcagggcaaaaccactaaggcattttctagctgtaaaacaatcctgttataaattattaactatctctaataatttgaattatggttcagcaaatattaacatctctccccccttccactgtaggaagagtctactttctcattctattgatgtcagatttggcaacgtaatttgctttggccaatcaaatgtcagtgaacttcacaggagcagaggccatgagtgttcttgggaggtttaggtttatactttggtgactggtcatgaaaacatgtcactgacccttcatcttaggtccagagcaaagacatatatagcagaccttaatccaacatgcatcatggaacctagctctactaacccacatcttgaagcagagcttcccggccaagcccagctgagtcagtcaaggtacaagtaacctaaacagccagaaatgcctgttgttttcagtcagcaagttctagggtgatttgtgtcacagcattattgcggtcatagctaatactaccatacatgtaccatttaagaaaaataccaatatagcccttcttactagctcaaatttattttgatttaacccaaattggcttactaaaaaactcagcagatttttgttgagaacaccacatgaaggctgtactgaacatttgtgtattcaggaatgcatagcttctaaatctctccaaggattcaagaatctaccattgtatgggacttagtaggacacgaggtgttgactgccactacaatgaagaacaaattcagctatttattttccctgatctctggcaataagaacctagttctgtggcctaaacctgtattgtaacagcagtcatcaatctatggcccatcagcaattccagcctgccatctgccttggtaaataaagttttatttaaacacaacatgtccatccatttatatattatacatggtttttttcaccctaaaacagcagagttgagtagttgtgacagagactacatgacctgcagggacaaaaatatcgactaactgcccctttacagaaaaaaatatccatcctctgactatcagatgcttctgccagagaccctagttgtagaatgagcgacacacagcaagaataaataatttagatactttttttttgcagtgacgatagcaagcaatgtccagtgcaatggtgctcctggtaaagcaatggactctggcatgacagcaaaataattcagatttacctcatagcttgatagtagatatattctggatgcctagcctgctcttcctttatagtttctgcccattgttaaacctagctctcaggctttcctattgattccatgaggtatctgatatccttctagtaatttatataattctacctaaagtaactagagtcactttctgttagttgtaactcagaaccttgaatggtctatagaccttgacttattccccattcttagtaagatagcttcattccattccccagggatcttgttcttgccctcttgtacagctccagtctatcaacccttattttactggctggttgtgccttttctctccaagactgtgaagctcttcaaagcagggactgagtctaattcttctctctgtagttctcagggaaatttgaaagcatgtaagaatgaattaacagatatcatgactatcagaaccataagatcaccattttcatcatcaaaattgccaaccttaactgagccattatcgtgtttaagcaacccactaagctccccacatatattgtgtcagataatcctcataacaaccctgtgacatagacactattcttatcctattttatacatcagaaatgtatggagcagaagatttaagagacttgctcaagggcacatagatagcagaaaggccagaattccaaaacgggttggaactctagagcctgtgcttataagcaattacttaaaacagtttgtatctgagattgtactaaaagtcataggaaatttaacagctcctgaccaattcctatagaatgtcaatggaagtacaatttcaacctctggataaggacagggtggatctattggggctagagaaactctatcctttgtcaaaaccagaaaagtcctcagagttggggtgagatttcagcgaccctctctgtggaatggcgttagtgtttctgtttaagtctaaggtgaaggtaaactgaaagggaaatgtccatatgacccagtgagaagggaatacctggatcatttgccaaaaattactcatgagtaaagcggaggagaaacctcaaaaagcagaaagcgttatttctactttagtgcaaaactggtaggtgtatatagaagcacagtaatcactggctatccaagaaacctcaacggtccttaggggatggtgtgggtggcctagaatgcttggagaaaacactgactataagaagacaaaccagagggggaagaacttcccaagagtggaatgaacatcccaaaagatggtaatgaaactgacatcattggagtagcccgcagagcctcataatgtctcaatgtgaaatgctgggagaaagtacaccatggtggcgatataagtttattcaaatatttttgttaatttattttagagagagtctgttactcaggctgtagtacagtggcacaatcatggctcgtggcagccttgaattcctgggctcaagtgaccctcctgcctcagcctcccaaagcacagggattacaggcatgagccaccattttataagtttaagtttgtatttgtagcatatacacagagtggctgagtttctttgcctttatcaagcctggctttggatactgtgggaccagctattttcaaggaagttgagataaatctgtttttttgttttgttttgttttgtttgagacggagccttgctctgtcacccaggctggaatgcagtggtggatttgggctcactgcagcctctgcctcctgggttcaagggattctcctgcctcagcctcccgagtagctgggactacaagcgcatgccaccacgcacaggtcatttttgtatttttaatggagacaaggtttcaccatgttggccaggctggtctcggactcctgacctcaaatgatgtgcccgccttggactcccaaagtgctgggattacagacatgagccaccgcacctgccctggaaggtgcagtgagataaatctggtagactatccaaaggggaaatattctcaggtttcggagaggaggcttgagtccagacacattgaacacccactttgtgctcagcactatatcagtcctgagcatataacacaaataaaacatagcccttttctataaggagcttgtgtgggaggcagaaaagtaaacaaattgattactatgtgttaggttttaggagcaggcacatcagatcatatattctacacggtagccaccaagtctggaaaatttacaaatgcataaatgatttattgatattaaattacattaaatgatgaaacaatatccaagtttccagatgttaggagcgactaatagttttaggatttctagaaaaagacaacatctgaagtgagacctgaagaacaggcaggtcagagggagtacaaaacacttgggcatctgcaaattgatttaatatcgctagaacataattggaggggcttgctatagggcaggcacgaagaaataagcagtgaggctgaccagataattttgcacaattaaggagtcagggtttcattctcaagggaatgagattatagtaccaaagctcttacactttagaaaaatgacggccactgaaagatcgttgagaacaaagtggagataatcacttgagacaactgagattaatgctagaaatctctctttaggtgcctgatgtagtaaaccaagaactaaaataggagtaaagatggttagaaatggacagatgtaagagataccatggaggttccctataattattagacgaatgatttgatttcctctgagaataattaagaagcctaccttgaggataaagacttctgaaatgaatcactttaagctgttagagaactttattacttttaatctaaaaatgtaaaagaaagagtaatccacttcttgtgatgtgaagctaaataatgtaattgaatttctgccaccccccaattaagtcaacagctaaatatttcaattaagataaaaagaaacatgattttaaatcaacttaacaaattccccatggcaaaaaaaaatgtgggggagggtaatgcaaagtgtaaagtgtcaccctccaaaatataaataaatgaaaatcaatttttttattgataggtagtattttaaacatgttaatctaagtatcaaactcctataaatttgtagatacagatttgactaaagataaatatgttatatcgaacaactgtttatagcacctcaatgccccaatctgatttacgattacctgaaattttagaagatataatgcttcaacataacgctaaatttaatactgaataatttctacagttcagctcatttgtctgaattgttcatcattatttgttctcattttacttaccatttttcaatgagagtgatacttctttttccctgtcttttttccatggagggtactgaaataaattctacagttccctgaaaacaaatcatttctgcaagtatcaagaaaaatatatgtgttacctacccttgtcggtccttgtacattttgttaactttttcccattggaaatcaagctgggagagagcttcctgtagcttcaccctttccacaggcgttgcactttgcaatgctgctgtcttcttgctatgaataatgtcaatccgacctgagctttgttgtagactatcttttatattctgtaatataaaaattttaaaacagtaaaaaaatgaattagctgtctatagaaagagaaaaatatatatatatatacaaatcccaaaggtagcaaatggtgttgcaattcttaattattgactttttaaagttaataaccatgaagtccagtgactttgacatgttcaaattcaataggtaaatcacagacctcatcctgagagagtggatcgctccctacatcttaaaactgccttcatttggcttctgtatcctgacctcttctgctttcctttgctggatccttctcatcctgatcttaatattagagtgctctgactcagtatttgcacttcttttcttctctgtccataatccatcccatttgttctcataattttaaatatcttatataagacaatgacacccaaatgtgtatctcaagcccggacatctcctccgaactccagtctaacaaatgctaatttctcaacacttggaggtctcacgagactttcaaacttaatatgacgcaaacaaaattctgaactgcatttcctaatccttctcatcccatagattccctcatttcagtaaatggcaattactgatttcaattgaattatagtaattcaattaacaattactcagattgacaactttggagccatccttaattttttcagtctccagtattcaaattattgggcaaatgttttggcttgactttcaggacatatgcagaatttgactgcttctcactacctttcttgctacagatctgatagaagctattattgtctctcatctgggttatagaactacctatctaaatggtcctcttgcttccgctctttcccccctactggataattctccacacaagagccgaaaagattcttttaaaacataattgggatcatatcactcctctgctcaaaatcttctggtggctcttcatcacagagttcaatcacagccaatttcaaaagcctacatgaaaaataattattcttgcaacactttatacaaataatcaggccaagtataataaagcaaatcagtcctatgatgatccatctttagtaaaaatgggagactggagagagaaaaaaattatgttttaagaactatggtacacctgttattagtctcgtcagctgtttttgagttttttcctgcaatatagactgatcctgcttattcctgtgaacctgccagtgatctctgactgcacctcagaagaaacaagaaggatgggtaatataaaaacctggatcagtattctaattctgggcatgtattggaatcagctagcagccccacatcactttggttccaacagctgcccagttcacggaaagccttctaatttagtttacttgggataattttacttattgtgttttactgttgtggaatatatttgctgttttactttttgtataggaatgcagaataagcttactcaatgttttcttagattgaaaacttactaatcttccagatatcaccatttatcagttatgaatggccctcaccaagctgatgcttgctgactgagctcctctctaccctgaatacaagagaccctaatagttaggcagaaatatcatcacccatattcagcctgaagaagttacagaagatgtattacccttctactacttaatcctaagggtaactctactacccttaggattaagggttcccttgtaaaagaaagaggggaaatatgtcagaggcgttcgaactagaacaactccatcttgaataggggctgggtaaaataaggctgagacctactgggctgcattcccaggaggttgggcattcttagtcacaggatgagataagaggccagaacaagatacgggtcacaaagaccttgctgataaagcaggttgctgtaaataagctagtcaaaacccaccaaaaccaagctggtgaaaaaagtgacctctggtccttctcactgctcattatacactaattataatgcattagcaggctaaaagacactcctagcagtgccatgacaggttacaaatgcatggcaatgtcaagaagttacccaatatggtctaaaatgggagaaaccctcagttctaggaattgctgactccttttcccagaaaactcatgaataatccaccccttgtttagcatataatcaagaaataactacaagtatcctgagtcaagcagcccatgccactgcactgcctacggagtggccattctttattcctttactttcttaataaacttgcttttactttttttaaaaaagcataatcttcactatgacctataaatctctacatgacttggttgtatactacctaccattccaagctcatctcttcccagtctcttcatagtccacaacacttcaccctcattaggtttattgcattacttgagtataacaactacattcttgcttcaagatttctgcccttgctgttctacctgccaaaaatagttttcctaacccacatttctatcagtggttcccttacttctttctcacgttaaaggggccttctctactactctattttaaatagcaccagcaatcactctttattcctggcattactcttcccttttctttatagtacttattactaacattaaaatatatatcaagtagccggtatataccactaatttgaaatctatgactacagggatgttgttatctgttgggcttccaaagctcaaacctgtgcttggcacatgatagatggcaaaagcttttttgttgaataaatgaatagatggtcccataaatttaatccataatgttttgtttatattctatttaacggaaaaatcacaaaccacaaatgggttatacgggaagaaagaaaaatctaaacatatttattctcaataaatttgctaaaaactacattctggctattcttcctagtacgaattttgttattttgatcatctaaattatacataaggtccactgagcaaaatttattgagttcttcccatgtgtaaggagcaatatagcagaaacaaaggtgggtgaaacacagtttagtttgcctttaagaagttttaagtaggttttattgtagtagtaagaaaggatatggtttgaagaattgaagaaaaaaatccaagtatagaagccttagctggatgagaagaaggaagaaatgagtgttccaagtggtaccaaacattttctagaagttagagaaaacatgtatcatatatttggtcataggctcaggaaagaattcacgaagaaggtgcaaattgcagtagacatatctgagtagtagaagtgggaagaacattagagctagtaggtaacacacacgcaaagctaggtaacaagcgcagtcatatttggctgccttttcagtaacatagaagcttaggggaagatggggcatgaaacagaggctgaggatgttcaataatgtgctttgaatctcaacagaaaattctgcctgtacttcagtagctaatggggaactatgatttttaaaaagttatcattatgtaagatttcaaatatatttgaaagtaggaaaataatacaaatagctcccataaccctataatccagtgccaactgttatgactccatggacaatccacccactcacctcttcaactagattattctgaaacaaactgatatattattttctccataaatacttcagcatttttctcttgctgaaatattctctcatgagaacttttttcggaaagtacatatataataccattaacacacctacagtcttaacaaaagttcattaattgaatcaagtatctagttgctattcacatttgagctgaagtgggaaggaagtttaggaaaacagctcagcagaattcagtgactgtgtgttgggtgaagaagaggaagaacttgaatgagtcttaggtatctggcctgggcatccacatgatttgtggtgtcattgggtaacaggatttcagacagatgaagaggttccatggttacatgcttgtgtatgtgtgcataagtgatcagttcaattttggacatggtcattctgaaaagcctttgaggcatcaaactgtagatgttccagaggcagttgaaatcagattttgagaagaggagtaagatggcagggattgctgagccatacatattttcacatttggatacatggactaggctttctgagcaaagagttgtagtaactgtcttaaagggtgactgaatggcaagcgtaccttggagtttagtgcattgctctggagagatttaaaaacttttatctccaagagccctttgattacatttcaacttatattccaaaaataatagacctagatcattggtttatagcccagagcaaagtctctgtcttcctgtatgtctgtctctctcactttctctcctcctgatacatcaggtgctctatataatctccaagatccacaattctgggatttctctcctgtactacaacccctgcactcacagataaacatcttgccctgagatgcttttgagtaattaatgatgtattctctcatccagagatcttatgtttcctgactagataaatataaattttaacaaatatcaacaaagggaatattcttttttttttttttttgagatggagtctagctctgtcacccaggctggagtgcagtggtctgatctaggctcactgcaagctccgcctcccgggtttacttacaccattctcttgcctcagcctcctcccgagtagctgggactataggcgcccaccaccacgcctggctaattttttgtatctttagtagagacggggtttcaccgtgttagccaggatggtctcgatctcctgacctcgtgatccacccgcctcagcctcccaaaacaaagggaatattcttgcctattttcagtcaaaattgggaagcattttaatcatttgtaagttggagactgtgttagatagggagtgactgctgctgatcgtacagctttccagatgacgggctctgaagaaaacttcacaatcagagagggaaacaggaaagaagttaacaataaaacttagaggattttctgccttattctaagatttcacgtttgtggtccacgaggacttgccttgagcaagaactaagctgaagaggcaggtgagactacagataatgtcagttgtaaaaggtaaaagtcaatgcttacaatgggaaccttataaaaagcaactgtgttctcgtgtcttatttatcagctcagcaacaggataagatacaatggttatgggtgatgtgagtgaatttcagagaaagaaggtgtttttaaaataaaatttcaaggcattctcttccagtctatgtacaccttgtgatggaaagctttcattatttcttttgtttcgcacctcaatttaactctgtggaaaaagtacttatctgacaggtcaggtattaccatacaaaagaaagaacaagccaacacagaaacaatctgagaatttacttatctggaggaatgcaggttaaaactgtcttttagcaatttcacatagagaattgatagtcattggaatgtgtgtgatgttgaataagactagggatggtcagattgctcaggaaaggtgtttagggtgaaaagagtgagaagaaaggtagcataaagatgaacctatgtggaaagcatgggcagaggaaggagatgagtatccctaaagaataatagtcatcagacccaggaagagaaccagaaggagggagggagttgtcaacaagtcagatgcagccaggaccaggagggaaaagtcagctcgggcaatttaggaggtcattggtgatcttatcgagagcaacaacagcatgttggaagtggaaaacataaatgtaggcagaccagactgtcttttgctgtcatcatctttcactataaaatagaaaatagctttgtacgacattgcagtatgctgtatttgacatcagaggcttgcttattgaagaaaagtttcatattgataaaaacaaaactcataataaaacagaaactgttggatactatgctcactgcctgggtgatggggtcattcatatcccaaatctcagcatcaaacaatatatccatgtaacaaacctgcacatgtattcctgaatctaaaatacacttgaaattataataaaagagatacaatggatgtaatacctgttattaatgccctaaaagccattgaactcaagcgtatctctagtattatttctttacttttatttacctggtagaattttactaccatcttctgatggctccaagcctggagtcttgggtggaatgtttagggctactccgctagcctgattaggtcaggtaccagaaacgtgcaccaacatatcttcttggctgcttctgttaacttgcctgacctgggcagcctgatttcacaagtacttgattcaactctgaattcttttaagtcactgtctccatcattcttgcttggctgccagtccaatggcaaagatacataactctgccaagtcctccacctgataccaagactccagctgaatgaaaggctgattacttaaattcacattgggcaaccaatcacatttgttagtacatagcaggcccaaaccctttaaatgcatagctgtaagcacccatggagaaaaacattcaagggaagagataaaggatcttccccatcagcatataaaagttatccagttatggctttgatatggtatgcgtgtgtttgtgcgtatgtgtgtgtatgtatactctctgaggatttgagcttgcaaagcttcctgattttaatctgagtctctggggagctaccaattctttggaatgctgtagcattgctcagcatcaagttatgaacggttttagcaatgctgtacagcatgttactaacgcgggaaaactttctatcttaaaggagaaaagcaaaaagcaaaaactggggcaggggatgtcacactccctggatatctagataatagctccttggtgcattctcagagaatgctgtcaaaattggctggagtccaggaaatacatcctttttaaagtccctgcacatattcgtgtcctcaaggcactgcacacagaaaaatggtatgtgcaccaaagaaaatgctgtagcactttccatagtttaaagtcagagatgagatctctgatagtattttactattttagtttgtctagaaataagtgatctttatagtttctgaccctctaaaaaggaagccatagtcccttgtagttgctatggcgatataaacatccctagaatcactatagaatatagcatttctatttctctccctgaatagttccttatcttatctgaaaatatgatgtcaaaatgataaagtaccaactttttagtcaaatcccttcttaattttgacatgcccctatgaattgaccacttcactattccgctgaaattctgtaagatgtttatttttggccactctttctgcaaaaggaaattctaaatatacatacaaatggaattttaatttctgaaaggcatctgtacacgaatttatacaactcgagtccttaatattttaaaataggatatttgcatctctgattcacagtctccaataagttaaagaagaccctgattatgcactgtgaatagagaaaaattagatagcacagtaacttttacaaccggcagatgaaatccagatacctaaagtaaggaaaagcagaaatctataagccatgtggcttcaattcatttatctgtttgaaaagcttattgtttaaataagtgtttattgataatacagacataatatcagcctcaaatgtgagatatgaaaataaagactttaaaatgtgagtctctcccttaagaagataattggtttttaaaggagacacatacagaaataatttgaacataaaaatgctttgtttattcaagtgttgtggagtatgtgtctttaacaggataaaaggagaagccagagaatacagaaaatttatctaggaaacaaacaagggacctatttgccaactaatcagtttaagataaaggtatgaagcaacccttaactatgctccattctttatcataagggatagacttctactgtttagtttttcttccatttaatgtaaagtgacaactactcccttgctgtcaaagattttcattgcagagcctgcctttaccatctaaatggtaaacttatgtgtataaatgtcaaagtagatattgcagaacctgaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcacttataattcacatttttaaccatatttatttcctgaaggaaattcctattcactcacttagtaatagcttccccatttcatctttccctccttggcaggattcagtacagttaggcacagttttcatcatacagacctagccacactagttttaactagtaatactatcttctaggtttctctctctgtgtctgacagctacatcgctgtattcattcattaactcaagaaatatttgttgaaaaaacctaccatgagacagtcatattttatttatttatttatttatttatttatttatttattatttatttatttattttggagacagagtctcactctgtcacccaggctggaatgcagtggcgcaatctctgttcactgcaacctccacctcccaggttcaagcaattctcctgcctcagcctcccgagtagctgggattacaggcgcccgccaccatgcccggctaattttttgtatttttagtagagatcgggttccattacgttggccaggctggtattgaactcctgaccctgtggtcacccgccttggcctcccaaagtgctgggattacaggcgtgagccaccgcgcccagcctgagacagtcatatattatatcttgggtatatactagtgatccagaaagcaaaagccccgctctctggaatctcaccttctacaggagaataaagtaaacaaatagagaaatgactaaactatatactcagttagatagtggttaagtgctgaggagcaaaactaaagcagggaaggaagaaatgaaggataaagtgggggtcagaattttaggtaagaggggtcggggaagaccttaccaggaaggcagtttttaagtaaagatctgaaggaaatgcagaaattaaccattgaaagaaaaatcatgagaataatattccagacaggtaaagcaagtataagggccctgacactggaatgtgcctggaggagtggccaaggaacatggaggaagtgattatggctggagtgtatgagctagcgactaccagagaaatatcagagaatggggtgggtaacccatgaaggtacttatgaacataaggacttccctgtttactttgagggggatggggagcattgggggttttgaacagaagcagaaagggggatataatctgactttccatttaaataggtatctctggctagtatattgacagtagagtctacaggggagaaggcaatgagggggaaacttgttaatagacaactgcaatcatccatgctggagatgatggtgctttggatcagagtggaggcagggttgaattccggatacattgtaaaggcagaatccttaggatttggtggccaattacatgtgtgttggtagagaaaggccttaaggataacatgaagaattttggcacagacaagtggaataatggagttgccattaactatagtgtagaaaactgcaggaggataaggttagggtgtaagattttaacatgctaaatttaagatgtttattatacttctaagtgaatatataaaaggcatatatatatatgtcatgattcaggagaggaatcttgactagagatataaatttgagagtcactaggggtaatttttaatctcttccaaacttgctcagaaaatactgatgttttgctatattccctttccagacctcttttcttccaaacccaaccctgtagacaatcttagccatttctatcacttaaatcaaactttgacacaaaggaattttatttaggggaggtgggaaaggggataagaaaaatgtcaagttgggagcatagattcactgctgctggggcccaacagagaaggcacccagcaggaggagggagttagccctttgatggttgattctgcttaaggctacatcaaggtgttttggggataacagaaatcgaagaagctagaagaaagtacagggaaaaaattcaagtctacaggttggtagacagtcagagactcttggttctgttgccatggtgggattatatacaccttccagaaaacctttccttaaccaatcagagtatttatttaactagatagaaatatgtatcgggaaatccagtccacattttgcactaacacaggaaaatgggtgatctaggatgttgggcatctcctgagtgaactttaataatgagagtcctggtacagctactgaatcaagggtatggtttataaatcggtccagctatgctgaacacaaatatctccttacttattgttttatctctttatttttccttgtgtccaatttatcctgccattttaaggattatccctgaccaaaatccatccatgatgacatatagctttttggacactttcaagcccatcttttagcccatctttttttccaggaaaaaaaagaaaaaactggattcacagtttttatccaacttgatttcctagtgctttgccagcagagacacttgaaaggataatcaaagtgaataacaaagtgaaggattaatctctttgttattcttcagacacatccttctgatacaattttttttttttttacccttactgactttgtatctttaactttgaaaacattttctgcatcaagaaactgtatagcgtagtgcttaagagcagaaactctggagcttgaacatccagagtgggacttcaactatgatatttaaaaatgatctcacctgagcaagtcacttaactgctcaggacctccgtttctccatctgagtatgggtataataatacagccttccttgtagggctgttatgatgaccatacaagttactctaagtgtttagaatgtgtcctggcacaaaaataataactgtcagctattacattcaagattagtccagattccagttatattcacacctcaagctaaggattcctcctctataaaattcctcctagtttctgctttttgtgctgctttcttcttttcatgatttcagttacactcatgtcttatatatttttgcttggatgatgtccttaatgtctttattactctctaacttgtttgtataactataatatgtatattcaataatgttatcaactaccagagtacaaggattattccttaatatttctttcttatcttttagaatgttaagcatagcacttgtagcattaataaatatctgttgacttgaagtaaaaagttgagttgaacttgcttatgaaaatccaatttgaattcaatcattgaacctctaagatttgttactctgttcaaccattgtagatagatattcaggtatggtcagacgtgagctattcaggtaattccttgtttattctactttacttttacaagacattagctgttgaacagtggaatagaagtccacatgcatttcctggctgagtttccttatggtttcctcacagcacattagatatctaagaaaaaagtcctttattcagaattacacctgcccatttctccagatgccacagagcatcaacaagaacaaaaagaacaacaaaaaaaaccctgcactttactgatccaagtgtttctcagataaaatgattctagtccatcagcactaagtaaattgaaaacaattttaccagtccttttatgatacgtacattttgtgttaagttgtacacatcgcctaaatcattttacagaaaatccaaatagaaaaattgactcacatgcatggcaaagggggttttatagaagtaagtacttttctcttagttcaaaatatatggcattctatgatcccaaatttcttagagtcaggatacgctttagtgttgtgtgactcagcagaggagggccaggtaggttttatggaggaaaaattccaaagcaatacaacaatccaagaaaacctcaaaaactgatgatcaccaatgaatggaatatgcttttttaaaattcatgttatactttttaattctatttacatatgcaatcatgagcatcttattattttgataaatgaaaatttagtataaatgattaagcaacttcataggtagctaccatacatgataaaatataatcaaacctgcaaaaattaatattgatgacagtaaactattttggtaaaacagaaaacatatttggtaatattatgcccgttttatatataactaatacttctgatgttggggaaatgtgctttccatcatattgttttacacaggggacagaaaagcaaaatcgctctttcatacaattgttctgtacccaaatgcatacatctaaaaaaaaaaaaaaaagaaagaaaagaaataaacaaaaggcatgatatgggagcaggaagctaacactctactcaatgtttacctttttggaagctccatagatttccttactgataacactatttaatttttgcctgtggtttggcaaattaaatttgggaattggtgtctgttaatcatacgtgatttacaacagaaagttcttgttttttttccatcaggatgtttaatgatatatattaatattcagaaataagcagacttgggtacaagtcattgtattaaactataagatattgccaatatttaaaccttttgaaagacttgacaattcataaggttcaatggaatagcattataattttaatatgttcatggttacaaatttaaccaggagaaaataaatacaaactaacttttttaaatggcaaaggaaagacaacaaaaaataaacaacaaaagcaaatttcaagactccaaagcaaaaaagagaaaaaaacactactgattaaatcattctttgcttagagtttcaatatttttcaataatttttgtcatggttctgaactcacaattagaacaatgggttttaagttactgaactagaaatggaaaaaataaatcaacacatttcataaagaaactaaagcccaaaataaaacaacaattaaaaccaagctagaaaacagcatcctcttcttggtaaaagttatggtacacagaatcttggaataatttagagttgcatttctgcacctcaagataaatatacaataaagtgagttatttgttttataccttaaataaatagaagaataaaaaaattactcctgaataagtaacaactagcctcggaaatacacatggcccccgtcttataatgtttctacttagtgatttttcaactttagggtggtgagaaagtgatatacattcattcgaaaccatacttcagtatagtattcactaaattgaatgagatattcaacactttactataaaataggtcttgtgttctatgactttgcgcaactgtaggttaacataggtgttcagagcatgtttaaggtaagctaggctaaaccatgatatttggtgggttaagtgtattgaatgcatttccgcatacaaaattctcaacttacaatgggtttatctggatataaccccatcacaagtcaaggaacattctgtacaatagaagaatatgatcaaaagtttgtaagatcctctaaggaagattttgtcaaaagcaaacgtggcttagcttgtatgtattctcttattttaaagtttttttagctttagaatatttgccacatctggaaataactttacgtatattttatgtggttaacattttatttacagttttttaagatataaatatgcaattttataatgtttaacacattcttaaaggtaatttgtttttaggatactttacgtggaaatttataactttcttagaatttgggatgtttgatgaagcaatatgcattttacaaatcttgaaatttatataattatacattttaacaggaattttcctacacagtcgtacatgatttcactgtatcttcacaagagtacagttgagtaggcaggggcagttattatcactgatttaatttcaacgttaaaaaacaggcctaaatatcttatgttacttgcccaagggtacaactatcaacaatcaggttaaatctttctaagcttttcaggttccaatacagtactttgctaaactctctactctactgcttatcataaccacataatgaaagctcactgatgtggaaaaatgttagtaatgttttaattatatgtgggttccctgtcacacattttcataaatgattgttttagattcagtatatacaaacctagaacaatttcttcatgcttatatgcatatagatttgtagaatgcacatgtctagatgatttaactcagtgagttaggatacaatataaaaagaagtaaatttggttttctcttttagtaccagcgcttactaacactgccctgtcttcttctatctcagagtccacacctacatgtatcagaccatcactcactaattcaacagatgtacattcagtacctttaagtgctaggtgctgttctaggagttctagatacagtggtggaggaaaaaaacaacaaacaagatactaatttttcttcctggtggctgtgtgtatgtatcaccttcttgaaaaatgtagcactgcagttacatgggttatacatatacttaaatgcatgtatagtgtttatagacttataaaactctaggcactattgtcgtcatattttgggaaggtgaaaataatagctttaagcagttttaggtatcagaaatgccttgagacactttgtaacttggttaacagaggagcacataactttcatttctaagaaaaaaggattagaaaaacccattagtaactgttgtgacagcggccgttggggagtagatctatcttaaaatggaaaaagagaaataagagaaccaaagactcaaactccagttcattttcactctctggaatttgtctttatctgacagataaaggcaacaccctatataaatctaattcttacactcttcacatcccatccagctaccaggcactacattaatgacatatcgaattgggaactgtgttcaatcaaaaggcattaaagtacttattaactaggttttacggagcttccaaaaaaagttaaaaagttatttttggtggctctatggtaaggtgaccttttaattttttcttcatggtttattgtccccatgtgagaaaacactttctaaacacagctacgtatttggaccaaaatattcttcataggatgatgcattgtctttgcataaataacgaatcagtaattatatatcacacataaaaaacgacattataactggtcgaagcacagcttcaaccgtttgtgaataaaaggaaaacctccccacaacttaactgcaacttcaaaatttctaccagcctcatgatttgtaagttttaatatggaagtttctgctttctacactttacacgatggggattatgaaaacagtgctgctgggagaatggaaggagtaggagtgcgttcttaaagtacattttagcagagttgggagtaaattgcagcataatagtcaaggtaggacaactgctaggcttgataaaataatggttggggataaagaatggataatttcctacaagagagatttgtataaaatataaaagaaaactgtaccgaagcacatataaatatgagctgggcatgactgaaaggcagtaaatatctataatctcttctctatagtacaaatcttttcatataatacaaatgaaaaataatgtactatggaaataatttaagcatgatttaaactacagttaatgattaatatttgaaaatacacacatttatatatagcaaatcaatcaaataaatcccaagtcatataagctgttgaagaaacaaattatatttataaccaaataaatgtgttgaaaaactcaatttttctaagagaaaccactgatcacattattgcaaatgtttatgtatagttcaaaagatcagtttctacaaagtcacaatgtattaataaaaatcatcttttccacgcattaaactgttagaactattaaactattagaaaattcaactcgaattcaaaaagcatttgcaaacaaattttgctttgaaattttatatgatccatgattatttagagtaattgcaatgtcctcttattccaatattattaaatacccctgtattacaatatgcatataaacaatgtaatatgcccctgtattacaatacgcatataaacaatcgttcttttattttccttcagatattttgtttggatttctacatatggtgcctcttgctattatctaattctcctaataccagaatagaaaagcagtcactttgctcatggcataattttgccttcatttaactaattgggattattaaatttgtgcttaagagctgtgaaacagattccagaggagaaagatcttaaccagtgtattaaaaatctctgttgccagtacttttgtccctacttcaaggcaagactgaagaatcgaagactaaaatatgagaagaaatcatacatctctcaagggatcttctgctaggttttacgagaccaaagttctaactcagccccaagtcggccgagaatgggttttcatagacacatgcttaagtttctgtatgaccagagaaatatatctgctatctctaatttcaaaatatttccagaatctgacattctctcactaccgaccaagtccaagccaccagcatctctttttcaactcttgttgattctattattggtcccctacagttctactctcaacccagaagccagtgtgatccttttaaaacatgattgagatcatgccactcaactgctcagaaacttacaattgctctcatctcatttagaatcttctttacaatggccccaaaggccctccacaatctggacactcacaactcccatatcctcatctctttctacccttccactggcttgttttgcttcagccactttggccttcttgttggtgcttgattaagataagctcagtcccacatttgggcctctactctatttcctctacacagactccatggctgactcccttaccttcttccaatctttgctcaaaggtcatttctaccctatttgaaatggcaattccgccactttcaattatacctacgtctacccctgtagtggtcctatatccccttaacagattctggtttttttttttttcccaaaatacgtatcacctagtaatacgcaatatttacttatcatttttctttgtttgcttgcttctattctgtctcccaatgttataataaaagctgaatgagggcaaagattcgttagtctttttcactgttttataagcacttagaatagtgtgtggtacatactaagagcttaataactatttttggaatatacgaatccacattccttaggtttacttgtcctaacaattttttgtttctcaagagcaatgcaaaaaacctgaactcaagaggacttgaacgacctggcttcacactatctttggcttataagctcactaccagctttcccttgtggtctcgaacttgaacaagggttgtctctatttcttgatcctatttaaaatctacattaggaccaccatgtctcctacccgtgagctttcttcatatggccacgtttttcatcaccctcttggttacccaaagtatagcacattttattcattccaaacaaggcatctgtactataattggttttgatgagacaactgaaatgatgtgtgcctgatattttttctttccttccatttatttcctccttgtttctctccttattttatttcttttcttcaattctccctccctccttccctcactctctttcttccttacttcctcccttccttcctcctcctttcagtgatttgaaactccagtgcaatgtggaatattgaagggatgtgggcagatatccttgtcttgttcatgttcttcaggtgaagacattctgctctaccataaagaataatattagctgtaaattgattctcattattgcaaaaggtaaagcatagttgtcattcttattataagctatgttcttatttttgtcctaaaaattcacatttattgataccaaggcctaattgaacagctaaggattccctgaatgagggagcagcagaatcacttgaagaattccactccaaaggcatgaactatttctaagaatttctctacgtaaatgctaactacacagtaaatatgtcattatttatttcaaaaatgtcctagatagagttcccctataagcagattcgaagacaagggatgtctttgggaatgatccaaggaggtgctagtaaagtgtgtgtaaggtaggacagggagcaagtgaaatgtatcctatgaggcaggtttttactgtgtgcgatggggtcttaatcctggaacagaattttgggtcagagcataaatcatgcttcagagttaccctaactgaagaatgagtgagtagtggtatttatccaccaaaagttatttgttattggttgaggtttgctggggaacacgggggatgcagaactttaactacctgacactcatgagctttgattactagagagagccctaaggcaaacagtcagagacacttggatctggcagctaccagtcagagtacaaggcatgctgagtcaggaaatgatatgggtgacatcccaagagtgtttcatcctccaataaaactgatgctttcagtaaaattaggcatatggacacatgatgataaatcctttcagttaagtcttttaagtggatcatttctgcttttaggataagctttcaaatatttaactctctccagagaaaaccttttggtaatttaaaacttacgatgctaagaaattctgtgttcatgctttcatatgagatactttaaggcaggatttgacggtttaacacagtaattatattttggaaaattttatcatgaaaatgattttttcttaaaaatgaaatgcaagttaatattgctctaaacttccaaaaaattgcaattcttctaaaattatgtactcttgtctgttatgagtattattaactttgtacatataagcaatcacaatcaattaactgttaatattggctctgaagtaagaaagaaaatattacttatgtgtatgtttctcattcttctctagctctgccttagctagtgtttttgctattaaatgcagatttccacatatgtatatatatatacgtatatatatatgtttgtgtttatctgcatagtctctgtcaacatgattaggtagctttccaattcaatacatctattgaaaccatacgtgctattttagttgtattttgtttagaaagtaattcttttaacatattacatattatttgtgttgtactgcactttcaaaaaagatgtatgttaaagcacagcaatacttactatagttctgtaatttgattcatgcatatctgtcaggaataaaatcaaccacaatttcaaaccttcccaaccagcagctgtacaatttatgcactgcttttccatttttactactggataatgacaatgatgaatgcctttaacaggaaatacatattcactgaaaagactgagctcaaaactatcccccttcaaaaaagtcaatgaaggtaggaagcccattcacctgctggagatttgttgggagacagaaggaatcatgcccacaactgtatcttatggggattcaaccatttagctaaattaaatctacaataataccatattataaaccgcagtaatcaatactattacgattgacatcagctataataatattaaatagatcaggatgaacaaatgattcactgtgagtgtagccaagggtctaacattctgagtatgccaggctaagaggtatggagacagagttattcaatgggcaacttaataagatcagggtcactactctcctgaaccaaatgtccatgaacctgggaaggaatggatattagctcattggcaataatttacttattgaatgacaatgatgcacttacaaactatgctgccatgagaacttagttaatagaaataatgacaggaattctggcatgtcagctttattttattaactgattaggtttcttttcttcattgtaccaataagtgatttgacttttacttcaaacagaataagaaacagtgccacactgacatggatggaatagttccagagatctgtgaagctcttattttactgtgtaattttatagcttatttgatataatgttaagatattaaagtcaagtcactgaagatactgcaacaccgatttccaaaacaaacaaatagctttatccatttgtatattcatacaggcaaatgtgtgatatagaatgagcttccaggaaaccatttgagtataaaatactttagctaatatgtgctgctgatagcaaacccatcttttgcctataatcacatactgtttgcatttgaaaataccaagctctgggtatactataatatttcattttgagtgtaaaatgtacgatcatgaaaattatctggagacacattattatgtgcattttcttgatcctacattcatttatcttcagacactgccttctgaaattcatagcctatttcatcatcattatttgccttacttgagaatttagtaacttgctgttggtggtttgaaaacagctggattttgttggtagcctttaactggcagttataaagaaaatattttattgatttctattcaattttattccatatgttatagcacaggtattgacattaatttgaaattgaatatgtatacataaaaaatataaaacaaaaacaatatacattacatataaatgaaaaatctaatttccctttttggaaaatgaaacagaagtcatccattaactaggaataaactgttcttccatcaaagtttatttactggtggttcctttctgtccctactgcatgtaaaaatgatcatttttgtgcatttcttcattttaggatgtctctcaaagctaaatattgtaaaatacattttctaacttatgtctttctaccctagatttctgaagccaaccacactatcaagtatttttaagaattccatgtgaaagtcaaaatgccatcatgatgcatacaatttaagtcaattgttctggcactatgaatgatcagtatgatcaccttgtaaaatacgaatgaaagtgctttggttttaccttcagagactcctcttgcttaaagagatcttcaaagtccttagcacagaggtcaggagcattgagaagttgttccacttctaatagggcttgtgagacatgagtgatttcagtcaaataagtagaaggcacataagaaatttccaaaggcatgtcttcagtcatcaccatcatcgtttcttcacggacagtgtgctggtatagatatacaaaagaacaattttttttagcttcctaacagtgaaacctcctccattaagtttatataggtctcattctacagctgacaattgaatctacaaactgggctgaaaatggattcaaaacctcacgatggtaagtctagtaaaacggtgatttattaattatatacctactttttccagaaagtgttaaaagcatttcataataagtgacacacacatattagcaccataaatataagacgaaagaccatgaggtcataaggagagtagttttatcctaagaaaaagacgatttttgcaaccggcatttaaatttctaattctaatttgcaactggcatttaaaattctaattttcctggaaatctagatatgggattgggtgagggggactcatatctgttttattcctaacacaggcaactttcctgtatctataggaaagttcactgagatacaacagatacgaagtagttaggctggtatgtaactttgtattaagccctcttctcctccaaattctagacattagctcctgtttttgttgctagtctcttgctaagttaagctgctaatgaagctgctatatgagcagaactgactgcggaatttatattttaaaaagaactccagaatgtcctgatatataagggagcactagcctcttctcttgcacctacacttttctgactgggatccaagtgctagacatgatgagaatttccagctccagagtccttttggagtttcccagtaatacatctttccctattctttataagagcaaaaaataaatactacttggcaggcaaattcagaaagatggatgacctgtgctctcttctgtctacactataggcagcaaaattcttgtaattgaaattattctcccaataactttgtctagaattgatcaactgccacctgcctgttgatgaggtcacctgagggtttcagtggtagggtctctggggaagtacaaacgataagcatgctaacgtagccatttattactgcacagccttttatgacaacaccatacttatttttgcagtaatgtaatacattggactttggggatactagactgaaccccacacaaagaggagtaaaatttacaagctggtcactttatgttttgtttttaatttctctgacctaggattttcatactcaattcttacatgatataaaaaatgaagtaattctaatttagatatctcatctacttgtgatatagcaaattcacagaattgcacaaattagctattaaataattataccttttacaacatttgttttattgtgtatatctgggccaaatccatggcacacattccttcatgttcaatggaataatgtatatatatttctcatttacatttaaaaggatattagaaacttgagccagagtttgataaataaaattcagaatttaacagatttcttaagaaattcttaatttcactatttcatcataagcattttacacatttaaaagaaaaataactcagcaggctatttgaatgtgaaattttcactgacacattaaacagtagaatcaatagcacaagtaacacaagcttgtgttttgcacgcattacattggttggtgaccattatgttgttcttaataaaatttacaagttaataagctcgtctttcttattcacgttagttgctataacccctgcagtaaagatagcttcacatcatctaaagcaagcgtatttcttataatacttatttaatggtgcaattaaatctgcctttaatgatacattttacacctgtaagtttttggaaaacaaaggtttttgttatcaggaacagagtaagtagaagacaagttgtagtttttcatttatttattaatttgttttgttgtttaatcaagggagttgtttcagaattggacatatcttgaaaatatttagaaaaaaatctgggtggccttaacaaaagcagtgggaattcagaaaagttttgatgcatgtcctcatcactttttcttaaaagaaaaataattctaagatgtttttatctattttctgattcttctttgatatgtagttttctcagtcttcattactttcatttgagatgctctcagctatcttaaattcatattggtgcttaataaatatagtaattgtggattatagccagcaagaaacttagctgtatggtcaaatataatgaagaaaaagacactcaaaatatactcacttttgtctgctaacttgtatttaacttccttaaatgaaatttcaaacccaaattttgactattttggtatttgcagaaaggaacgttaaataaaaatgagatttgccaatgaatccaggagctggtcttttgaaaagattaacaaaatagatagaccactagccagactaataaagaagaaaagagaaaagaatcaaagaggcacaataaaaaatgataaaggggatatcaccaccgatcccacagaaatacaaactaccatcagagaatactatcaacacctctacgcaaataaactagaaaatctagaaaaaatggataaattcctggacacatacaccctcccaagactaaaccaggaagaagttgaatccctgaatagaccaataacaagttctgaaattgaggcagtaatagcctacgaaccaaaaaaaaaaaaaaaaaaaaaagcccaggaccagacggattcacagctgaattctaccagagatacaaagaggagctggtaccattccctctaaaactattccaagcaatacaaaagaaaataaattcttccctaactctttttatgaggccagcagcatcctgataccaaaacctggcaaagacacaacaaaaaagaaaatcctcaataaaatactggcaaaccaaatccagtagcacattaaaaagcatatccatcacaatcaagtaggcttcatccctgggatgcaaagctggttcaacatacgcaaatcaataaatgtaacccatcacataaacagaaccaatgaccaaaaaaaccacatgattatctcaatagatgcagaaaaggtcttggataaattcaacaccctttcatgttaaaaacactcaataaactagttattgatgggacaaatctcaaaatattaagagctatttatgacaaacccacagccagtatcatactgaatgggcaaaagctagaagcattccctttgaaaactggcacaagacaaggatgccctctctcaccactcctattcaacatagtattggaagtcctggccagggcaatcaggcaagagaaagaaagaaagatattcaaataggaagagaggaagtcaaattatctctgtttgcagatgacatgattgtatatttagaaaaccccatcgtctcagcccaaaaactctttaagctgataagcaacttcagcaaagtctcaggatacaaaatcaacgtgcaaaaatcacaagcattcctataaaccaataacagacagagagccaaataatgagagaactcccattaaaaattgctacaaagagaataaaatacctaggaatacaacttgcaagggatgtgaagggcctcttcaaggagaactacaaaccactgctcaaggaaataagagaggacccaaacaaatggaaaaacattccatgcttatggaaaggaagaatcaataacatgaaaatggccatagcgcccaaagtaatttatagattcaatgctactcccatcaagctaccattgactttcttcacagaattagaacaaactactttacatttcatatggaaccaaaaaagggcccatatagccaagaaaatcctaagcaagaataacaaagctggaggcatcacgctacctgacttcaaactatactataatgctacagtaaccaaaacagattatactgatagcaaaacagatatatagaccaacggaacagaacagaggcctcagaaatatcaccacacatctacaaccatctgatctttgacaaacctgacaaaaacaagcaatgtggaaaagattccctatttaataaatggtgtcgggaaaactggctggccatatgcagaaaacggaaactagacccctttcttacaccttatacaaaaattaactcatgatggattaaagacttaaacctaagacctgaaaccataaaaactctagaagaaaacctaggcaataccattcaggatacaggcatgggcaaagacttcatgactaaaacaccaaaagcaacagcaacaaaagccaaaattgacaaatgggatctaattaaactgaagagcacagcaaaagaccctatcatgagagtcaacaggcaacctacagaatgagagaaaacttttgcaatctatccatctgacaaagggctattatccagaatctataaggaacttaaacaaatttacaagaaaaaaaagaccccatcagaaagtgggcaaaggatatgaacagacacttcgcaaaagaagacatttacgcggccaacaaacataagaaaaaaacctcatcatcactggtcattagagaaatgcaagtcaaaaccacaacgagatagcatctcacaccagttagaatggcgatcattaaaaagtcaggaaacaactgatgctggagaagatgtggagaaataggaactcttttacactgttggtgggagtgtaaattagttccaccattgtggaagacagtgtgcagattcctcaaggatctagaaccagaaataccatttgacccagcaatcccattactggatatatacccaaaggattataaatcatcctactataaagacacatgcacacgtatgtttattgcagcactgttcacaatagcaaagaattgcaaccaacccaaatgcccaccagtgatagactggataaagaaaattgacacatatacaccatgggacactatgcagccataaaaaagaatgagttcgtgtcctttgcaggaacatggatgaaactagaaaccgtcattctcagcaaactaacacaggaacagaaaaccaaacactgcatgttctcactgataatgggagttgaacaatgaaaacatatggccgcaggggcctgttggcgggtggggggcaaggggagggatagcattaggagaaatacctaatgtagatgacaggttgatgggtgcagcaaaccaccacggaacatgtatacctatgcaacaaacctgcacgttctgtacatgtatcccagaacttaagtataattaaaaaaaaaaagaaaaaatcattcagtgacactggataaaataaaaattagattcacttagaaaataataattcgtgctctcagaccagaattctgtgtctcagcaaataagatccagtgttaatcatagtcctaaaccagggcttaaagaatgtaggcagcacaccataccctggcttctcatctgttaagcttctctccacctgaccccatgtgtctaccatagattattatataccgatttaacaaatattcttcagaacattaaactaaaaaccattttcacctatctttcaaagaaaatctcttttagaagagtgttatgtggcatctatttaaattgccaatttttctggtaatcatccttttactctctgtacaagagttcaatttttaagaaaattttagatacctaagtgacaaataattgtaattctgtatctggttctagaaatcattttttacaaacttttaaataatgaagaagctcttattaacctgatcgaaatactcttaaaagaaatattagccattgaactgcaggttgagaatgctctaataatatgcatattgtgattattttcaagattgtcacaaataagccatagagcaaccagtgtcaatacatggaaataatccctacatgctcagccatggcatgaacacattttctagaacacttagaaatattaaaattcttatggttgaacataatcaataaaaaggtatagtttattactttagaaaaatctgaatgagaaaaatcatttctatcctcaactactgataattaagtaatctttcaaaaatttttctttccattataaagataaattagaatacctgtaatttctaagatgcttctcattacaattacctatgggcaacagttcagctatacgttataaagtctaaaaggttaatgttatactttaaatatatttaatgaagacggatctattgaaagatttactatcttgatacgtagtgtccagtcatcacagataacagacactaagtggtacagatcagctgactagagaaaactaagggttgatcctgtgaactttcttgagaaatagaaatattccaaaataactttttgacaccactgggaaactgtgaactcattttctagaaaattccgtgttattaagtttgaatattctcatttattatagcaatctgatatatacaataatgtttaatatatagacttttttgtaattttcatatacaagaaactaccagaaattgaatcaaaagagaaccagacatttggagatctagtttgctatctattccttaaaagtatagcattcctattgacacagtcatgcgaatctataatgagaaaactacatccattgaatgactttcagtttggtttaataaaaatttcagacagttatttaaaaatcagtgtaattagaaatatcatgttcattttctcttctttatgcaaaatccaggtactcattcagattaatccttttcatttgaatttcattaactctgccttgaataattttatccttctgagttctgatgtgtacaaatcccgtctaaccttttgaaaatcaacttgcttttgttaatgttctttaccaccttatatcattatagatactcatgcatcattagcaaggaaatgctataatctgattaattcattttatttctttgtgtttattttcatttttaaccatatataccccaaagaatatactagcctcattttctagaaacaaaaagatatgtgaaagaaaccataaaatgcctatttttatttaaaaatgaaaagttcgatcaatgcttaatgactattatagaacacaattatgatttgtatgatctaaacttaaagtcaaaacagttttaagattctgagctgtgtaaataggcacaggtatcactcacaaagttttgaatacattttcattcatctgaaacttaagttatcacattcttttcattacataaaatttgtttcttgaagggccataactgcaaaggataaaagcaatcctgttttgaaacaaatggtgcattatgtctaggtttttaaacaaaatgttttcctccatgatttaaaagacttctttctcctttaaatgcattgaggttactggcccatttatgagttatgaggtcaaagaaactcaagaagaaaaatgtgctatatgacatatgattatgacatatgccacaaaataactatatatctcatataaatatggcacatgaaaaatatatcaatgcatcaaaagtgtaacaaaaatagactattatcttgaccaaaaacagtaaaatagtgatggagcctttttttttttaactgcgttggtgttaatgaagatgaaaataagcaaatcctcaaagtaagatttattaatgatttagtgtgagctataatatgaaaatctatgagccataatatgaaagtatgtcagtttgtatctgattatctttcctcaaagggacattcttaaatattatggattatttaaaagtaataacacaatgatatgtaaatccaaaataggactgcaggctttaagtaggttctgatgggtcataaatgaaaaggcaatgggaaagacttaagtcttagacaagtagctctgtctcttagccccacaagtcttcagagaaagacaagtttccttctaggaatcattacagtaataaacaaagttgagagattttttatttatttctcctggacaattataataggcattgtaagcataaaaatgcaaatcacaaacaaattaggcaaaaatattgtattggtccagggtgattaaaaaaccccaaacaataaagcataaaaacaaaacaacatgatgcaggtgagacgggtatggttttaatctgcgttgtcactgttttggatacatataatggcatgacaataacagcattctgacagtacttcgttttgtctgttttagtcaagtcactgggtagaaagatgttgaataatcaatctaatgagtctaagcatattggttatgaccgtgcatagaaaaaatagcaatgagagagtgtttgctcttatgtgatttcccccttcctattgcatcatctaaaaaattgcttatgtgaagctatgtaaccaaaaaaagggcctgtccatctcagaataattattcagaatcaatgaacaatttaccccctttgtttaaaaagaataaaactcactaacatacacaaaatagtcaaggtaaaatatgaaagaaaatcatcctttatgcccatattatttattttctaaagttagaattaatttttaaagcagggcaggctgtcagcgaaaaagatatgcagatgatgctggatttgccagtctttaaatacaccctgcttctagaaggccaggtataaatagtgtcctatgtaaaaggtctggacagacctgctcattgacctgcctcatgtggattctgactttctacaccatgaaatttacctaattcctcagggccaagctcaattactatcaaattaagctgataaactgaatctggaaaatgtgttaatggcttatagtggtttaaagtctttcgtttcaaaggacaacatttgcatttttatacagattttcaaagaattaacataaattagtaacttgataaaattttagtcactaagtatggcctgtgagagaagagaaagaaaagggctttggttgccaccaagataagtatcaacacataagcagcaatatataagcaccaacaatcatggcctgctttgtaaaaccatctccaaaaaataacctataaattaatagataaggttatacaccctagccaacttataaggcagcaaaaaataaatgcagcaaagactcatgcctagtacctagcatacagtatgttatcaaaaatatttgttggataaattaatgaaaaaacaagtatcaacttaacaggataattataagatagatatgtggttacaattgctgggatttacatttataatttatatttaggaatattcagaattcaaacaggaatattttcttcattttataatgcaatctttattgtcatagatttaaaaggtatatctgatttcactatgtcgcatttcttcaattcatagcacattagctacatgctattgtacatgcgtgcttaggtccttaaattgtcttttagttactaatctgactcattatacttgaatacaaacataagcaattatttgaggtaatgacatatagacgatattaagatatactgattttagcttcttcatgggtatcataatgtctattagcaaattgaagggtatgagaagacttgtattcaaaaaatcattttaacctttgataactcttcccaaactcttctcataaaagttttcgtttacatatctagtatatattttttattttaagctattccaaaatttcagcttgggaatacttgctatagcaatctttttgtatgttgacaagcaaatcgaaccctccctccacctcacacacatacttatacttaattcagtgtgaaaataaaagtaacacaagaaaaaataagtatggaaagaccttaaatactgcagttatatttcaccctcctatatcgcttttaacttctgttgccttgtggatctgtcaacttgagtagatttttcagaataaactcacacttttatttctatattacatttgtcacacccctcagaaaatgtggacactatctctagattaatgcggcaactcagtatctatgtctaaatatgcatgtgtcataattatgtttttcaaggaagtattctcttcattagaaatgcgagtgatagtaaagatgcatataattacactatcccgtatggtagtcattagctacacttgacgaaagaaatgtaaatctaaattatttaaaagcaaatacaattaaaaacttagtacatctgtttttactagccatgttttaagttctcagtagcctcaatagctactttattggacagtgtagatatagaacattgccatcatctcagaaagttctataggacagtgctaatctagagaatgacaatacattttatttatagaaaaggttaataccaaagtatgttctgtaatcgttttttattctactcagtctctgtccaaagggctgtctagtacttaatgtggttaaagttacctaatgagcactcaattaatattcttttataatggcaatcatacaagaaagaaagatttgtttctttttcaaattgcttattaaaatataacaatgtgttctattttaaataatgtgaaaactaagattatatgaataattctaatgctggtattatatctatcagaaaatacttgtagcctagttttttcacaaaggtaatttagacaggctactaaatccaaactaaaatgtcacaaggtgaaaactcaactaatttgttattattctatatccaattgattttactgaattgctaatacactgtattttgttttcaggtagacacagcctaaatctgtaagtaatctcactcaactctgaagataattaatttaaaaacctattattgtgaattatacataatttgcattatttatatggtcaaagcttattaattatatatatgcacatgtatgtatgtacgtgtctgtgcaaatacagacacacaaaatagaaatgttgagaatgggtaaatcacatcgtagatatgttttctgtttcactttgaactgagtccatgcaacgtcaagataatcacaactaactgctacaatttagaagaatatatgtatcaggacctcaaattatggaaaaaaaaattgcaggtgaagagagaatgatgatgaactggtgatatttcaaagttatgtgtatcttggcacgatctgagacagaaatgatggatctgatggttttcaagtatatatgtggaatgatctgttggagaccattgatttaaggagatctgtttgacttaagaagggggtcagtacctgctagtttgtttcatgcaggcattactggagagtggctgtactacatggttgaggacagccttacttccaccccttgtccatgagatcagagatgttttcccatatgtaaattttgtgaataggtttcagcttgttaaataattattcatcagatcaaaacaacaacaacaacaacaaaacttccagtatccatgttgcttctcaatcaatcactatgcatcaaaatatcaaaaccttaactgcatttgcgccaagacattttacattctttgacttaggcatgagagaaaataaagcaaaggctttttcagaagacacaaggggctggagagaaagacaaagctgagagtccatacaagtagtatactagaagatacggaaggtacatttaataaaaataaaattagaaacattaaaaggttaacattagagcacagaaagcctgttacctagtttttaaataacaatagacaacttagaaaagagaatgatcatggctaaaaataaaatatgggttctttacagtcaaccagaagaagtatatcacaatttaaagacaaatagaaataaactgacattaatagtgaaaaaataagagacttagagaacagatctaagatacctattaagcaatgataagtaccagaatgagaaaaaagaagagatggaagatttgtaataattaaaacaatcataatagaaaattttccagagctaaagaagttattaatattaattggttatttaaaacgttacccaagtgcaaaaaagaattaaataagtggtgggtcacaactgaaatcccagcactttaggaggctgaggtgagaagattacttgattccaggagttcaagaccagcctgggcaacataatgacacatcatctctacaaacaaatgttttaaaaattagccagtcatggtactgatggcctgtagtcccagccactaaagaggctgaggcaataggatctcctgagcctaggagttggtggctgcagtgagctatgattgcatcgcggcactccagcttgggcaatagcaagaccctgtctcaaaaataaaaacaaaataaaataaaataaaataataaacagggacacatttagaaacatttaaaattatatcttaatgaaatttctgtacttcaatagatgggacagacagcaactttagagtttgagagaaagaaaaaaggttaaatacaaataaatgatacttggactagaatcagactttacactggaaacaatagtagcttgaagatagttgaaacaagaaaacaatggaaactggaagacaattgttcataacctacagagactactaaaaaaagaggagagatattaaagaatgttactatccaataaatccatcatgatgactgcaaagcaaagatcatttcgaaaatgcaaggtttacaaagtttacatcctttatgtttttacgaggacatttctcatgtgttccaaccaaattaaaactgaagtacagttggccctctgtatccatgggttccacatttgtggatttaaccagtcatcgatcgaacacatttgcaaaaatacatggatggctgtgtctgcactgaacatgtacagacatttttattgccattattccctaaacaatactgcataacaactatttacatagcatttacattgtattgggtactataaataatctagagatgatatgaagtgttcaggagggtgtccatagttacatgcaaacactatgccattttatataaataatttgagtattcttgaattttgatatcaaaatgctgaaaccagtgccccacagacactgaaggatgactgtgtaataaagatttcaaaacaatgagaaataaacggtacaaaaaaacagtgacaggaaatacaccttgtgtcgtttgtggtcaaattttatgaagtgatagtgtaatttaagtaataacatgacatcttgaactagtatgtgatactacaagtgaaaacaatagtagccaggaaataaaattataaattatttctttttaaaggattttgcctttgattgaaaataatgaggagttgactaagtaaatcatcttggtgatgagggcattgttcttatttaattttggcgcaacactacagaaatataggcataaaattgttgtttaaaatgggaaacagcactagtaaaatgatagtacaaagtataacttataaataacctataagtgcgggaagagatgcagtagagtgcagtgaagaagatgatgaattataaaattatagacaagggataagagtaaataaaatgataaaataatgaccatcaatatgacaaggaattaaaacagacacagttataagagttattgtaaaaatgaagttggttaaaatgtctcatctaaagatgaactatctatcatttttatatcttcataagatcaagcacgtattggtaagaatatgtgatttttttttatagataccagaggctgggaagagtgtaggtgggcggaatgggtgaagagagattggttactgggtacggacatacagttgcatagaaagagtaagtgctaatgtttgaaagaagagtagggtgactataatcaacaatatattgtatctctcaaaatacctagaagagaggagttgaactatttccaacacatataaatgataaatacttgagatgatggataccctaactatcctgacttaatcattatacattctatgcatgtagcaaaatattacatgtaccctataaagatgtaaaaatatttgcataagttaaaaagacaaaattatctagtttaaaatgcacactccatctataggctgtttacaagaaacataaaaatacaaggtcacaatgctgcgttaatggtgatttagaaaaccattttttaaaaagtgaaagtcacaagaaacataaaaatacaaggtcacaatgctgcgttaatggtgatttagaaaaccattttttaaaaagtgaaagtcaaaataatagcatcaaatgaagtatagttcaagaccgaaaagcactaaatgggtctcagagaaccattgtaatgacaaaaatcacacttcttcccaaagcacagtagtcattaattgctatgccccaaacaattgggtgcattctacataaggtaaaaattactagaaataaaaggagaacatgataaaatcatagctgtagttggtaccttacatacaactcttctgtaatttgttagattaaaatagacaaaaaatacaaataaaaaacaagaatagaggtggtttaaaaccgacaagctaaatttaatccgtattttgtgcacactggaaaaagcatattctcctatttacttgggacatcaaaaattacatagagaggaaacttttaaaagcatcaaaaagaaagatttgataggccaccttttctaatcaaaatataataatccagaaatgtagaagaataatagaatacattttgattcatcatctaagactttcacaaagaatgtataagatctatatacattacctgggaacatgtttctaattgactgttatatttaaaataatacacagaataaagcagtattttttaaaaaagtaaaatatatctatatatactattcattggtaagaatgaacagtatatggaatatagtacaaagagatatctaagactaaactatagactttttaaagactaaattgtagactttttttttgcttcagtgagggaggaatcagcagaatgaagaaatgaagagtagtaaagtttccttaatctacctttgtattaattgattaaagtaatactgcaatacatttaaaataatcgcacagagctctgaactagcactaaagagtagatgcaaatagatacagatttcaaggtaaattgagtctttacataacatatttatcagtaggcatggccccctctaattgactttattgttcataatagacttcacttctattcaagctgcaggaaggcatgtactactaattggctcccaatattatggaagcatagactaagacaaaattcagaagggagaatgaaagcattttgaaacaatttcacatcatcacctaaaaccatattggtgcccctcactgcatacccaattgacagaagagtcgtggcaaagactagtggctgctgttgcccatgaagtaaagagaattatttttaggtgcctgagattcctggagatgaggaaatttaacagccaatggctaatagcactcttatgtgacagcatccaatactcgatatattttaattgatcttaagtactcaattttttttttttttttttttgagacggagtctcgctctgttgcccaggctggagtgcagtggcttgatctcggctcactgcaaactacacttcccaggttcaatttataagcaactaattaaataagtatcactaatgagaaaaatacccaagccaaagtaaacatttagctaaggatattgtaatccataaaaatacaactttttgtttgcatttgaaatgactgcttcaattctccccatgtatttgaagtcactttgctaagctgaaaagttttcctctttggcctggcacattagaccatctttatttccatgcccttaacttgaagggacactaatgacattgtgatatactgataacagtatttacaaaattatctgacctaattccaaataacaagtttgagagttaccctgcattctattcttctttgaaatatgcacaacaatttcatatacctgcaataaaaagcaggcagttaaaaaaacacaactttaggaactcgactaaaagatggagaataacctacaaaaatcataatcttgatgagttcagcaggcatttttttcaaagccaaaggacatattttgctaagtaacttaatagatgtaaatagcaaataacatatagcatagctacataaataagcatatgtgtaacatatatgaatacatttatgtgtgcctatgcagcctcagatgtaaatatagagatataagttagctggtggcagtggtatgtgatttaggaagctaatatgccatatggcattatgtattaaacacttttgcacataggtaagatattaaagatccttgggctgggcgccatggctcacaccagtaatcccagcactttgggaggccgaggcaggcagatcatttgaggtcaggagttcaagacaagcctggacaacatggtgaaaccctgtctgtactaaaaaaataaaaaaattagccaggcgtgatggcggttgcctgtaatcccagcaactctggaggttgaggcaggagaatcacttgaacctgggagacagagggtgcagtgagccgagatcatgccactgcactccagcctgggtgacagggtgagaatctgtctcaaaaaaaaaaaaaaagtatttacctaactatatgaataaactattgaaataattaaattatccataagtataaaatgaaataaacactaattatctgttctctctctctgtctcccttcctccatccctccctctctcatctgtgttgccctgtgctaaattatttccccaaactatgagtccatatatataggttctttttcaccttactcgaggctgcagctattatctcctgtttcagtcatttattccttctgtcccattttgacttcaaagctactaggggcacaaaaaaaaaaagagataattaagtttattagaattacctctttaatcaaagcaaaatttttaaaaaatctccaaaaaaggatttggaaattcatttcataatgaaatataagtaagctttggatttcatgaaccttaaaaaatcaattttgggaatcgagaggccttttgttctactccattcctgactcttggctgtgttgcaggtaaattaaaatgatatccatctgacctctgaataaataaagtgccactgtgtgtatagaaatggttatatttaatattattttcccaaaataatatattttgccaggttataactttgcaaaatatggtaatagtcactgaagaaaaccatttttctcttaccaaagattacgctcaattcttttttaaaagttttgtgaatttaatgacaccttaggcttaatgtgctctactttacaatccagatagtttctcctaaaatagcttgttctctgtcaatgttccaggaaataatagtcattgtattatcctatggcaaggattccaatataaaattgttctattctgtccagaaaatttacaagttttaactctaaaaactcatattgacacaatcaattttcactccattttagatcatatattttgaaaaggtaattaactgagaacttggatatgactgttcctccccacaatctccttgtaaaagcagctacaacagaaataaagtattttaccaaataaaaaataaattttttttcacttctcaaaacttttcagaatacaaatttaattggcttatattatatccagaccaattatttcttaaataataattaactaaaatgatgaacgttagagtcttttgtcaatcacaaataattatgttaattattagtcattatgatcactgggaaataaagaatgtgaaaaaagcatgcataataacattaacgcattttgttaagtttttgatcttgatgcattgtttacaattatgaaaaggacagaaaatgtaatacttctgttttgaattaatttttggattccaaatatcatcaggaaatgatactattatgagttctttatatcaccaaaacaaacaaaaacagattcaaatccagaggatgaaaatatttatacacaagaaaataccattttggtacctttattatttgtaagtgttaacgttgaacaatgttagacaaatgtcgtgataccctaattctactcttttttgtgtattttgtcttgtttttgctcctcacatgtgacaaaataaattcaagaatgttattccagtggataactgttatggggccagtactgcttgccgaacaggccatacatataggaggtgatggttttcatgctttctcttcctcattctgaaacttcaagcaaccaatatagaaacttagcaggaatggtattccttcatgtaaataaatttatctaagttggtggtttacggacattgtatttcataggtcaataacaacattacaaaaaaaaaaaactattagggaacatcacaaaagttctgccctttactttttctagtaaaggacattgtaacaaaatgagaagaaagaaaaagaaaggccattttaatacctccaaaactgttgaaacccataattttgaaagaaaggacaattcttgcattaaaaaactttgctttatgaaaagctaaataaaaaattgctcttttttttcttttccttatggaccattgaaaacttctggaccatggcagactggcattaggataccactgacataaaaatacagaacaaccaactctgaaactgcagggatttccacaggaagatgttatacattcattcattcaatcattcattccacatactttcattaaatacctgctctgtgatagactctatgtcttggggaaacagtgactaacaagatagaataggctcctgacttcatcaagcctacattctaatgatagcagacaaattataaacaagtaaacatgcaaaggtaacatttgcagattgcagtaaatattagaagggaaacgtctagctgatgttctagagcatgatggtaaggatagaatggatgtggcgaacgacataaaataggttgtcgaaggcaggccacctgtggagataatgttcactctgcatcctgcaatgtgacgggagaccagcaaggaaatatccagaaatagaggcccaagtcaaaggaaacataattgcaatgacctgaggtagaagacatcttggcaagtttaaagaagaggagggctttgtagcagattaaagagaccctttcccattagggaggccaatatatgaagaggactagatctcttaattttccacatatgaaatactcgagtgtatctacgaagcaagaaatgaaaatatagtgaccgatattattcatgtttcatgtgtgtttatgattgtctagatactaaccagttaacacattttgagctttatacgggtcacagatggagttatatgttatagataactgtatttgttaggtaattcatttatttttcatcacccagatagtctattaactaagaaagcactaattattatggaaaattatggaccttctggaactttccccagttaatttattctggcgagaagtgcccatgcactgatatccagaaaaacagttaacaatgcctccaaattatctgaacatcttaagtttgtacagatatgggcacttggattatatttaatccatgcatctttcatccatggattagtcaccactaaatatagctttcctctgttttacatgcgttaaaatagctatttaggaattttaaaaactgctcatgattatagcatatggtgctaaatttgagaatgcaatcaattcggacttccatttagttctcttggctgttactaaatgggtgctaaactatactcaaaagattaaataaagggtaaaaatgatagaatgtttttaagcaaaattatgttataacatcaaggctatgtgaatttgtattattcataaaactaaattttaaacaaaccttaattatttcaaaagcaactggatcataaaggagggcaggagaattatcagataacttaccaacttgaaaatattataatccttttattttgtgaaaatcaaagtggaaaacaatatacacttgaatagattttattcatctgttctcagaatatgttccatacaatgagagtcttaagtaatcattgaagaatcagaatgattcacagatggtgcaagtgatttaattatttttaaccagttgttctggacatgctcagaaggatatttccaaccccactgcagaagccatctgagctcccttccagctggtgttccatattttcaaagcaaatttagattggagaaaattacactttatattgttgtgttgcaaacggaggtcaaattgctgtgtataaattcttgttcttttttttcttcattgtatgagttatatttatcaaatatcacgtcttttgtatgattgctatggatttgccaatggtattttacgttttgtgttgtctggcacttaggaggcactagataaatgtttattcaatgaaagaaataccaattcagtgtattcaaaataaaacttgaatttatttctagactcacactaagtgtatggagttaccatttaactgcatcctcaccattattgggaggttcccattaaaaatgaacaaaaaaaggaagaaaccaatgtaataaaacaataccacgatcactacccccatcatcaaagaaaatcatcaacaaaactctgtgttaattcaataagtaaaactacatcttgatgctggaaccctgtcccctaattttataggatcttaggaaacctgcttgacaaattttcacctttttaggctatcataaggataagagataccctttgtaaaaatttagtcttgcatacttcataatgcggaatgactgtaacatcagtcaagaaacataactgatatctgtaatcatttccactatgctaagaaaagggaatggaaggaatatgggcatcccattaatgtccatagtcacaatgagaagtaacaaactgttcccaaatagttctatcaaatgtaataatttttcaaggttgtagcattcaaataaagataatactaactttagtgaaccaagtttcctcatctgatgctaaaaatgagttatatttttttaattttatcagtaacattatatgatagtaaaactgcacatatcaataattcatcacttcattttgtatttatatccaatatttctgaaaaatatattaatcatagattttgcagtcaatatttcctgaagaatgtgctaaatttccacttgatagaaaaatttgacacagtatattactatgttttttcttatgtttattaatatatttgacaacacattgcatgatgactgtagtctattactgtaacattaattcagaagataagcaaatataaaattgtatatctaacagagccataatctaactataaaataattgtgaatagtaagtgtagcttgacacatttattctactatttttatttaacgtgctacttgaagccagtcatttgagacaatattcaagaggtaatatgttgtataaatcacgtataaatggtaaatttgcttaaacttacaagaatattaaactgtaattaacatcttattttatacatagtgatggctttggactagagatattcggaaaacacaaaatcctatgttcatatagtttcttactacccttgatgaattcaattaatgttcttaaacctcagttttctatttggattatttgctttaacttaatagcttgtctttatttttccctctactattcaaaaattgtatacttctatcgatttaatgattagtataaaattcttaacacgcacaagaaattttgcaagttttcattctaagcactaagagaatcttaaaattgctttattcattattgattaattacttattttatgaattaaacaaatatatactgtgtacctagtcactgttttgggtgttgaggacacagcagtgggaaaaaaagacaatttttttttgcattgttgggttggagctctacttctaggtagggaaataaatactcaagaagataaagaaggaaaatattgagaactttcctggtcatgcactttattgagaaaaataaatgaggaaagcatggataaaaagtgtgtgtgtgtgtgtgtgtgtgtgtgtgtggtgtatgtgcacacatgagaaagattcattgaaaaaaacacttttgagtaaagaagttaaggcagaaacgaaaagagccacatggagaaacgggggaggattattttaggcagaggtagcacacaatgcaatgggtgcatgtcagatctgtgaaagcagcagcaaaggggtcaacataggtggagcagaggaaagtattaagagataaggcctgagttaagaagtgggccagccaggtcagatatcccttgaaattcatgaagagttttggatttcacttaaaaatagatgggaattcattgaaggattatgatcagatttaaatatggtttatatttttcaaatgttgtccctgtgtattgtgtagagataggctaaagaaagcatgcgtagatttttttttttctctgaaaatttgaaagaacggtgcttccactgcatttgaggggaaaagaataattttgttttaatcaagtcacgaggctggatgaaaacagcaagacatatatagaataaataaaaatggcaagtgcccaaggactgagcactgaggcatttcagcattagagaagtaggtactacctatggaaactgagaaacaatacatagaaaggtagcaggtaaactggatgaaaaacttaaccaccttctcatgtttcattgatgtccagcatttttctgttttttaatagacactttcatacacggtaaatgtttatttaagacttttccatttttttaccattttctttgcacatcattttcttttgcagcttaaatcttccatcttgtatctttctcctgcttaaagaccaatcttgacgtcctctaaagggaattttatgctagtaaacggtttctgtgtgtctgaaaagatctttatttcaatgttattcctgaaagagagtttctatcagtacacaattctaggttcctacgtggatgttctttcattgtttttgaaaatattattctaccgtcttctggcttctatcattgctctaaaaccaggtaccattttaagtgtcactactttctaaggaaatacagcagtatttaaaattatttctttgctttttttggattcatcagattcatcgtctcatagtgatgatctatacttatatttcttttttttaataatcttttctgcttcagatttgctcagtttcccaatcggagtattggaatttctattaagttttgaaaatcctaagctattatcactacagataatgcctcttctccattgtgggtaggatttatttattcccctttacagctgagggaagcccttgaaaattcagactttaaggaggggttttattttcacctctatattatgtgttgttgaaggtcacatattttgtcctaaaaggtcttgaaaacttcttcctagccattaggctctcaatccaggttcagtttcacgtaagatgatttgatcattcatggcacacagagggaagagaggttccaccatagcccagctgtgtatttaaaacttttaaaaattatattttattcagaatttccacgcatttgaagtgagggggtgaggaattaagtcagtctgtcatctttctggaagctgatactcgctgaacatgcctctacttaaccattaaactgattatgctacacaactagacactagaacaaaaaaactccgtacaaatatttataaccactatgatcatcaacaatctagaaaaacataaaatgttagctaatttcttttttaatccttgtaatatgttaattacaaaattgagctgagaggagaaaaattctacaaacagctacatcctggtgcaacatttcccttaacaaccattattagtcttttgtatttacaattccatttgctaaagaacattctgtctctaaataagaaaatcatttatcttcccaaattctccaaggatgttgcactggcagctgacaatctttgttgttatttcaaggcaaagaagaaaatctatgtggcaattatgcaaagacaatatatttcccctaattttattctcaaaatgagttgcttttattacaagataggagacaatataaaaaatgtgtagcagaccattaaatctaggctcagacattattttacataaggtggtggcaaacagttctgttattacttttcttgtacatctctgcttaaatttaaggaaatcccaaacaacagaagaataatgatacggtgatgttcttcccatttttttctaaagaatattcttatttcaccatcactcaaataagaaacctttcatcaatctgaaatcaaatttcccttttctactgcaactgtctagatgtgaaagtctatagaatctaaccccttcatagaaagtcataatcccattagcatatcaaacgcactagaaagttatagagtaaggaaagtttgcttaatctactgtttaccaaaattgtttaaacactgaaacttttttccttttttattaataactcccaccatgttttggaaagcagtgagttcaagtttggcgtcttccatttctcagatgtatccttggacaaatctcttaacctcatttatgctaatttttcttacagtaaaatgacaaagaaaatgatacttgagagggtcattactgtgatcaaactagatgcatgtgaaaactctttgtgaatgtataatactattcagattcaaacaacttaaaaaagttagtggaaaaatattcacaatatataggtgtttattttacaaatttattcaattaaggactacttttttttcttgaggcggggtctcaatctgttgcccaggctgtagtgcagtggtgtgatccctgctgactgtaacctctgtctcccagtttcaagcaattctcatgcctcagcctctgagaagcttggattacaagcaactgccagcaagcctggctaattttatatataaaacatatataatacatatatataacatatatatataacttgtatatatatgttatatatggatgtatatatgtatatacatgtatatataacatgtatttataacatttatatatacatgttatatatataacatgtgtatgttatatataaaacatgttatatataacgtgtatatgttatataacatgttatatacataacatgtgtatgttatatataaaacattataaaacaaacatgttatatacataacatatacataacatgttatatacataacatatacataatatgtatatataacatataacatgttatatacataacatgtatatataacatgtatatacgtagaacatgtgtatataggcataacatgtatatataaaacgttatatatgtataacatgttatatataacacgtgtatatatgtataacatgttatatataacgtgcatatataacatgttatattcaacgttatatgtgtataacatgttatatataacatgttatacatataacgtgtatatatgtatgttatatataacgtgtatacgtgtatgttatatataacgtgtatatgtgtataacatgttatatataacgtgtatatataacgttatatataacgtgtatatataacgttatatataacgtgtatatataacgttatatataacgtgtgtataacatgttatatataacgtgtgtatacgtacatgttatatatgttatatgtaacatgtgcatacgtgtataacatgttatctgtgtgtgtataacatgtgtatatatgtatagcatgtcatatatatacatgacatgttatatatgttagccaggctgatctggaactcctcctcaagtgatccgcccacctcggcctcacaaagagctgggattacagttgtgagccaccacgcccagccaaggactattttaaataacacatttattgcagcatttaatctacaaacaaggttaattttctatcagccttccaagagcatgtatattttggaaatgtgtactttaattttgtcaaaatatcccattacaattactctgctgtaggacaagctatccattgcaatacaatattgtaaccctcttcatattcatcttttaccacctcacttttatgttccagaagctgtgtctttccttagtatgcctacttctagaagtaaccgtaagagaaactgatgttctgaacgagcagtcttaaactccgaatttgcatacataagtatagggaatataaaacatttataacagaaactactacattacataaccagattatacatcaaagttctactaaatattcattgttcctaaatgaaaggatatctaaataagttatagcacctatgcaaaattctaggtgaaaaatattccattagaaaaatatgttcaaagatactgatatggaaatgaaattggttgtgtttaagtatagaaaagaaacctttaggcctctatgttagcagaagagcaaaaagggagacaaagtgtgagtaacagaagtgataggaaggggctacatcatatagcggatcacaggatttcatttaaagagtaatgggcaggaggggcctgatatgatctcattaactccttagaaggagctctctgccttcaccaggagaaatatggtgtaagtggggaaagactggaagaagaggttagaggttgttgaagtaatccagatgagagataataatcttgtagattagcacttccataacagatacggaggagtgatttgatgcattttgcaggtatatccaacaagagtggaaataatttacatggtaatgtaagagaaaagaatcatgaaggatgtctaggtttctgacttaagtaaataatagtgcaatttaataacatctggagatgttggtagatgccaattaacgtagatggggggtggatcatttatttttcacttggctattgtatgtttgagatgctcattaggcatccaagataagagactgttggatataaaatgttaaacatcaagatcatatacttggtatttgatgtcataacatgctcagctcaagtggaaatgtatttagaaaatggacatttctttttcttcactgaagtgggcttttttttgtatttttttgctgctgttcttggaaaggtcatgtatgtatacatatttcagaggtttagcacttttttgctatctagaaacattataattggtaataatttacatagaacacattatgcacaagccttatatttgttgccattatctcgaataagtcttgtttttatctccctttacatagcatatgtaatatgcaggatatgaattaaggatatgtaattcataggatatgcaataagtcttctatttgatttctctctctttacacaggatcagtcaaacactgcattctcctagtattctgtgttttccttggtggcactgaccaaattttaggattataagcttttttaataaatgttcttatttacagagaaaacaattttatacagctttacatcgctgtctccttccttctagtttcattttattttacacaaatatattgcttagtaattattttagcaaaaatctatagacaagaaattcttagtttttgttcaggtgaaactagctgtatgtctgagaatattttgccttaattcttgaatcatgttttacctggtatttgaaaatgtgcctagcattttgaagatattattcaactgtcttctaatatctattgttgatgaaaagtcttcagtcaatattgtcatcctgtaaatgttcttttgtcttaagtaacccttaatgatacctttttgattactgatgctctgagtttcattcagagctagctggtagacttgtttttattttttccacgttggttgacctttattgaatttgaggattcattaaaatttacatttattccattttattaaatttcattaatatgaaatattgtctcttccccataatccctatttttttcaacttgaaacttatttcacgcagatgtttgagggattaattatattttcatttccagactttgttttttcaaatcttcgttttcactttatataatggcctattcttactggaaaaaaatccatttaatttttatttttgaacattaaaaattacttaatatcctttggtgattatcctcttatctctattttcttcaggtatacattctccttttaacgtttggcatctgataacattgcttataatttttttccacaataatcataattttagtttgtaagcttatgttccttagcagtttcacatgacccttgggggttgtagtggtatcttcattgtataattttgtgtttgcaaatgcctgggctctctgaggttattttccaaatgctacaatgatgtgaggggcagtttagggaaaatcatgccctttcttggcagtcatcagatttgtgtgatatttcctgtgtttattctgtgaatctagagaaaagtatctgcttatatattatagaattaaatttgaaattttcactgaacgagatatctgttgttaacattttaaacaaatgctgcgtacttaattctcttaatgacttatgaaaatattttaaaaattaaagattatgtctattttccaatgttaatatatatacagaaaggagacgaagaaaactttcatgcattgagcctgcataacgcagcaggtgtttgacaaatattaccttatttaatcctcagaaacatccttatctctattgtacagatgaagtaaatgagactcagtttatccctgatcatacagcactcaaagtcactgggattcatattcaaggctgtttatccaagagttaattttactagaccacactgctgtgatagtacatcctatagaactatcccttttcctcagtttacagtccgtgcttggtcttaactgaggaacctagtttctaaaccaacaggaaatatattagaaatgattggaattcctaattaaggcaggagttctctcattttgaatatctggtaaaatttttacctgcgtcctcccagtctcatgcctctttctttatcatctccaggtttgccctgaggaccacaatttgcagataccctctactatgctttggtctgcattcctgtgtggctgggcgctgcctcatgattgttccctcaaagtctcagtccttttctgagctttattactaccatatatagctctgacatggacagagtcccctaaatgccttaattttacagtggttagcacttctctgagtctttatctgtgagataaggaaaattaatttttcattttaaactcactcagctctcacatactaagcattttaagagtaccgcttactatttcaacatgttgctgtaaagacatgaaagatgaactttaagcctacagtttatatctagaaaaacaaaaagggacagttaggaaaagtaaaaatcaaacaattagagaaggagaatatagggggaggtaagaaattctgaagctatggcatatgctgcatcagagccattgtaaggttatatcaaatactacttttcattaagctgttactgtgactatcacaaatgactctagggcgtaagaattgggaaagataactctaatcagtggccacagtgaaattagttttaaaatgcattgacaattggtcaagtataaagatgtatcttgaatatttctacacccacctgtctatctatctacctaccaacctatatacctacttatcatctatcaattatccctcagttctaattaaaatacgatgccaaatataactgcaatattaaattgattattcttcatacagattgtgattactttattatcatggataattaagagttaacacaaaaatagcccccttcacattctgaattttggatctttaatatataaaacttaagaataaatcgtttatgaggaaaatatatcccagaattttactacaattttttaaaaatatatactggttcacacatgcttcctttatttcaccagtcattattacgttgtacaaatatttgttgagagcctactatgaatagggacataatggcattttaagtaagtggtttatggagatttttgatcctgtgcctatttagccataaagcattagcaacttgattagtttgtaacgaattttaaacctgcatattgggtgtgtcaagacctggggaaaattggaatggagaaatgagttagtagtcagataattcaaagcaaaggactcccccttgaatgatctattaaattgaggtgaaactattttattagaattttctttttgattgccttaatctttcgcttcattttgcatctgcagacacaggcttgctggttagtgtaaggttatttatgacacattacattcataacatctaatatgaaggataataggctgaaacattcagccaggtggaattagacttcacatgcaatacagtttcgctatttctcgtattcttccaattgctcagaataattcacctgctattaaactttagggtattagatttaacagaaaacagtgtatttattaattttcttgaagtattaaaagaagtcacaataatatgcaacatacttcccttatatgcttataaaattaagttatggtaactgcttttgacattttaaaaatatacaccaaattaaatggaactgacactatcacagaagaagttcccaagaagtctcatacatgggctgaaccctatgcagttattatttacatagggcaaaatggttgagtatctgtttgattcatataattcaacctaacttaactataaagacttagtttccagattttgacatcctggttttgtgaggagtactttcttctataattacagatgatgatcattcctcttcatcttacaagtgttaataataggaacaaaaatgtacctgtcagaaaacctctatggtttatacctactacaaataaagaagtgagaccaagctaacaattctgaatcgcctttttaaagagagaaccatacactttccattcagttgtttgaaagaagagcagtcactcctttttgttttggctggtaacatttcagtaataacattatctgatattgttcaatctgcaatcaattagcaaccatcttactaggcatccagttcttttatgggcactgtaacccattaagtagttaaaccaggtgtgaggattaagctattattcttcaagtcaatgagataatggcttatgcaggttgacataagatgtaccatgaaatatttattatttatcatgtatacattaagaaagtaaaatcagcatgggatgatctcaggaaagcaatacatattttttggattagacattgaagtaaagtgaatgtatgataaattgacaaattaacattgccaatgttatgaaaaatgatgtagcaaaaaaaattaagatgtattttcatttttgataaggggttttccctgttatctgttaatttcttgtgtctttaattggcaaaattaagcactagtgttacagaagcccaaagtgagggaaaccactcactttcagaatgtacattagaagtttaaaactgtacccagattttttgtctcttttttttttattagtaggcctctgttaatagagtagtagttgcaaacacatacgtgggtttgccagtaacaactcacaatttgtgcaaagttgagtcttcgaaactgagcaaatttgctctcaatttcccgccagcgcttgctgagctggatctgagttggctccactgccattgcggccccatcctcagacaagccctcagcttgcctacgcactgcattcagctcctctttcttcttctgcaattcccgatcaatttcctattgagcaaaaccaatacagggcccagggcagttagctaaccacatcaaccgacttgcaagcagcaaatacttctctcaaaatttcaaaggctgttgtccctttattgtcatcctttgaagtttacaaatatgaaaggcatgactgtcatcctcgctcaataacccaaatattatttcagttatcctttgaatgcttggttttagatattctaattaagtaaatattgaaattggtctaacattttctttcttctaaattcctctggtgtcttgggatttgaaacaatttggagtgataactcattatttattagggaccgtccacatagaatataatttagagggtaagtgaataagttatttatttcctttttaaaggtttgaggaactcaacagagaatgaagcaaaataaaaagtgtaaaataataacagaaaaaaacatatttagacaatatgcaaataaatctatagagagtgaacactgatgtgtgaagatgctctgatgaaatgaatgggctaacatgagtaagaagtcgtccatataccgataagtcattagttcatctggaacaaagatacacaaagtcaattacaattttaccagaaaacacatcacatttcttaaatcactttacatagtctaaaacattttattcattcaacattacgtcaattgaataacacttaatacaatacatttactgaaaacaacacacaatacaaggaaatgcatcaaatcaaagagaacgttaatagaaacaagaacatcaacattttaaatatgatcttcacaggttaattaaactgtataataaaatctggtattgacattctaaaacaacattacctttattttcctttcatctctgggctcaggtaggctggctaattttttttcaatgtcatccaagcatttcaggagatcatcagcctgcctcttgtactgataccactgatgagaaatttctagagccttttttcttctttgagacctcaaatcctgttcatggtgcagacattattaaaatatcaatatatatgtatagtgcacttctggctgcagttatttatcaaaataatttgcgtccctcatctttttgtacaacttaggttaaaatcatatttaaatgcaaaatatacaaagacataattaaattgcctatgcatgaggcgggacccatgtataggaagctaagaaacctgaataacacacttaaagtattttctcttagcatgttcaaacttgcttaaaaattttgtcacattcaattgactcttaatgagctaactgttgtgtagtttatgtgcaagagtttaatatacgaatacaattgacttaactagatacaaactcacaaacctagtgagtttgtatctgacttaaaataggtaaaattctaaaatgtatatctttagccttggggctcatcaacaaaactttatgtactcaaccaatatacattcatgtttttagaaatgcctacataagagtttcataggccattaatattttatgattagaaatataaagccattttagttgtcttataaactgttccaagctgtatgtgtagaagtgtcaccactgttcgtatattggtgaacataactaataaaaaattatgtgagataaatgcttctccttccaaggcttgcatagccacatttatcttactataccaaatcatgctctaaatgcaaaacaattaactatttgaaaaaagaaaacagcaagtgcatgctttcaaatcaatgtgataagactaatttaataaatcaacaatgggaggaaatcagtcatcatgctctttacaagcacactcaatatcttctgtgattaatagaattactcaaaatgccattttataattcatgggaacataagctctgcatgcagctttcatttctacagaaagtagcaattagggttttattcacaggtttaattcgagcgaaaaaataataaatatcagggaatttctaaaaatttcattccattggaaaattttgaccttctctaaaatatttcataaggaccagaattggaactatttgacaggtttaaaaagttattgaatatgttggtatagattggtttggcgagtagtgttgacgattttgattaatcacttatagcctgtatttgcaagaatgaactacatttcattatctagtttgtttaaaattgggaatttaaaccttgctgtactttatgttttatgttgaattttcaaaccttctgaggagtcagatcgaacgctgcttttttcaaaggtagcaagatacagccacgtgaattagagttgagccatgccttatttgtgacataactcacatctttgccaggagaaagggcttggtggtcatcaatctgaaacatctttcatttcctaagcacaaagtgatgtataatatgtaaaatatttagagatgtcatgtagatttctttagaggaatgccagatgaccattaaacactgctattcagtaggacacacaccatcatacgaccagtgtagatacttctgaaagcttgctcacagttggaagggtgtgagttacatagcgttccgattttctagacacattatggtgtgcttttgcactccctcgaggaagaggccttttctgtttactatatttatcagcagttaccttcagaacacctgctggccaattagactttccttgtggattccttgcaggcacaatattgtgtaattacattctcagcagtgtttatttggttgactatagggggaaaggttttattctcttatttgcatgtagaaagcagactccatctacctgctaggtggatccaccttcataactacatagctcaaaagagtgatttacaaggaaaagctcagcaattaaaagtattagaaaatcagccatgcatgcaaatagtgattattgcaaagcatatacaaaaaaaaagtttcacaaaactttccacatgtctagtctcaagaacttcctagatattattatagaaaaattaagtttatcctgctcttcctgcacaaaccagatgagtcacctggggacttgaagccatacactacactgcttaatatgaaagtagcagttcttattcaagggcactaagattattttttaggattcctacataaatgaaatttgactttgtagatagttgcaaagagtgactttcttaaaggcataataaagttttaaaaataaataaaagaatctagggcttattaaacaagtatcaggttaccaaaaaattggacctaatgcaagcaaaatcaattaagtaaagaaagcaggaataatggatacatgtagatcggttattctggcagttaggcaggtttttttcaatataaagtagctgataaaaataaagcacattagaaaattaaatgtataagtactatgaatgcattcccatctttcaattactacttagaaaaatatgtctttaaaaagccataacttttaagcaacacatcgttcaaaatcaaataccactcaaaaatgttaaataaagcatacacattgaacagaaaaagtgagtttctgatgactaagtctgaagcagattttattaatgcacattatattttaccctatatattaaaaaaaaaccacaggcaaggtatattataattttagctctaataccttgagagcattatgttttgtctgtaacagctgctgttttatctttatttcctctcgctttctctcatctgtgattctttgttgtaagttgtctcctctttgcaacaattcttttacagtaccctcattgtcttcattctgatcaaaaacaacaagtacagtcttcattttggtttttaaaaagctgtacattgttaacagagataataagacatgttatttaaacacacacaaaaatccaatttaaaactttcatggaatgctattataagatactgtgctcatagcctttcttttacatttggtacttgaggtttcaaaataagtttcctcccatctagttgtaaagaacacatttttaggggcacctgtagaaagatgggggagtgtggtacttcatcatgtcagacaagtcatgaattactgtgaaagtattcttttggcttttttagtgtagttctagaaattaaaacattagagaaatgagctaaagttatcatttataatgttaactgatccataaaggaatacagatgtgtatttgtgactgagataacagcaaatctgaaaatattaacacacaactacatgaaaatattttgatttaaatgtacactaattcctatctaataactcctgcttcatttctgaaacctaaatgctcaatattaataggagaaatatcaggatattaataaaaatcatgtgctaagttaccatcaaataatttctaaaatatgtcatatatgcatgttaatttaaatacgatcaaataatactaaaatatggactggaaaatggctttaaacattttcaatgggtattttgttcctttaggctgcaagaacaatatcttaattttctttacttagaaataaaatgttttgaataaatgctggtctaatatagtcgcatatatgaccatgtgatttttcacctttagttttctttctttcaactcagaatgtgaaaactttgtatcaagtagtctcacattgtaatggtactcaaggtacactgatgacataaggaaaacaaataataaatttcaaaagtcacaagtatttgtatgtgtgtattacaattcaaggaattagatgttatatatttaaatctataatgcataaacttcaacacgcaactgaggactgattcattttgtatgggggaaagggattatttttgtcagagactggtcaataatctaaagaaacatacggcataatatagacacattatatacttatcataatatagacacatcatatacttatagtctgtaaaagactttacttattttaaaaggtgttgtaaaagtctgtagcattttctagggctgaggacaaaaacaacaaaaaattaaaaaacccacttcacttctttccctataccagttgagggctctagggcagagttggggtcagcccaagaggtaatcagtactttttttcatcttggtgccctctagtttcttctttgacctgaagtagagattgctgtaactcagcaacttggaaagcctcttccgtctttccacaagctgagttggcaaggccaccaaaccccatacatggggagtattgattgaggcagctccaggaagtgggaactaagattggtgggaatagttctcctattgcttcacacacttattacctaaaatttatatattgtcttctgatgtcactttcaagcattgtctgagaaggctctagcactggtaattgtaaaggttaagaatgccacagaggtgatggcagtgaaagaggggaaaaaattgtgaaaaggaggatgaagagagaaaaaaaaagtcagttaataaggatgtgatgtacaaatattcaagccagagagaaatgtagtagatactttgaaattagttgggattgaaggagaatattctgaggttgggaagagcacacatggtcatatttctttactcccatgaaataagcagcatgaatttatacacattttagacatataatgtactaactaaacaactatttggtaaaacaactttgtgggaaattgtaataaataatgttcatattatgcattattctctcttcattgaaataaatgttatactaccaaaaacattgctgatacaaaatgtcagtcatctatgatagttgagtattttattaaatttttagtttattttatgattcgactcttttttccaattacattttgcccttgataagttcaaaagtaggtcaggtcaaaagaaaattgctgggctatttattagaaaccgtaagtgctcctatattaccataccatagtaattcagcatttgtaataaaaggccaagaatattctgcatttataaaattcattagaatcataaaatgtgtaatatgtgctctgaaaattcagttggagacttatctaagttctttccaaatatttatttccactcctagttcattcacacttttatcacaaccaatttaccatatctttattgaagtcttcctctttcagattcaccccctgctgaatttcagcctccagtggttcaagcaatttttgtatatctgagttaaactgctccaattccttcaaaggaatggaggcctaaaaaaaaagatagtgctactttaaatcaaaattactttttattagaaacataaaccaaaagaaatacatttattcaacctcctgttgctaaactaatcacatgcattatgtttccatattatgttttatgaagggttttgaaatacaactggaaaagtacctgaggatgcaaataaggagaaacatttcacatcaccagagctgaacatacatgcaagatagtacaattcatcatttggtgatatcaacaacagtcaatttacagatacatttgaatgggctaatttttaatattctaaagtcaaatttgaccttattttaaatattctgatataaatacatttgggtaaatatgtctcatcagaaattgcctcatttatcaagtaacagtaacctcaggtagaaatgcagaattgtcatcttatccttagaaaaactacatggcaatctgctcagatgttttaaatgacatttttagcacagcacaattgacaggcatgctcttctaagacaatgccattagcttgccttaggaacagtttggttggtgatgcaaataaattcaaacgaatgaacctaatatatttcacataaagaatctatgcttttcaaccttgtaaacatcagtttctttacttttgaactgataatgaccagtctaagaaaactttaaaatctcttgactttctaaacaaaacccttgaaaaggagtgataagtgaaaagacatggaaaatcaaatatatattcaaaaaagtgggcaaggtttagttattagattaaaattctgttaataaaatacattgatactctctcaatctttatgctgtatttctttccattaaaacactagaacatattttatatgggatagctcttgaaaacccatagatgacatacagaaatctgattttctttcagagctaaaacattttacttttgtaaaaccaattcaggaatgacccccgtgtcttttgccaagacgattacattcatcaagtttggtccccacctacccttctccagtcacattcccaggaagaggttgaatttttattagatggcaacttctggtgaacaatacggataagtgtagaagaaaaactaaatatctaaaggtaataatctgtcactattgaagaagtgaataatcaaattctattcatgatgacatgattctcatatgcaacatgaataaccacatatcttctaggtacttctacacacccctgaaagatttatgagataattttaagtgacctattacagtaccagtttttaaatcctaatgatcatttgccatttgaaatatcataagttatttgaaccagtatagattggtagtggtacaaacatgcttaaagtttcaatgtctgtattattagcaattacggtacaataaaatcatacactgtttagatgacggtaaaagtaaaaagattaacaacccttagaatcataactatacaattatcaatttggtgatattttatgttattaaatggttgttcacatttgctaatatttaatgaaagcaactatgttctatgtgattttgtgaatacataatgataatgttgaaaataacttttattgtgtacttggatgtcagaagaacataggtctatttacagtcagatttacctgttttattccaactgcttcttctctagctcatctctccatgaatttaacttctattaatttaagatacaattttctacgaatttaacaattttttatgccttccaagtcttcaccctaagctgttatctgacttttgaattcccatctagactctccaatagccagctgaattttcacctgaagtttcacattcctagtatggagcacattatctttcccgcaaactgcttacaatactaacttccctagttctcttaatggaagaccatttctctcagtcattcaggcgtaaaacgtaagtcatgctatttttgaacatctcactctaatgtctaataaatatcaagtaagtgtcaattgacttgctatgatccacttgctttgtattcccagagactccatcgttcctggtccttacacaaaactaaggcaataagctttgaaaagatgtaaaatctcctttcagtcaaaccagttccagcctgtgcccaatgatcagcttactatgtttcaaaaacctttctttcattatgctatttatttgctgaagaacctcctgcatctattgagtataaatagaataaagtccaacctccagcacagtagtcaaggcttctcctaatcttgccccaaagacttgccagccttatgtaagtgttcctaatatagacctttttttgcaggccatttggtgatcttctgttatgcctccttcaatgaccttagaatacttttcatcttctagtgaagaacataaacttctgtatgaaaatgcatagattgaatctgggctctaccatttactagctgagggaacttagacaagttatttatcctcattgaacctcagtttctttataacatggagataagatgaatatctacctcacagggctattactaagatcaaatatgttagaatggtgtctggtatataataaaagcttaataaatgttgactattattttctctcaaacttctatgtgtccatccaatataaatacatgctctataaatcttgggtcttattttgatcctctcaaaatcctaatcatccattggctcaggtcaagcccttcctcctttgaaatctatggttttaaaggataaaatacatgcttattgatataatgagtctttattttaccaagggatttgatgaaatcataacattgtaatggtgaacatggaggattttagattccagtttggtagagttacataatcctgaagaacaaaactacagattaatttatctgcggcaatataaaaagtgatatcacagccttgcatttagtttacagggtgcagttttttttttttaatcaggaattatttggagacagaaaaggcataccacagatacagtcagtggggtgtgttccctagacatcctatggagctgagtttctcatgttcaacctacagtcatttctggtacatagtaaatattcataagtaaatatttcctgaaaaaataaatgaacaaaagactaaaaattgagggccaaaatagacatttcaaggagcttttttagtgacatggaattttaaataacacaatttctatgtagaaatgtcaaaagacctgactggttagcattatatgagtatgtatattaactgctgcccaaatgctaagcaacatgataccaccaggtaaacacaaaaaagggggaagatgtaaaaagagctttgggagagactaccaaaaactgaagtgctaattattcaggcaagataatggaaacttagacttctttagttcaatgtgtagggtctaaattttccaatgaaagactaccgtgcattttgtttaaaaaaattaggaagattaagaatttgagtagttttattttgtgtagtttcaaagtgattaactaaaatcagtgggcaaaaattatttggagcctaaattttaggtttatataagaacaactgatgaggactgcaatttttttaaaaacactgattttcaagtaatgctaaatgtttataagcagagactagatgaggatgtattcagtcacattttaggaacaaaatccttttcacacagacattttcttaaaattttataaccttacagtaagttcttgtctctaaattcaagtagaacttttatagtagtgcagctcaatagaaatataatacatgccatatatgtaattttaaatattctagttgccatagtaaaaaacaaaaaacagataaaattaattttactgatttcactgagatgtccaaattattgtataaactcataatcaatacaaaaatatgaatattttacattttatattctcttcaaaacccacacatattttacacttatttataaatcttaacatggagtagccaaatttctaaagctcagtggccacatgtggttcatgaccaccttattaggcagtatagagctctattaaccattatactcataacattgtaaagaactaatatctcataattactttgaataaaatagtaatgttttgtttataacttgtggtgaatttagattattcttacgtcggtcttattatcttgcattatgtgttctgagtgaaattttcaggcagtcctcggggtataggaaaaattacgggagtgggattgacctgttatttcaggagtttctattctcatttatgtgtatctcagcttgtgttgcactgctttcttatagacaggaatataatattatttggctttcaaagatatatgcttgtctctctaaataaattttccatccttaaagttggcaatatgtcttatactactctattttccagtgaaaacactgccttttattttatacaggaaaaggtgcttattatatcaatcggtagttttagaactacctatatattaatttaatcaaccagtgaccaattttataaccaaaataagtttatcaaaccaattgttttagctatgttattggcaagatagcaccagccatttgacagccatatgattaatagtctttggacacaaagagatgaaaaaaattcattgcttttcttaagagttcactagttcagcattaggctatgcccattctaaaacagaaaacactttcccacccaattaaaattctacatgtcattccttggtcttccctgtctttgtaacttggaattcttatgcaactttataaaggaaacatgtaataagaaagcgtttataatttaacagctcattcttgagtcaccaaattttaaaacacaaagtatatcatgcctgcttttcaattcagaattatgataaattgtctaaaacagttgaaagcaatggctgataaatcatcttaattattgggtaagttacttctattgactttaaaggaaatagatgaccacaaaagaactggaatcacaattaaatcacacaatgttagacagtgcacacaaaataggttttagttatatagaaaataatcaaacaaaagttataatattgcatgagaaagtgtataccaagcataggttttggacacttttaattttttacttaccttttcattttaagagctttagcatgactgtgcagtcatacaaaatacatataaattagaagacagggaagtataataaatggataaatggacacataaagaagagacagagaaaccgagaaagacaacactttgttttccttgattttttaatgtttcaaattgcttaacaactattaattgtgctttgttggattatttaaggattaatgaaatttaaggctttgttgaagttttggcattaaagctgaattttataacaagttaacaaaggataacagactgaagaaaagcaagatcaattacaaactgattcattgtaaattgaaagcattcaaaattactcagatacactttattagttttaaaatgtaagctttccttggttaaatattactttggcatgcacagatacactagcataataacgactgtgtttacacagacagcaagtaaacatttgttaatctggactatggaatcttaataatcatgataaattaccactatattcaaatcacactaaaacctaaattgaaaataaataatccaagtgctacagattggtttaaaattgcttcaaatccatcagtctcctttttccattctgcagctttgaaaatttatttatcattacaatattgatatagaaaaataaagaattcatggaaaccaagatgaaaaatttcaaggacaagtaacacactatagtacagaaaagacagactactgatatgatatgaagagttatttcacatcattctatctgtagaggaaaagaacttacaaaaacaaataagtgtattggaaagatactacatctatgctagaagaaagattatttaaaatatggtttataaacttatttattctattattttaaaattattagagcaaacaagaaaatgtaagaaatattatttttaaattaaataaattgactccaaatagtgacatttcattggttgcattcttttgagaatagataaagtactggtttacctttaatgctttgataataaaaatgtgaaaatgtgactaatttgtgaggctaattagaggatattacccagtagatttcaattgattttgtatggatgaggttaatttcatgcttacacattttaaaactggatgcaaaatatattcgtgggtcaagaatctgcttcctactgtcgaccttttataaagtttaacttagaatattgccctatttcatgattacatgactttttggagtaggaaatgaattaaaagaggaaaacatttaactctaaaatgtatgggggagacagacaaaagtaaaaacataacactttaagcaattttgtattttaaactttcttttcatttacttaggttgttttccagttttatttcttccattcccccttccttcttccatttcttcctccctaccaccttttgttcttgtcatttttaatacaaaaagtataacgaaatcactgtatttgaagtgaaattgggtatgtttatactaacacatagtagaccaacaaaaactactttatgacataaatagaggcagtaaactatgctgagtcagtgtattgaagtggacaaagcaatggactgagatctagtatttgctaaccacactgtctaactgtgagaacttggtcaactcactgacactctcacaacctcctataaatatctgaaagtctctggtccaaagcaaaattgctttacatctactgacactgatcaggggactaattttcctttatcaaaggagaacaatcaagattcaccaaatagctttaattatttcaaatgttatgctaacaagacccagatagttttatcaaatgacactgctcaccaaactcaattacacatctactttaaaaatattttacatggttaccaaagggatttattagcgaagtttcaatggacttaaccttgttatagggataaccaattacacatgtggaaaaaataagctaacataagaattatgttgttaggttcatatttttctgattcattttagtaaaataaaatttgcagatattatacagtttgactagtgatctgttactattacctgaagatattagttgtaaatattacatatttaatgctctacaaattatgcaatatttacaagtcttcatctcagttttcatgtttttatagaaaattttactaaaaatgaatatctatatacctacaatgtacctacaaaaattaaaaaaattaaaatttaaagaatatatatagcaagaatactgttccaattaagatacaatattattttccatcataggtgttaagttataatacgatcagaaagagactgcaaaatatcaatgtatttgcattgataaatctgactacagaaaattaagctttaattaaaaattttcaatccaatacatcttcattggaccttctagatcacatttataaaatgcatcatttatttcccaccgaagtttaggagagccaaaataattaaatcactgcttaattattttccacacatagaaccatattttaagatagattaggcccaatcatgtgtttctttttcttatatattctacattacatgggaaggtcactgactctctcacagcctcctataaacttgtgaaagtctcttatccaaagaatgattacttttatatcttctgacactgaatggaagtaaaaaaaaaaaaaaaaaaaaaaaaaaacttggtaatttacaattattgcagcaatcaaacaatgaatatttaagtatttgatgcccgattgtccaaatctcatattacagttgtaatacatatatatagaaactgctacatgaattttagcagcaattttcaaggcctatatggaaattaaagaacatatgccagatatatcctatagcaaataagtcttagtaaaggatcaaagtcagagaaaataatttcacttttttctggttagtatcaatttcagaataaataatttaacatttcagctccttagaacagtgaagtatatctaaatctctagaaaaatacaatctaagcaaattttatgtagaaattacataatattttgtaaaaagtaaaataattgcctttattaatatgacacacctaaagtttgtttagtcaaaattattttgcagctaagtattacaacaataaaaatataacttgatgcatattttattattgaaattttttttaatttttatttttgagatggaatctcactctgtcgcccaggctggggtgcagtggtgcgatctcggctcactgcaacctccgcctcccgggttcaaacaatttccctcctcagcctcccaagtagctgggattacaggcgcccaccaccatgcccagctaatttttgtatttttagtagagaaggggatttgccatgttggccaggttgatcttcaactcctgacgtcaggtgatctgcctgcagcggcctcccaaagtgttgggattacaggcgtgagccaccgcaccaggcctattattggaatttatatgcagactttcctagtcaatcagagttaaatttggagtcatttttgaattcatcatcttcttgggtccttgtatgtaatgacttaactctaggctacctctaaatatctccgcagcagcagttctctaagcgtggtccctagaccttcagcatcaatctgacctagaaaaatgttagaaatgcaaactcttgtgctccactccagacctagtgagtcagaagctctgagtgtggggcccagcacactggttttaacaattcacccaagtgcatacaaaagatttactgatctagactgaaatttcctttccactcccatagctatccctttttttgaggtcatcagtgtatctcatctagactactgcaatagctcccgaacttcatgtcattattcagtggaattctcctcacaactatcactggactaatttctcaacagtgcatacacagatacacacacacacacacacacacacacacacacacacacagagcacatcaagaactcttcattgcatactgaattaagcatgaatgattagtctggctgtccatgacctcttcacactgtgtctagccataatcttcagccttatcatccacaactaagttttatcttccatgccctctactctgaaaactaaaggaactcactcttcattgaacacactgtatgctcctaagctttctcatatgtttatgccgaattgttacctcctctgtgttgctggagtgactgctaaactcacttaccatgcactcactctcaatctagtatccatgaacacatcttgccctatcatcaaacagtaagctccttgaatccatcgtattttacctagcaatagatccccctcactaccaaacactgttatcggaaaataatatatggttggtgagaattcatcctgattaatcccttttctcaagtcttcactcattagtgcttttagatatacctcaactagcatctctcccaaattgctgactccccttctccaacttggcttctagagggatggagaggggtagaactgtcataattaatatgaataaataatcagtttatttttgtcttcccatgccccttcctatacttttgtctcctatcaccttattttcccgatggtatccacttgccctcagccatgccactatactccgatgccctaaaacagagacagttgagacaaggagtctctcctcattgattctgtcaatttactcagggttctaatattatctctgattgactgttgcaattctgatcctctccattaaaactgccatttcctcacattgatttcacatagattacgaaaaaacacgcttttttcaaagtcattggatactcttaggtaaccttaataaaatgggaaaaggcagcatttttatgtattttaaggggcgtatgtgggacaaacataactccttagtagttcttaaattcatccacttcattatctttaaggctggtctttgtcatgaaaatagcaaagacacgattttctgactccagtcgattacagcagagaccacagaaaatcagcaattctttcatttttttccatcagtttttgtctcaaccccccagattcggccattcaagtgtaatatacgtaacgatggaaatacccattgatattaattatttttaaccatttcatatctatacactgattaatacattttaaatgcatgtttttacatatattacataatttgatcctcattacaatctttagattaaaataaaacaggcatcatctcccttattttgtagctagaaatgaggctctgagaggtaaagaggcatatccaaaatcactaagtagtaatgtgctcagctagtgctcaaagcaggtcttgtgtcttgaagttaaggactttttgctctcaccatactgctccttgctgaggccaaaattaacattacagagagctgcacttggacagtcaagtcctcagccaatctgaactgaggatccctttactcactgctttctgggcttcggaatttcttgtcatgaacagtcctggcaggagacatgggagtaccccactttgtattcttcaccaaatagtaaatctagacaccagtgaattttcagcataagttatttctctattcaagggctctttagagttatgttctaaaggctatactgaaattactgattacaaagagtctatgacctacccgtgttcaatccaaatctactttttttatcaccatagtattttttttccccaggttactcttccatgaaacttagacatagactcaaccatagaaaagccatattctaacctaatattatcctgtataacccctactataaagaaacctgattttgagatcaaaggctaccccctaaaacctccagcacttcagcacttccctactccagagcaaacacacacaagacattaaatgttttcaatttcttattgtaatcaacaaaagattactgaatagccaaattttagaacgagcagggatttatgaactaatctaatttagaaatttcaaaccatgttctatgagcataatttatacttcctgaattcaatcataggaaggagaaagataaaatggcagatatttcccccatctagtaactctattattttccaatttattaatttaattttaaataatatgattttaatattaaatatttaaatttaatactttattttaaataataatattttgggcaggataggttttcttttaaaaattgttagtctattttaacttcctcatcttacaaacaatgaaatggatatgcagaaaaatcacatattctggctactactgaaaaagttaggcctaaatctcaatcttctaaatccactgttttctctggtgagattaccttctaaatctattgttctctctgccgagatcatctcaccattatttgaacatccccatgaagatgaattagtgttaaacatattttatgattatactaagtattcatttctgtttgaaaacatgtatttcttaagcaaggatctttatacccttgtatcttctcaccacaatctctaacacaatggaagctcaatcccattagctgatgcaatgaatatataagcaaagtgtcagatatgctttatttctgtgtttttcatttcatcgtgataatagagcataattatctcttcagagccctaaaatggggtcattgttacactcagttgcctttactaatttagagaaaaacaaatactttgaaaagcaaacatgtgattattttgttaattaacatataattgaaaatctggggccaggcacagtggttcacgcttgtaatcccagcactttgagaggcccaggcaggaggatcacttgaggtcaggagttccagaccagcctggccaacgtggtgaaaccccgtctctgccaaaatacaaaaattagccaggtgtcacggcgcccgcccgtaatcccagctacttgggaggctgaggcaggagaatcacttgattccaggaggcagaggttgcagtgagctgaggttatgccacagcactccagcctgggcaacagagagagtctccaccacacacacacacacaaaataataataataataataataataataaatgaatattcactggaaatttcttatgccttatgtttctagggaaaataaaagaagttcatagagtggatcactttatgcatgatttccagaagtatacttacaaattcatgcagaatgtgaaatgaaaactcacaaacttgtcttggtcacaaacttgtattggctgggtctgtcacatctgtggtggagagcaaattctacccattttttaatatctgtgaaccacaatcttgtaacacaatttatccaaagataataccttattttctcttaaatattctatagcttagtgatttattaaaatgtgcatgtgtgtgtgtctatatcttagtaatgaagtagtagcattttttaaggattgaaataaatctccattcattgtcttgttattacataagccattgatatctttagaagtaaaaacaattgtctttgtaagtaacaatacattctttcaaaactttaatcaattttaagagcctgtcacatttttttgcaggtaataatgactgactcaaatatatatatttgtgacagttaactactaagttctctcatgctgtctctctccatatgtagagaatatagccttttaaaagtcaactatataaggtctctatgtatggagagagagagtacaagagaactaagtagttaactattaaaaataacttgcaatgaattaaggtaaactaacaactttttaatttgggaaggtgaattttgaagggtaactgtgtctcatgcatacaagctaaactatttagaatttatcatgtcacatttcacttattttgaaaactactttaaatatgtactattatataacatgatgagacactgtaatgccttagaaagtgcagcaattgtgaaaccatgctattactggttgcttatatctatcaaaatattttttgaaaatgttctatttttccaggaatcaatacttacctgacatactgcatcatattttctcataaatactccaatgtttttttcatttcagattatttctaacaattatctatatacctaaatacatatattgattttatatacatttttatgtttgaaagcatatcatatatattgaaatttatcaaactacagtatataaatttctaggtaattacttgcatttcaaatcttcccaaagagctgaaattctataacactatatttatacatttttgcaaactacttattaaataagactttctcttcatcaaatcatacacaaatataaagtctatcacgcaaaagttccatattccctggttcttcttaaacagtaatataaataggcatataaaattacaaaaattaggatatgtaagctttgcaatgatttgttttcatggcgtgatcatttcattatagcctaatgaattttgtcacagtgtctacaactagcaaaagcaagttaaacaaacacacttgcacaaccagtaaagaggtaaaaaaacaccctagaccgtgcagaagatgtacaagacctcattttggatatttgatccacattacatacaagcaatattgtatcagtactgcttttggcaaaatttatcggtagtgctttatgttgatggatgacttgtgtgcttttggttttatttatttttttggccttcagcatgctatttgttatttttttctgtaggtgacccctgaaagtacgtatgtaaactgcagcatagaatgcagtcctagaatatctatggcagcaaaagatgagagagaaaaagagacagagagagacagagagagacagagacggggaggagtggcgtttatctcccattataatcagtggtaaaatttccttaaatacattttggcattcattttccttttgaaaaccttgctgtggggtctacttgcccctttcagagtactgcgcaaccttcgcaagagaccatttagcacaagtttccaccttggagtagatcttcctacctttccagtcttaattctgtgtgaaatggctgcaaatcgatggttgagctctgagatttggggctctactaatttcctgcagtggtcaccgcggtttgccatcaagtttgctgcttggtcacgtgtagagtccacctttgggcgtatgtcattcagttctgcctttaaacgctatattccatgagcaagagataggacttgaagttagtaattaatgaaggtcaagatagaaaaagagagccaaacagagcgagtgagcaagtgagcgagaagagtgagaaagagagagagagaaagtaagaaaatgagagcaagcacatgcagaaaatacaaagggagataaaaccacaacttccataaaacaggactaaaatgaaaatgcgtgtgatttcagaaaaatagatcaccgtccttaagtttgatgcatgtctatttaaaatgtttatttagtccgaggaaggacagggatgttttcccaactatgttgttgcaactatcataatatattctatttagtcttattttattatatcgttactgaatttaatagttgtggaatgaactaagtatgtgctcaggaggtcaggtagctgaagaacacttttctattccttcctagcactttcaagttcctctttattacattgagtgtcataagaaaaaaagtgattttctaacacatacgaattttctgtcacatacagaggtactgaggaatgttcttcctgacctgccgggtcacagaggttgaagttaaataactcagaccctattattcaaaaagccttgaaggaaattcaccataagatgacatctctgactatacatcaagggataatgaagagcacaatacagatccacatcaaaataagcttcagacaatggcataaatgtgttttggggatagcctggaatgaatttatagtttttcattaaaggtatatcgtaatctgtggaaaatatcagaggcataaaaataaattgcatagaaagaaacataatttttgagttttctttaaatagtaaacaactaatcaataaatttatcaaacattgcagcaaaacaaaataaaaaatgtttattgaaaagagagctgttaaaattcaactctacctatttaattgggaaaagagacatcatcaaatagaaacaatgtagtgtctataaggtatatttgcgtattacacctctcatacccttttatcggaatcattttttaaagaaaagattaagttccccttgaaaaagaagacagggcatcctaacagtcagttttgagactaaaagaaagaacccaaagcctagtttacatgtagttaaaaatgaaaacctcagctttacataagcccaacattaagactaattaccaagatttggatatggcataggcaaaaaaatcagctgactggatttcaggtgttcattcagatgggctaaatgaatgatagtgtcagattgttctttgtgttagacacaagaatgtagtaccaccattgacaaaggcagaaatttgcaatatgatttcaaaataaatcttggaatatctttctgaacggagtttacattgggtataattaactgagtgatggatttgaacagaaagtcagattacagaactcttcaaaatcattcatttccattcaaagggggaaggaaggaaaaagggaaagataaaggaaggaagaaaggattgttttactcttattaagacgtccttagtatcttttaggacaaagatgattgaagtaactggtgtacaatttggacattacttttcatattttatttgctaccttaagcacgtcttctttttgctggggtttctttttctctgattcatccaaaagtgtgtcagcctgaatgatccactttgtgatgtggtccacattctggtcaaaagtttccatgtgtttctggtattccttaattgtacagagacataccatggcattattggttagacaatattcttaaagaatttttcctatgttctaaaatgtttaaaagacaacaataaagtttcattgagattagttttaagtggtattttcatatagaatattgcgtaaatataaagaaaaatatattaaaatattgttatagatattgaattaagagccagcatatacgtagaattgagaaattttcaaacacagaattgttactggtcacttatgtatctttttctcgtgacagagaagggtgtaaaagcttctagccttttctcttaccaacaaaagatttaaccactcttctgctcgggaggtgacagctatccagttactattcagaagactgagtttatcttccaccaacgtctccttcttgcccaaaactgttttcaaggcctctcctacctctgtgatactcttcaggtgcaccttctgtttctcaatctctttttgagtagcctgtgaaaaggagagcattgaccttcaagtaatgtcttgtagtcttaagatttaatgcttatgaaacggctttctgtatggttactatgattctgcaaggttttaaacctataactatgtattaatgaatcatgaaaaccataccatatatactgaagcttcattgttgggtaactatgaacatatatatgtacataagcataattcatgtcttatttttcattataaatatttaataaacatacatattgttcaactaaatatatttatatttatttaatttatacatgtagtggctaaaggcagatatttgaaaatccatccacaaataagaaactgcccttagaaaattctacagtatggtgctactgtatttctgcagcagggatttttttagccttttagtgccatggatctttttggcatctgttgaagcttaaaaacccattctcataataatgcttttaaatgcataaaacaaaatacataggattttaaatgaaaacaattatactgaaatacaatgtgcaacacattttttaaatatttgtgatgtagtaatacatgttttatttcctaatatgttaattaacaagatctagcatcaggtctttaggataatttcaatgtagtgatgacgagcataactggtatttttaagtatgtacaatgtctggaacacgttataaaagtatctgtcatttctattagtgacaaagtcatgggtatctctattgctggagtttgttgctcacattttaactgaaaaaactgcttacttttggttttaattgaatacaaataaagataaagttttcccccaatccaagttcacagaccttatttctatccacataccctagactaaaatctcctaagagaataccactatttcctaagaggtgatttataaaacatgaaaacaatcacatttaacatgaaaaaagatagagagtagtgatggaaaaagtgatcttagtacaaaggtttactacctgccctgcataaagcccctttcctggtacatggcacggctgacagacaatgtggccactcggcattccactgagtctgtgcctggttctttccctgcctgtctagttagccagctgtgggacattcacagagagctgagccagagcccaacagaccctttttctcctttctcaataaggttaacagatacagagactgtgattggcactcgagttgaaaagctatttgcgagtggagctgatgtcttaatcacagaaagccaaagcaaaacaaaatcattgagaaacagcaataacaggaaagtggagaaagtccagatacaaataatcaattaataaacacacaaggagcagctctgtaatgccagcctacatctaatttcttaagaaaaaaattacagtacaagagtaagaaattaggtataggctggcctcatagagtcactctcaacatgtcttttctatctttataatatacctaagtagtcctgtggctgtctttctgccacgccataaggtcctggtccactcgaaatcacttctcatactttctgttttggttttgcctttggcatcggataaacaggagaaataaatgaggaaacaatgtataaaaatttttatgcaagacaaaaacactgtttcttcaattctaagatatggttttatgtcacattttttcaataaaaacatgcctgaaattaaggtacttaatgccagatgaactcgacagctatcatgcatggggttcttcatatgtaggtgctatttgttgcacacaggtgagcttagcaattcataaaagcaatttcttcatttatcaatcgtaagtgttgcctgagctcctattatatgccagttactactgtagcagaatcatatgtaattctcctcaatatattctgggagattattagaagtctctcatttgggtagatacagaccctttagagcttaacttcagagtagacatagactagattttattccttttaatactttgacttcaaccttttgtagtatacaacctctacaaccatagatgttagccattgttactaggctctgtgggataaaacggtagagaagtccccatccttcaaaaacttatatccaagtatgagtttgtcaaagagatggacatatacgcaaatgagaattatctactttctatattccagtctactggcatctcgctgtagttgatttattcacaaaggtaacccttcacaaagttgaagcttaatttatatttggattactaattatctcttaataagtcttcataaagatgacactatattttagcatcaatgtaaaaagttattgtgtacatagattttgtttcttacatgacaagcaatgcaattaaaggcaatggaattttccaaaactcagaagagatcacaaaagttttgaacttaggggataatgttgcaggtagttcctgggtcacagaaaccattatgtgtcaacatctggccaaattcctccagctaatttaaacaatgtccagtgatgttcagttgatgggaacaaaataggaaatgtggactaatttctagtgccttcttaagttccacaaaattataaattaaaactaaaagatgttcaatttatcaccattatcaacttgtatttgaaaaaagcagtgatatgatggtggtttataactgctaatggtcaaaagtgattcacaggacaatttacactctgtaaaaaaagagacctagagttaaacttttatgtatgctattcaacaataaggaaccagtattcaatcatttgtatacatgctgttttgggttaggaaaaaatattgtgttaatttagtaggccttaaatttttccctcaaatgtgtttttaatcaaagatatgacttaagaaataagacttaaataagacttagcctttaaatactatgctgagcttgctttctggagatctgaaatactaattgaccaatgtatatcaggtgcctaatatccagtctgtactgtgctattcactgccagagatgaggaatgaggtaatctttgcaaacctcactctaatcatgcctacagtgtagctgcagaggaaagcttaaatgcaataaaacaatttgatatcatactagaaaaaaatcacatttttttttggaaacagatgagccatggctggaataagcatgaatgactacaagggaaaggtgacacttgaaggcggagtgtgcatgggatggtttggattgactaaagacaaagtacgaagcaacgagaaggtatgaaagttagaatacaaggctgccatagaggaacagggaattcttactgtaaactaaaagaatacatttgatgaggttgttgacgaaccattttctctggctctaatagtttcccacaacacaagaatgtctgcatcttcagatgtatggagaaccaacctagagctattgccttggccattgtctttatacctgtactcattcctctcaaagggagctccttatttatagggttggcgagatggaaagaaacagctgaaaagatatggcatttcctccttttcaaaagcatccgattctcagcatacatgccttcttctgccttgtgaggtgagaagtggagagggttctagaagatctactcttctgaaggagcaagttcaaattcaatgactaaattcactaaattataactcagacactttaggtttttcagtcatgtagtaatgtgattgctgctaggatcgattttagggctgaagaaaaagcaagattgtgtacactcagttttaacttgacctatgacatgattgtaagtccaccttcaggagattcaagagaaggtgaacgcaaactatatacttggcactaagggtttttatgatagaggggaaaatatctgacataagtaaaatccaattaaactataaattctcacaatgtctaacatattattttccatatgttactttgtaacatttgatagctccagtataaatagtccaaatactaagcactaacttccatgatttcaaacaaatttgctgtctacttcttagccataatttgtaaatgctactctaatttccttattataaaagaatgagtataatgagttaatttcttccagtgaagtcatgccccatgttgatgggaaggatgaagaatacattctgattcattccccatatctacaagtataattgcttgtagaaatttaaaaaggcatgttcggttcagggttcagctatcggctcacttcactgatacagtagcaagatggaaaaaccttctccattggtctctgctgattataccatcagcatttttcattatttttatttaatggtagaacggtaaaaattattggaaaaatcatctggtcctataggaacacctttacaaacatttcccttcaggggtaaagaaatgtagctcacttaacctctattctctcctccacccatttcgtattttcacaagttttccagtaccttccacagattttcttggaatttctcagggacttatattcttaagataacttctctgtctgatctcttttttccaccccctctttttaaacaaattttattatcttaagagtctcctgttctctagagcttatcttcaatcagcaccacatttatttacctacgtaccttaacatcatttccttatagattcctccctttactaggactcaattaaattcagacttattttagctattcctttctcttactcatgttccctgtaatatgaataaaaggctaactaaagcatccataaaaggcatcttgagaagtccccctacccaggtgaattctgcacttagtatttgcaaatattataccatttctgatcacagagaacaggagagggttctttcaccttttagctacgtaacatattcgtggaaagaaaaggaatacattgccatattactgcaattctaagatgtgcatttgtcacattttaaggattcggaaattgagatgtaacatacaattaaggtttaccttgaaagtggtagtgtttttttttttttttttaaattctcagcagctgtaatcatatcaatggtgcatcacacaatctaacatgtcttaaacatgaggaaatgagatgctaattgcttttacagcccccaaaattactctatcatggctagaggtttaggacatattttactattaggctaatgtgacagaataatataatgatacattcaaaaagaacataaagcattaaatagtggattctatagcaatgtgtattgactttttaataacactgtattgtttattaaagaagaatttcatgaaagcagaatgaactgaacagaaataacagctctaactataatgacagtgaatagtgactccaatggcatgtaacagatgttctattttctaagtaacagctgcttgatgcattcattgcaccaagttaatgatctgctagtgttatttcacttcacagataaattactctgctcactttaaaaaaaaaagatacgtaatttttcaggggaatgagagtataacagactttagagtaagtaatagttcttatatttttatagctaagaggaatgatgagttgaggcagttatccagataatctaggaccagaaaccagatctctttaaactgtgaaatcttactgttataaaaaatatatatacaagacatggttgactgagctgaatttaggctctcgtcagacagcttgaaattcgcggatcttgtatcacattatctagtgattctcaactttgctgaataagagagctagttagagttagaccaattaaatcagaatctctggaagtgggccccaaacattgggatacttttcaagtttctcgggtgattttgatgtgcaaccaatgttgaaaaccacaggcaaacagaaagatgcattctgagtttttattgagtgatagtcattaaattctaagagtgaactgaaagccaaaggataattgagcaaccaatgtttgttcttcctgaggttaaatattataaaactttgtttccaaaataaacgtgaaaaacacggtaatttgttaaacaagtggctatttagacatagattattctgcatttaacaccttcagttaaatttattaataccatttgtgtgcgtgtgtgtttgtgtgtgttcctctcaggcaactcttggcatactaagactactgttaataaaacaggcggtaggatgaacatactataggaccaaattttttttttccagaaaatcttattctaccatttgaactttcagatgacaccatggatatttaggggtttaatggaactaaattatttaactgagttggaatctttgatgcttaaaacaaaattagaaataaaatgttagtgattaaatcagaaaatcatatagattagactttgtcaaagcttgtatttcccaaacataatgatcttcagggaagtaaacctctaattaatcacatacatatttactttcctatggttatgttttcgtgatcaattcatatgctaaacaatattggccagtaatgggatgttcagattgatttacttacactcaactaatcagagtgatattaagatactaacaaacaatatttgaaatctaaaatcacaacagtggggacagactacagactgtagtaggtgatagatacacacgggttttcattttattattttaatgaggacttatattttctgcacttgaaatttagccatggtttgtttcatgcttattgtgaataagtagctttttgttattttaagcttagattactttaaaattactagaaaataagacttcttatgataatttggtatagtggaaaaaactgttgaaatcaggcatagtattacagttttgctatgtaccaggacttgtatttgttcatctataaaacgggaacatttgatcaggtgattatttatgtttgttataaaacttgtacaattttaaatgtaaatcagcatttttctcttctctcaagaactgctttgtcattataatttgcaactcttaatttgcaagttacgtttaaacagatatttcatgagtatgtcctatgtgtcaggcaatatcttatgtacatgggaaatatcagagaccaaaatacacattttccctgtccttttgctgaatgaattactattgcctacataacagtccaagagagtaggggttatcatgaaagctcaaggaacttgtgcagttccagtattcaaactcttcaggtgctagtaatctcctgtagattgccttgccatttccttccatcatctctattctacagctatcagtgtttgtcacctcagcctagaaaattccattaacagaaaaggaaaagtatctgaacatttatggggtgataaatatcactgtgatggctgcctcgtggcattgctgttgtctggaccatgcagctagctaggattgatccatatttttaaaaacttaacattaattttaccctctttaatactactctgattgaagggtgaatttaaaaatacagtgaaagggctatgtcgctgtaggaagttgcaattagcattaataatttaaattgtcaattttcatcatcaatcttttatctcatttgttaatattctcaaatggctttcctcctgtcattttaatttaaaaatttttctttaccttttaaacaatttggaatacttttaaaatatattctttttttctgtaactataatttggaaacatggtcacagggtaaggggacacaggacagttttcttacctgcagctgtcccttcagttaatcacccctgaccacatcctcactacttctggaagttctcccattctttctctgtgggatcattaagaattagaatacctaagacattcttgagttcgtaattctcttcaagtagatggtatctttaaacatcttaaattgtgtcacgcaccacccagtatcttttggaagggctatgcattctagtatctatggtttggaatatgttactatttaattctgagcaggaagaaaacttagatgaatcattctatttaggaaagaccaattctacaacgccactggcctatcaaaaggatcccagaaatgtcaaacctctgatactcattcaagaagaagacatggcaaaattctatggtcaaacagggtgctgcttctatattagctttcctctagttcaggagtttgaatatgttctgtgaatggccacatagtagttgttctaggctttgtgagccatgcagtctctgtcacaattactcaactctgctgttttagcacaaaagcagccagaaaaaataaacaaatataaattgatacacttcaatagtcttatgtacagacactgacatatgcatttttaataatttttatgtgtcctgaagtatctagttcttcttttgattttttccaaccatttacataaaaacaattttcagcccatgggctgtacaaaagaaggtggctgaatggattaggcctaccaattatagtttgcccatctctgctctcatttatctgactagttaatttgccttcctcttggtgagagagtctcttaggcattcttctctattaggaagctcaagaagttggctagaattgatatggcccctattaggtcagctcttttcatggttcccatggtaacattaatcctcatattgaggatcctggacccacatgactttgaaatccttaggagtgaatgactattacaaatgtaatcatggtcaccctatgaaagcaatcaacatccgttattttctgactttttaacaaaagccattcagactggtgtgagatggtatcttatttagggtttaattggcatctctctgatgattagtgatattgaagattttttaatatgctcattggccgcttgtatgtcttctttcgaggagtgtctattcacgttctttgtcctgtttttaatctgtttttttttaatttcttgttgacaagtttaagttccttatagattctggatattattcttttgtcagatgcaaagtttgcaaatattttctcccattcaggaggttatctgtttactgtgttgattgtttctttttctgtacagaagctttaatttaattaactctcatttgtcaatttttgtttttgttgcatttgtcattgaggtcttggtcataaattctttgcctaagccagtgtccagaagaacttttcctaggttttattctaggatttttagtagtttcagggcttacatttaagactttaatccatcttgagttaatttttgtatatggtgaaaggtaggggtccaggttcattcctctatatatggctagccagctatcctagcaatatttaatgaataaggtgtcccttctctgttgcttatttttgccaactttgtcaaaaatcagttggttgtaggtgtgcagctttatttctgagttctctattctgttccattgatctaggtgtctatatctgtaatagtattatgctgtttgcgttactacagctttgtagtatattttaagtggggcaatgtaatgccctcaactttgttcttttggcttaggattgctttagctgttcaggccctttcttggttccatatgaattttagaattgttacacaatacacccatgtaacaaacttgcacatgtaacccctgaatctaaagtaattttaaaaagaaagtaatcgagaaacagagaaagggatatggagctttttgcacagttttcttgtttacaaaaagggaaataagatcattttcagaggaccttcagttctgatgttacctcacccagtgacttacagatctgtcctctctaataacgattctctctgaatagaagtgttcttaaggatagaacagcactgctgccacacaaactgaccatacacaggctaacttttggttccactttgatgaaaattctcagttctcggtttgcgctattcattcccttgactctgctttcacaaggaaatcattgataagaatctgtcgatcatgcttcaatgtagataataaagaaaaaaaaagccacagaaacatcctctttaaaaactggaaagacaatgttccttattcatctcgctggaattaatctgctaggttcctgtcctgttgctcaatcagcaggagaatctttggccaatgcttaggcaaaccgaatgaacagtggccatgctcttttgaaaccaataatactcacgaagtgggtgttccttaattactaagcgttatcttacagaacctggctagtggagtttccaaaaggaaaaatcccaagcatttgcttttgtatgttttcttatgttcttatatgtgattttagacacacagaaagtataccaaatgtaatcattacttctgtatgcataactcatcttaaggaatgaaatattacaagtatcatttaagtgtcctgttcatatcccacccaattcttttgtctttcctcacagagatagctcttgttctgtattcagtttatattaattcccaaacatctttctgcttttactatatattatatataactaaataatgtatatttctacatattttatcctttgtgtaaatggtaacacactgcaacatttaaggtgtttccaattttactatatttctcaagaagcttgatttttataacatctctttcatcgttttaggcaaccttccccttcctttttaaagggcacagcattagaaaacaaatggtgaattgccccctaagcctatgccaagtttataaagaacataactgatcttttggccagtgtaagaaactcttctggccgggtgtggtgactcacacctgtaatcccagcactttgggaggccgaggcaggtggatgacctgaggtcaggagttcgagaccagcctgaccatcatggtgaaactccaactctaccgaaaacacaaaaaattagcagggtatggtggcaggtgtctgtaatcccagctacccgggaggctggggcaggagaactgcttgaacccaggaggttgcagtgagccgagatcgggccattgcactccaggatcggtgacaagagcaagactccatctcaaaataaataaataagaataaactctttctttcggtatctatttggtttccctacaagttggaataattcatctcaatgctagtagtacctctctgaaggtgcatggggctgacttaagtattgctcacacaatgatggttgtctcattttattaattctgtgtattttatggtaggcctaaatgatagttgtgatgggaccttattgagaattttggtggtactggaaaactgcttgcacatggactatggccctataaataggcgatgaaatactattaaattaattaaataacataatctagtaagaaatgaaggaacagcaagaatgcctggctgctttggtggtcaccaacatagtttatattatagacaatgcatcatctggggcctgcccacagccacggtaaggaggtgaaatgagtatagagaatccaattttttttttttctcataaaaacttaagtgttagatcattgtggaagggcttgatttgatatgacagggatttttgataaaccgcattggtgacatgaatacagtaagccagaccagattgcttttgattttaatgttagattcatttttctcagcttcgtaatgtaagaaaaactgaattgaactttaaatatgcttatacttttctaatttaggataggaaatttcctcgattatataacacggctagttaaaaaccaaaaccctaaaacttttgtgtcacatgaagactttatgaaatatatattactatagattagtaaaatctgtattgtttttaaggtgacttctgattctccaattggagcaatacttccaaattctttgctaattttgatcttgaaaagtgaattctagttttctcatatcacaggaaaaactagtacatttagactcagtattatcattaaccagtatattaattttcatcacactcagtacttgatacttcatgccccctataaaacattctcacttcaccttttaaatgccatcatcaagtaagagagtactactgagctttattttcaatagcttttacagctaaagtaatagcccaactgtgttttcaaataaatacattcactgagagattgatacaggttcctagagaagtcaacatattttgagttgtcgatggtgagttttctttcttcaattatgcttggcacgaaaaggctcaatagccaatttctctgtgactggttcaaacccaaaactctatgttagcaaaaatttttagctattgaagccttctagtactatgacatacacatgaatatgaagccctgctttccaattagatatagggccaagtatagaaatgtgttctcagttagaaacaatctggcttctttccaggaaaaagatacagaaaatttttttctgtattcagagaaaataaataaccttcaaatctctgatgtctaattctacttaaaagctcagttgcaggaaagcatattcacagaaggttacatgatgtgacaattacgtattgcatgcctgtataaaaatgtctcctataattcataaatatatacacccagtatgtatccatacaaaattaaaaattaataaaatagagaatctgaaaatctgaaaacaattgctagactactttagacttctgctccaatattttttcctctcatagaattgcttttcctgaatggccctttagcactaaatttttctttttcatggagccatgttggtagaaaaaaataaacattcttattgtttattataagaatatgaatcagcgtgttatcacctttatgaccctcccatttattttcttctggcactaagttctagcaaaaagctaacatactactagtaaagttaaaattattttaattattattttaataatttggaaactttgggtctcaaaaatatgtttacttcttggttttgtcttttaggaagcttggcgccaatttgtggctttaaaatgttccctgtccattccaccacccatgatacattgtggatatatttctatgcaagaattttttattatttatctactataattttccttttcctagttttccaatttatttaggcttctcaagttgtgccatatgtatctcttcaagccacactaaataatttttctggaatttaatatatattaaatataattaagatactttaagataaaactgatactatttaactatagtcaatgtacttgaaattatgctttgtttggataaactaaaggtcaaaaaatcacttcatgagtaattgacatttttatgtatttgaatatttgaaactagatgttcaaatactttcatacgaaaataaatataatgttcttgggtcaacagaactgggagaaattcagcagatataaattaaattgtctaaaaattttttaaaataataaaaaagaaattgactctagatattcaaatttgctgcagtcacattccaaatacttggaatgatcggcaactacatttaatgtattgcatttaaatgaatttaatttagtttttaaaaatgtgacatttatcttttgaaacagcagatgaaacttatagcttgaattaagctctccacctaccaagaaaccatgagaaatgagaatgtactcaatagtcacggggtttcatatatgagagtttgaattttatgttaaaatattagaatgattatcataaatgtgactggcttagatctgcagggcatatattcttttatgattgttatttttaaagaaataatgagaaccttccaaataaattggtaaaaaaaaaaaaaagttctgtaattcagatgcaaatgaatatactttatttgacaactaagagattttagagtatgtcattaacagcttagtgtttgaaaagatctagatagagtgataaattatctttattctataaagaaagaaaataaatgccagttttctaagctttttttttttcctactagatctcacagtagctttgctccttgacgttatgaaaaatactttccaggcagattcaacaagcagacaattctccagactattcaagccttctatatgagaaggataacctagaaacctctgcaaaggtcattaccttataacatttgaatgatttcatggtgaggctaatgcaaaaatacctcaagtaatatgtttgaatgataagaaaaaataaggctaatgtgagttttaacctgtatatactgtatcttccttgctatagtaatctcatgtatgatcctgaataactataattcaatatcttatctaacattacatttattctgaaagagaagaaaaacaatttaattccctactatttatttggaaatattttatgtaacaaaatatattactacttgttctctgaatctacataaagacagttttcagtttgggtctcatttatacgattgtaagtttttacataaggtattgaaaatttcccaactttgaataatctggatagccacattgaattaaaaataaagtataaacgtcttatacatctagttaatttggtaactttaaaacattaagtgggtgtaaatggcctaacacagtggcaaattttgaggtaaaacatgttatcaatatcagctattttctttatatcaacacactttcaggtaatctggtaatgaataaacagtaaaaaaaaaaatactaagctatgagtctcttgactaagttctaagcagcatgaaatgattggccatcagagaaagggcaagaatttaacggctaatgattacaggagtcgctgtgtcatttggtgatggaaatgatagcccctgcatagacaccttgagattctttctgaaatgcgactttggcaatatgctaatcttgcaagtcctgtccagcccaactgtcttcaatctctgtgtccttgccctcttcatggctgtgggattcatctgggcagtatggtcttaggcaagccagtacattataggatctcatctctggaccaattttcagactaatgacctatgtatttcttaaggtcttattcataatttactgaactctaaggaagcttttggagagactcctgctaaagcttaccattggttttatcatggtcctgaaaagcacagattaatttttaagaaagggaatatgaaacaatattaatatttataatgctattattgctacatgttaatacttccttacaaaatcatattatgtgttttcacgtatgttcaaaataaccttcagtgatataggttttacctttccccaggcaacttcagaatccaaattactaggcattccttcaactgctgatctctttgtcaattccatatctgtagctgccagccattctgtcaagacattcatttcctttcgcatcttacgggacaatttcaagcatttctccaactgttgctttctttctgttacctgaaaagaattataatgaaatgtaatttagtttactctttaattcaaatttcgttataaccacttatttggaacttttatatttctgttatttaaaataactattttcttacacgttttaaaataatattttataaaaatcatatattctgaatattaagagtgaataaaaactgtctagggcagatgacatcgtttgtccaaaagatagggtcttgtatgtcgtcatggtagaaaagaaacctatacgaatttttctctaagataatttatagccaaagtttatgataaatacaatgatataagtcaaactgaagataaaactcatttctcactgaaaacttactgtcatgtgtcaataatatggcaagaaggtttacaatcctctatatacaagtgagactagctcatgctggtaaggaatcaaaatgaagatagaagattaattctctcaaaaggtaaaagtatttgtgtaatacctagaattctcaactgtatcctcgttacatctttaaagtgtctcacatctgctcaaaaacaatacagtgaataggtcacttcctccttaaacataattttgccatccaatagggacaaaaagatgaatgtgaagacaatattcattcccattaatagaaaaactaattacttgatcctgtgctcctgttctcagtgtttgataccaacaccctcaaaagcaaattatccatattctcacataagaaatgaacaaatctgtatttctccaccaccttctcagatgtgcctatattttgttaagattttcagttggttggtttaataaaaatcccagcatctctttctactaaaggcagtcaaatcatcaacaaaagccagataaattacaatttcttaaaggcaaatcttcttgcctcacacatctttagattactcctctctactcctgaaagttccttgaacaaagaaaggtctcactaaatatgctttatgtattgaataaaggaatgaatgaagacttgcaaatcgttaattacaagttagaaaatataactggtagaatttacataaagagtttatactcttacaagttgctcctggttttcttttctttggtatgtgttttcacctttttttaaaaaaaacccttgtctgtcatgaagcctgggaatctgaacaatagatataaatatttggctctgcagaaacagcatgatggaatgtaagtatgttaggctctgcgatacgtagtggactctcgacttgagtatgatttttggcagaacacctcatttttctcaacacatctgtcaaatgggattactatacttattaatagaacacaggaatattgcgagggtaaaggcagacaacagtttgagagagcatgacatattgtaccacctcaatcccttcctttattctcattatttacctttagggatggttcaataaaaaactgtgcctgaatgtatagagcaaaagctttatttacatttattttactaccttacaggtaaataaaacatggacaagatttggcttttgttgctaagaaatctgaaaggtagactccagattaatttcaattgtaatggaattggttaaaacaataccaccaccacaagtgcgttatttgtgcattatgccctaagcccaataggcaccactgactgatacatatatttatgtcatatatatgtgtgtgtgtgtctatgtgtatgtgtgtgtacaaccaaaataagaatctatctataagcaagaaaaacacaaaagataaaaatatgtataaagcatctaaaatgctacaatcgaaataaatattctggaaccttgataacaattccaattccaaataataaaattccttattttctttaggagaggtgtgcgtacatttagaaaacatttagttgctgaggctgtaaattcattttttaaacagattttcccttctatttttttttttcctaagtaaaagcatctgcccttttgactgcaagaattttgtgttgtaggggtgtgtggggggtgagggaaaatatactttatggtgtgtttctatgcatatttttcctatgcattattggtagaaaaatgattccagattcaatatttcaaagaaattctatcttcccagagctaatgcagtattgatttttatttatttcattttgtttatttccagctaaatacatttttaaaaaacaggagacactgccatcttaaggaaaattgagttttatactttgtgtgtgtatgcgaggaatggatacgtttaacacaatgccacctgcagtaaaatgttttagtagtcattgtttcacgaagttaacaatgtatttaagggatgatattagtattgctatttatgtaaatttccataaaaatcagagcatagagaaataaaaaggggttataggtattattacatcaatggtgccagctttaatatctcttaataaattaattatattttctctccccactcatcaccatgtaagaatacagcaaaaaggtaagacaagaagaaagctctcctcaggaatgaaatggatcagcaccttgatcttgcactcccagactccacacttgcagaaatcaatttacctagtttattttattgtgttatggcagccagagctgattactccaaaaaggtaatgcatactcaattgtggcagacacaaccatataaattctgaagatggttaaaatagaagggttccttcttacataaaaagaataatgtaataacatttcctttgttgcctttgctttcattagacaaagctactgctgttgaaaatattttgagtcaaaatccagacaatatttttattctcaggcaaagaatataggacttacagcatttttataagatggtatttatacatgatcccttagtcacaaatgtttctacatcaatatttacttcaaaaataaatgtttggcctatgtttttgctgtattctgtgatactattaaagttaaatatgatttcttcatacacttttattttgctttaaggatattactatgtggcaaatggttagaataaacacaagctctcagatatgtattttcaggaataaatagggtttgacatcattacgagaatcattcatttctgaataataatcaactcagggcactattattcgtctaatgtcactttcattgctttaaattctaattgatttattctgttattttatgttaaatttactcttgcaatgatttcgtaaaaattcctatgacaaataaaaagcccacacacaaaaaacctctattttaaaaagtaaactgagaaactcccctttaccaaaacatatattttcttaatttaaaaaatactcatccatacattattttagtataaagtcacacaggtcaaattataaactgaaaatttgtaatttataactataacatacattcattttattaatttaaaatttataattacaaaaacaatatatctccagaactgaagctgtagcattaggattaatattagagattattcaatctctaatacatttgagactagagattactcagtccttcgtaattgatgttaaatatgaaataattggcatctataaaaattgataagcaccggaataaggtatcaagtgcagatacaatttttctgtctgtggtgatctttaaacaatgataaatttctctagaggatataaaggtatctcattccaaaggtaccttggtagaccaaatgaacagttgaaatgtattttatttcaagattatcataatgctttcccatcaattgagtatcagtgtttcttattttgaaacaaagtaggagaatcttttgtcataggatggcaacaaacttgtttaaaacataacaaatattaattagagggtttttaaaatataaaaacaagactatctaagaaaaatgattacttccagatttcaacttaattataaaatttactttctatggtaaggaattggcaactaatatcttgaagatataaccttcaatctactttcaggctgagatgcaagaaatatgcctctccttagctatttctcaaacatggacattcatatttctgtctaagatgaggtgacaattttatcagtgatgttgttctattcactaaagttgagaacctgagttgtaaaaatataactttttatcctccaagaaattcagttctttcagtcagaacgaaattaaaatgttagaagtccatttttggaaatactaagatatccgtttatggaaagatatcccatattcatggattggaataaataatattgttaagatgtctgtaccactcaaagcaatttacagacttaatgcaatccctattaaaattccagtgacatttttggcagatgtagaagaaagaatcccaaatttcattttgaacaacaaaagacccagaatagccaaagcaatcttaagccaaaagaacgaagctggaggtatcataattacctgattcaaaaatattctataatgctctagtaattaaaagagcaggatggtagtataaaaacagacatatagaccaaaggaacagaatagagagcccaataataaatccacatatttatgatcaactgatcaaccaaggggccgagaatacacaatgaaaaaaggacattctcttcaataaatggttctgagaaattggatatccaaatgcatgaaaatgcaattggacacttatctcacagcatataaaaaaccagttcaaaatggactcaagacttaaaacctgaacctataaaatgatttgaagaaaacaggaaaaagcttcctgacattgttctgggcaaacattttttttggatctgactcccaaagcacaggcaacaagaggaaaactagacgactgttatcgcatcaacctaaaaagcttctgctcagcaaaacaaacaatcaacagagtgaagagactacttactatcataatctatacagaatatttgagttgagcgaagtgagatggagagatataggcatcttgaattagcagtgaagtggagctggtcatgagactctgatcaggacaatgatacaaaaataattacagagacgtaggtcttaactggctatccatgctatcttattagccaagtgtggtagattttgcaagtcttggccatatagggaaataattactgtgtaatttttaaacttaatgtggtctctgtggaatatgttaacaacattagacctacatataaatagatacagtttataatatttaccagtcttcaagtcatcacaagtagatatatataatgaaaataaggaacacttacaactaagaaacccttttagagctatctgatggaccaggaaaaacctccctgagcgttacgtatttttcaatctgaataagcagagcctcactgattaattattgtttcttaatgagaattccacatcgaaatatgtgtatatgtttatctttgtgtatatgtgtacatatatatatatacgtatatgtgtgtatatatatacgtatacatatacatagagagagagaggtgtttagaattgctaagactctaatcatacataatttattgcccgttgctttacaatttataaggaaagtggaaagaagtgtttgtggtctcagcatgcacacacctttgctcccagctcattataatgcaatttcaaagctgttactctttcatcaagttctttgggattttccgtctgctttttctgtacaatctgacgtccagtctttatcaccatttccacttcagacttcacttcactcagacttttatacaagttctaagtttaaacataaaacaaaacatgataatcagtagagttaaattatttcataatattatgaacagaaataaatagagatccccttaattgctattccatgtttgaaattttaatagagtagcattttgcagcggtggtcaatatctagcttttgcattttctgttgatttaatatttctaattgtctacacacatgcatatatgtgtcatttgcagctattcttattaaacagagagttaatcatatatatgtgttttgtgatatatatatatttagttcttcaatcaaagaacataaatgtcaattctgaattttacatgacttctattttaaatgttggagttatataattctagccataaatttggatgaattaattcactcctacatcgggtatttattgagtggttactatcaatcagatagtatttgaatcactgggaagtcagtggtggccaaaacacacacattcactattgttctcatggtacttacatattagtaacattaaagcacctaaatttctacatcataatttcaatatatattgtatcatatataagaaagtaaggtccttttcaatgttaattaaattacacaactttattttcttaaaagtgctgatgaaaaccagatataaaaatattattgacaattcacatgtacatcacaaatataaagcacacacatacggtttcacaaaacataggttgctataaaaaagcatcataagacaagtgtcataactttggaagacagctatgttcacaattataccaccaacaccactccaacaccacttgatgtcttaattttgctttgtagttttcctagaaatatatgtctttgtatgtatgtggccatgtattcaaatatatgtacgtgtgtgtatatacgtatacacgtatatataatagtttacattatgtatctctgctttaatttgtttagtcataaatctgaactatcagtacttattttagtattaccaaaaaataaacctgacagtaggtaattgtttttatggaattagaacaaaaattgggtttaatttctcttttcagtttaaaagtaatgtctaaaaaaaagcattttgtaaaggctggacaattatctgatcaatgctacatgtatatttccatattaatcctctttgacaaatgatgttaacattccttcatcactaataattatgacttttgtctgagtttcccagatgatattatttacttcattttacttttttcttagaagatataaaaatatctgtgtatctggaaacactgaaattaattattatgttggaaatcaacgatgctaatttggaatcagagatttttctaaattatttactctctgaacttcaaaaaatataaatgctttattttgatgaagaaagttccctcaaggtaccgttagccattaacattgtttcattcaataggcaagtaaaatatttataaacaaaggggagaaatattatttatatttgtgttcatgaaagtaagacttttataaatagacaaacatgtcttgaaggcaagactatgattatggtatacaccacaaagcatcgtaaacaatgaaaaaactaaacagtgtaaggatattcttatgaaagaactgcttcaattggtcctgacatttaaaccagaaccagaaaccaattgagcaaatgccttgagcagtttcctttgtactgacgcagggcacagtcacagcttgacacaggtgagattgttttcagctcatatttactgttggatacattttataaggtaacattagagacctgtttctagaaaagaacgaaaagtgctcactttgcaaatattagtcatgaataaggcacttgggtcatttatgctttccttttttttttttttggcaaaatttaagatgggatatgttcccatatattcctatccttactcatctaatatcaactaactactttctatcatttctattccaagtttctttttgggggtgagaataattaaagtaattataccactaaaatgcagcttgaattatgaaaatatattatcgaataagaatacctcatatttttcacacataaatatatgtatttattttaagatatttgttaaaaagaaaaatatttccccattcatgatatgactacgatgtatctgaaggactctgtttttcattgatattatggagtagatgtagaaacaatacttaaaatatcaagtactaaatagacttgttttccctttaataacattctgtgttttcattttatgtgacttcccactctaatggccgatagtacatgtagagttataataatacttatgttactcgagtagatgcaatcatacctcagctttgttttcagaggaatcatctcagttggtgagtttccaataacagcaacataggacaccgttcaatattataaagtttaaatcagatttatactttaggctatttgtacctttccatgccttttaattcggtgttgtcttgaggcatttcactgtatatccagtactggtgtttaaaggaaagttattaaagtttggaataagagtacctgaattggaatcttgctttgccattcaccagctgtttgtccttaaattctctcaggtaatctgtagccttaagaattaaaggtgacttctgtatgtcacgtagtttacctggcatccattatttctgaagttgttaggattattgcaactactgttgttgttactatttttagattaatatatttcctttctagatttccatttaaaatatatttaaagaatcataaaaattaaacacaagcaacatccttttatattctgcacagttcttagcagaattatagactcaaaaaagacacacagaataggccacaatacatgtgccaatttttgttctcaatcttaaaattacatagtataattattatggttatctgaaaacaattctctcttataaaagagcagttacttcttaatgaggaaagtcaaggggtacctgcgtatttgccaccagaaatacataccacacaatgatttagctgtgactgtactacttcctgttccacactctttgtttccaatgcaggcaagtgcatcttcacttcatctaaaatcatcttactttcttgtagacgctgctcaaaattggctggtttctggaataatcgaaacttcatggagacatcttgtaattttttctgtaaggacagtgtaaaaaggcactgatttaattttgcctttcaaacaataactggtcctatttttattgatagatctgcctttatttctgaagatatacagaaaaataaaaacaaaataaagcagtatttttccattcatccaacacaggaaaacatacatttgggagaatgattcagtagttttttcttaatgttatactaaataaaaggtaatttattaacctattttatctttaaaatgtagagagcaaaacactcattgtttagacatcaaattatagttttcaaataatgtcctcaaatccaatcttgccaataatcaagttgtccaatatagactggagtataatgcccaacgaaaacacgttccttagtttctgaaataacatatacctgtgcaacatcaatctgagacaggactctttgggcagcctccttcccctgattatgtttcttcatttcttctaaactgatctcatgacttgtcaaatcagattggattttctgttgggaggatagcattattagtcagcatgctctacaaagaacaactaactttccaagaagacgaaattcagaaactctcctcaaccacctctaccatgtagcttcctttaaaatgaccgtaaattggccaagagtggtggttcacacctgtaatcctagcactttgggaggtcgaggcaggtggatcacctaaatagaattatcataaatattttttactttcataaattatccaagtgaaacgatttatttcttccctatgggattattatgaaaaaagcaataatcattttgagtcaatatcaactatttcagatatcattttcaataggtaatttatatattatatgtagaattgatatgttttatctttgaagtcacactcaaatcggaccaaagacatgatgttaatctgtaagattcagccaactgtgacagggatgagatataatgagaaaattgcatgtggaaaatactccttaattaccttctttttattttattttattttattttgtagaggcagagtcttgctatgtgacccagcctggtcccaaactcctggtcttaagcaattctcctgtctcagcctcccacagagctgtgattataggcgtgagccactgtgcctggccttagtgtagtctactcagtcattatgtgccatatttcagttaaatttcagggaagctatgaatctaagaaatggaagtcaaatgccccaaacaggtattgctatttgtctgatagatatttgatggcttccggcagatactgattgtgaattttagataactataaaacatttcaatatttatatattcaataaagacattttcgatcaagttctatagtaaagtatattctgcatttaacatatgaatttctgagccagttataggcagggatctctgcagcatgtggacacgaacacaatacatttatttatttatttctgtcaaatccatacaaaatcagctagcggtcaaatcattctaatttaaaattcagtcattattagattattataatttagagcagaaactaaattataccagagtgcccataacattatcatgcagatcattttgcataacgtatattagtgtaagtgaatttacaccaattggagtaaattctgatacatatcattagaagataacatcagttttgcttagcagtttccagagcgaactatagccctgaactgagtaatgagaattataccaagaacatggactaagtggttaaggagctccttatgcaaggttataaattcacagatgtacctcaatattattccttagaatattaatcctaacaattatagaggcaaatcaattatgaattacctaaatagttagaattctgccttaaaacaaatgagagcaaatacgcatataaatgtatcttattttattaccatatcgatgatcttcattggttgaataactaccttgtgtgagaaatattgatatgtttcgtgaacctagaatctgggagtagggatccatctaggtgcatgacgttatttatagagcaagaaacatcacagaatctataaaattggatggaagtatgcagggtggagtgatgcttgtacggaggatgtcataagggagttgatgttaaagtagaactttcaataattagtaagcattgctgggagtaacagatgctttagaggggttatggctagggcctttcatcttggaaatgttaatcctcctcaaaaaggtgggccagtaacaaccatgtctgtgccacgtaattctggccaactccatgttatgggtgatcagaatacacacaatgcttgtgttaagagagaatcatcagaatctctctcagaaaattagaattgacagaagagtctggtcaaactgtgagtgcttcgaattgtgtcacatatactagcaaattgtgcttacgaagtccctagtttgcagagtggattgaggaagagcaaaggtccatgaacagagagagaagaaagaagtagatgcatagggagtgaggtggtaacaaaaacactgatggcttccaatgcggtatggctttatttatttatttagttagttatttatgttttgagatggaatctcgctctgtcacccaggctggaacgcaatagcacgatcttggctcactgcaacctccgcctcccaggttcaagcgattctcctgcctcagccaaccaagtagctgcgattacaggtgcccaccaccatgctcagctaatttttatattttttagtagcgacagggttttaccatgttggtcaggatggtctcgaatgcctgacctcaggtgatccacctgcctcggcttcccaaagtgctgggattacaggtgtgagccaccgtgcccagcccgtagatagcattttcgaaagagggctgcaataatagctcccacagcacatgctcctcttaccactccctcaacaagaggtgaagtttatttcttcagctctttaaatctgggttgactctttgactgctttgaccaatagaatatagtccaagtgccagttatggcaaaagtccttaagtggcctggcagcttccacgtctatctttttagaacagtcattcttagggtgctcccttttagaatccatccaacatattatgctctgagaaagctaagtaacatcgaaaggccatggataagtgcttcagcaacaatcacaacaaggctttcagccaacaactgctaggcatgtgaatgagtgatcttggacgttcagcccagttgagcattcaggttactatagtatcagacaacaatggactaaaatcacataagaaaccacaaaagagaaccatccaggtgagctttctcaacacgcaaaaccattagtgggaataataaatggctatcataaataaccaaaacacaggcattagtcccttcttgagtcaaaactttattactgcccttggattctatgacacattcctgtttccatatgaaaaacctttctctctcatttgttttgctttagttacttcaattttgttacttctaaatgagagtcctaaatactgtatatgcatactggatacgcaaggatataggagttgtaaaaacaaaagcatttctggttgaagagagacaaggtgtggagacagggcactgaagagcataaggagtttggcaaaatttaacaagaaatgtaggtagaaatcaggtattaaataactttatgtcccaaatgaatggttaccactattttgatcacgaagataaatttcaaaatttgaaattgatcataatcacagataacagtagttttattgctaatatttgatccgataactaaggaaattcatagggaggaaatgcgactgtaaatcagcagtatgttgaagtgagtttgcattttaataatcactatgtgtgtctgtacagagagaaagagggaaacagggtacatttgtataatatgtattttttcagtgttttcaagcgttagaggaaagcagaaagagagaacaaagagagaaccatggagaacacaaatttaactgacatggaaagaaaagcaccaaataaagagaaagaacagtcaaagagaaagaaaagaagaactagaaaagagagaaaatctcacatcaattgatgtgagaattttaagaatgagagagagaggtcaacagtgacagtttgagataggttcaatgggatcaatagtaatcagggtacatgagctcgtcaatgaccattgcagctagaagagagaagtggatgacgagagcagaaatcgtattttcaagggctggcctgattaaggatcaaggagcactctaataaaaatagtttaaattacttttgcagacttttgtctccacacataataaaattcaggtcaatcagacttgaacatactttaaggctacatgaaagaagccaacacataaagtgattttttttaaatgtaagaagataaacttgattttaaaaaaacctgtttaaagcaagaaaaccagagtgaagcacaaagctcagggccaacggaaaatatcaacaggaggagaggtggctctttttcagaaaacaaaagtaagatgtgaagacgcaagaagttgaatgcttcctacatggtgctctcagagtatcagggtgaaatcatgttaacagtaaccaggatttaaatttcagggctctctcttgccaccttgggcaaagcatcaacatgttctgaaccttgattttctcatgtctagcccaagaatgataatagcaagccagcaatgaagttttcttatctgagaaattctcatttcttcagtagtcaactacattggttttggtcaaaaagatcagatgtgacagtatatgtaaaaatacctgtccatgttatttgcacaaatatttagttataagttatcagcgatataacatgtcatttcctcgtaagcacaaaaccctaggtatctgctgaggatgagaggagagaatcaaggtggaatttaaatcaaagtgataaaagttcaatagcaattgtggagactgtgaaaggaaactgatttaaaaaaataagaatacactcagagagggtagagggcccaaattatacatctgtaatcatatctgtgtacatgtatttaaaagtttttccatccccttagcctccaaggttagtagaggaaaaaatgaagtatacacatagtcctttaaccttttataccagagtggtcaaagaagagcaaaaaacaaaaaaacaaaaaaaaaaaaaaaaagaaaagaaatcatcatcagtatcctcaccaccacagatatttgtgggaacttatgtgctaacactttatataattaattccatctcctaatcatattaacataagtatttatcatcttcatgtacaaatgaaggtagaaacatcaacatgcccaaggtaacataactaggaagtaacaaacttgctgccctctaacaattatactgcctctttaattatgattttaaaataaaagtatcctccaaatggacatttgtgagaaaaaaagaaatttaatcttattcgtatgttgatagcatttagtcaatttaattcaacaaatcgttcagcttctactactcaattccacacagtgagaacaaaattgttgcccctatacttacagaagccttattttaagaggcagactgtagatatataagtaaattacaaagcagaaatatatgcaatgtaatagaaaaactaacatcacacaccagggcctgtcgtggggtggggggaggggggagggatagcattaggagatatacctaatgtaactgacaagttaatgggtgcagcacaccaacatgtcacatggatacatacgtaacaaacctgcatgttgtgcacacgtaccctagaacttaaagtataatttaaaaaaattttaaaaacagaaaaacccatgctctgtgatcagaaagataaatattaatatctgctgtataatctggtgatttttaggaaatttacatgatttaactagcatatggctgagaaagggttttggagggtcagagaataagaatataggatcttattttaggctgtaggaaacaagctagcaaagattaggcttggggcatgcagagtgtgtgtgcttaatttaatgggaggaaagactgaatgtgagttagtaagaattactatctagatgaggaattagtatgaagctacagaaccttaagtttcagtgcctctcacttgcaagagacccttctataaaccagcatttaattttctatttataattttttttttcaaagactgcccctggaaattctagaagctcagcattacaaagcaaagcaaagatagcgtaagtgatcactgcaacacaggccttcctgataagttccacattttcccaaatgagtcatattgttgtcataagtcataaataataggaacaacaacagcttacatataaccaaacactcgacttttatctgttggcaggggacatgaaggaccaagtaacctgtgagaggaatgttgggcaatttggagctcaaggcaaagcattccatggaatttgaaatatacatatttccattaaatagttagaaaaactgttgaggatgagcttctgtgtttttagaaaggtcgccaccactaaaattattaacattgaaaaaaatcatcattgaacatcatataaaagtgagacttttatcataatgtataggcatttctagtgaaattcgcatatttgtagtactgttccaatatgattagagataaaattttctttatgcattgagtagattatgcattaaaaagaactcagtggttaaacatattttggaaattgaagatgaacatgtgtctataccacagaacttctcagaatatttattaatatatattgtgtatatccaagaatcatacaacactttgtagatgttatccttttgcttttttttgccagagtgcatcatacaagtagatttggaaaaaggctatcaaatatacttaacatattcattaataataattcaattcattactaaaattataaaataaaatgtctttatatttccaattgattctactatgggtaagctgtaaaacatgcatgacacatatttgccagcatctttacacattaattccacaaaatttacatttaaattgtaattaacttttagcttgtacttaggatatcttttaccagctactttacctaacctcgtcagaactgtattctggaaccacataagtaaaaaatgcttagcactttagcgcaggcttattgtgaaatagaaaagtaacttgtacaaataacagaatattattgaaacttctgggaagaacaatctcctatgtaaaaatcactcataaaaaaagacaatgtaatcattttcttttttgacattatgagaatatgatgaaagaaaataaaattgtggaagaaaacattggggatagaagattcaatctgaaggaaaatgatctctctacttgtctactagatttctaagttgtcctaaagatgtgagggatgtataatttgagttatattttcacctaatatatacatctagggggatatggatagtaagcatttgaagaaaacaaataagccaaccacatacaactattcttgtgaaattatcagcctggcttcgtataaaatcagtaaactctaatggaaacaaagtgagaggacatagcaaatcacggatactgatgtgaacactcacatatgctctatgaggtgttctcaatccagtacctttcagaatcactagattttcttcatcaaagtcaagtaatataaagcaaattatatcatctttccattatattaaaaaagacatttgagcttatctcaacattccattataaaaaaggcatttgagcatgcagtaactatgttcacagcactatatattcaaagtaggaaaataaaacaagtgaaatcgaattaaccatttttccattgaatatggtaaagggcaaaattatagaaccaaaaaatcattcaaacattaatcacattttaaatataggactttacagttaactgagcagagagcagggctgtttttaaaatcttgctttacctcatcaaaccattctcatatatatagtaacagaaaatggccagcaaaattatactgcagcaggctaaagtacttaacagaatgaagaaaatgatatcaaataattattggagtttctgtggtgtcaaagaaaggaaaaatttagagaaaataagaaaatattttagtaaaagatattaaaatacttcatgttgagactactgattgatggaggaacgtaccactgttagattagtaattttgaaagagccagtaattttgaaattgctattttcaagaaagggaaatggccacatatcacacgtacttagaaaacgaaagaaacaaaatatatcaaaagatttgggatgatatgtactttccaaagataggaaaatgcaagaaatataattattttcatagaaaaaaaatgttgaaaagtttcaggttatactttataataattcaacaagtaaaaaaagaagaaattcacacagctttgtactactctttttttaaacccccccccccaagtagagttacttagaaaaatattacctttaaattaaattttgtcagctaaagaagttttgacttttatcagaaatatgcaataggccaaaggaaacagtctatttcagtgtctcccctacattgttccttgacatatgagttttgtggtatatcaacatatttctggaggaaaaagtgtctgtggcttcttatcaaatttaggttaaacttttatttttgaaaatacaaaaaagtgggtcaaaaatctccagcagagaagtaaagcatataaatttttctgcgtaatcttgaccacagaaccgtttaaaaataaaaaattggacattgtgtataattattacttgtaatatacctgagaaacgatgttacgcttagtcataataacgacaacgataatagaagagttcattataataatgtattttctaacaaagacattcttcacagaaatagaaaaaacaatcttaaaatttatatggaactgcagcagacccagaatagccaaatatatcctaagcaaaaaagaatgaaactggaggaatcactttacctaactttaaattatactacacagctatagtaaccgaaacagcatggtactggcttaagcgcaaacacacagcccaatagaacagaatagagaacacagagataaatccatacatctacagggacctaatttttgacaaagtgccaagaacacactttggggaaaggagtccttcaataaatggtgctgggaaaattggatatccaaatgcagaataaaaccagacctctatcttgaaccgtatacagaaatcaaatcaaaatggattaaatacttaaatctaagacctcaaattatgaaactaccacaagaaaactttgggagaaacctccagaacattggtctaggcaagaaattcttgaaccataccacacaagcacaggcaaccaaagcaaaaatggacaaatggtaacacaccaagttaaaaatcttcttcacaacaaagcatacaacccacaaagtgaagagacaacccatggaatgggagaaaatatttccaaactacccatctgacaagggatcaataactagaatatataaagagctcaaacaactctataggaaaaaactaataatctgattaaaaatgggcaaaatatctgaatagacttttttttgaaagaagataaatgacaaacgggtatatgaaaagggtctcaatatcactgatcataacagaatagtaaatcaaaaccacagtgagatataatctcacttcaactcaaatggttttatttataaaacaagcaataacaaatgttggcgaggatatggagaaaagggaaccctcatacactgctggtaggaatgtaaactagtacaaccactatggaaaacaagttttgagattcctcaaaaaactgtaaacagagctaccatacaatccagcaatcccactgctgtgtatatacccaaaagaaagaaaatcagtacactgaagaaatatctgtactcccgtgttttattgcggcactgttcacaaaagtcaagatttggaagcaacctaaatgtccattaaaaaacgaatggataaagaaaatatggttttctagatatacaatcatgtcatctgcaaacagggacaatttgacttcctcttttcctgattgaacaccctttatttccttctcctgcctaattgccctggccagaacttccaacactatgttgaataggagtggtgagagagggcatccctgtcttgtgccagttttcaaagggaatgcttccggtttttgcccattcagtatgatattggctgtgggtttgtcatagatagctcttattattttgaaatacgtcccatcaatacctaatttattgagaatttttagcatgaagcgttgttgaattttgtcaaaggctttttctgcatctattgagataatcatgtggtttttgtctttggctctgtttagatgctggattacatttattgatttgcatatattgaaccagccttgcatcccaaggatgaagcccacttgatcatggtggataagctttttgatgtgctgctggattcgttttgcaagtattttattgaggattttttcatcaatgttcatcaaggataatggtctaaaattctcttttttggttgtgtctctgcccggctttggtatcagaatgatgctggcctcataaaatgagttagggaggattccctctttttctatggattggaatagtttcagaaggaatggtatcagttcctccttgtacctctgcagccaaaaaacacatgaaaaaatgctcatcatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactggttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccaccattctcagcaaactatctcaaggacaaaaaaccaaacactgcatgttctcactcataggtgggaattgaacaatgagagcacatggacacaggaaggggaacatcacacaccggggactgttgtggggtggggggaggggggagggatagcattgggagatatacctaatgctagatgacgagttagtgggtgcagcgcaccagcatggcacatgtatacatatgtgactaacctgcacaatgtgcacatgtaccctaaaacttaaagtataataataaaaaaaagaaaatatggtacctatacacaatacagtactattcagccataaaaagaatgacgtcctgtcatttgcaataacatggatggaattgtacgttattacgttaagtgaaataagccagtcacagaaagacaaacatcccatgttctcagttatttgtgggagctaaaaattaagataattgaactatggagatagagagtagaaggatccttactagaggctgggaagggtagtcaggggttggggaggaagtggggatggttaatgggtacaaaaattagaaataatgagcaagacctagtatttgctagaacaggatgaccataataaaaaagtaatttgagtctacattttaaaataaactaaaagagtacaactgaattttttatatcacaaaggatagatgcttaaggtgatagacaccccatttaccctgatttgattgctacgcattgcatgcctgtatcaaaatatctcatgtaacgtttatacatctactacgtgcctacaaacattgaaaatagaaataacgtattttcaagtaattatggttacttttcaaaatagataaatgagtaaatcaaactctagggaacattttggaatgctgcctagaaataattgggagattgtacttctaggttaattttcacttaataaagggctaattattaaagtggagaaagcagatctgagttaaaatatcagcttcagtaaaaatgctttagcattaaaattcattaaatggaatagaatgtaaacaatgggaacattatgatattactatgtaagatcttgcggacatcagtaggccatcaataaatatctaccatttaagttaattccaggttatttaacaacattcatcacatttcaccctttgctatgcatcaaaataatggagtgaaaaagttgatggtaaccttaaattatctttttaaatatataatagtaattgatatattctctattcaatagggttttaaaaacaactttgaggtacaatttacataccataaaattttcattttaaacatatagtcaatgaacaataggaaatttatagagtcatgtatatatcaccacaatccaactttaggacattttttattaacccctaaacctgtgtgtccattttcattcacatcctgttctcaacccatgcctcaaccattcatctagtgttttcaaatattcccttttaaacacaacttttatacttcattaggctgctgtaattaccaaataacgtgaatgctttcaaaatattagatattcacatggtataatccttaaaaactaggtaatacataaagaggctaaaatatatattttccatcagtctttccttttcatgtgaagagttccattttatactattcaaagtattttggaaaggttttcagagcttcaaagttgggcaatcataaggcattatgacaagaagtctttatgatactattaagttccattggaaaaatggttcttcactattatggtaaacgtaagtggccagcaatttctaaattttatctttctttggtgctatctaatgagtggcaagatggcaaggaccacgttaggcttattcacattttaaattttacactgcctatcacatttgtctgacacatacttagtgactaaacctcagtggaattcaataaatttgccagctatttgttagaaatctgctgggtggcccacggtcttacagctgaactttagtggttagagaatgggaatagacggggaaaatttttaaaaagcaaataaaagatttaacaatcacgataaacgctgaaagaaaaataaaacatagtatgttatgctaagtgttatctggctgtgcattttagatcgataaattttctgtgtgctatctttgaagtaaatattcatttgcataagacaaaattgggaaataataggataaatttggatcacttcaaaatattcagagtgttgcaatagtgttcactgtggctgtagcgtgaagttattagactggtgcaaaagtaattgcagtttttgccattaattttaataatttcatccttatatgtagaatttgtagatagatttttacaaaagcatactatagtttaattgcagtcttaaaatgtacacatcaaaataatatgaaagaaatctatatctttatcatatagccagtgaggacataataatgtacaggttgtccaagtacagtcagtgacgtgtggcaagtttctagtattttacatttcctacaacttgtgtttatgactgtttcccacactattaaacatatgaaactaacaagttattcttaaatggagagtaataagttctgtatagcaacacataggggtggcctttcaatgttagaacagattcaaaattaaatgcactaggtttaccatctactgggctgtgtaaaaagaaaataaaaagtctacatctatggctagataggttttaatatttgaacccaaatctctgggttagttctccatttttttcttctttgactaaattatccaattaccacataaattcccctttgcaggtttctgctgtctaactcataaatcaataaagcagactgtaaagttacactgttccaagtcgtttggcaatcaaatatgcctatttacactataagagtctgttttattccttaatgaaatcaaaagctcaatctgatagaccaaaatctgcagttatatctttatttttaagccattgattttgatagcttggaatgttaacatttaaagatgaccgattatatttaatgtgagttataagatttagcttctttgataaacacgggaagattgcaattacgaattcttcttaaagtgcatttaacgtaattagtttaaattaatagctttctttgctttaaaaatcccctcttttctaaattgtactcacattgttaatgggagggaaaaagagaaggaggaagtctggtctgtagtggactctggaacacctgacgtcctagcttggtgagcaaaccacggcagtatttttcaatatttaattatgaggcactcttctttgaaggtaatttgtttccttcctctattcctgctcataaatctactatgtgggacacgaggttacaaaaaaatgagatcagaattctttgggaaaaaacaaatagaacagtaaagctactggagccactgctaagcaactccgctcttgcttgcagtaatttaagcaacagggccatgttttcccctacaaaatgtgcatcaacacataaggacatggtgactttcaacaggtgcccatgttgggttgttcttacatatcaaagattcaaaactaaaattagtagaaaaggaaaaaaatcatgtatgtgaaagtatctttgtaattttaaaaattgcaagacatttaagtagctatttaaacatagttgtcactgtcccctaaaatgattaagagccatatgcaagttaattgacatgttaacaaatggggttagaaaaaaatgaattgaagaaagccaagcagagttcagcctcaaacatctatattgaacattctttttgtctaaattaaaatttgtgcgatagctctcagctatattttcttccatcacccattttccattagaggaaaaaatcaaaataggagagaatctcaccagtagtttgattgccactctgactccctcccattgaaacgttgacacagtcatagaagagaatctttatagaagagtgatagaaaatgtcgtatgaaaaatactctggaacaatttagtcattactagtagggaaccatccaaagccattctccaattagctacacattagaatgaataaaaaagtttccaaaaattctgaagaccaaatccacctaaagatttgatttgattgctccggggctcagcatggttacttagactgttgctataggattttaggtgccaaaactaaactctgtgcttcaatatatagttctgaaaaattgaacagtaaatgactaaatttgttccatgtgtttctttgcagtcacacaatttcgtgatttaattttttatttatttccaaggaacacgcataggttgttacatttttaatcatagtactttggaaataatcctagtttctgttttctaagatatatttccatatctagaagagttttccccatttgctttattctgtttcaataaatcttttcttaattttgtactttaataaaatctctcattaaatgagctgacactgggtagattgatgctgtggccatataatttaatttaagactgtggtaccagtaccatgctgttttggttactgtagccttgtagtatactttgaagtcaggtagcatgatgactccagctttattcttttggcttaggattgacttggcgatgcaggctcctttatggttccatatgaactttaaagtagttttttccaattctctgaagaaaggcattggtagcttgatggggatggcattgaatctataaattaccttgggcagtatggccattttcacgatattgacacttcctacccatgagcatggaatgttcttccatttgtttgtatcctcttttatttcattgagcagtggtttgtagttctccttgaagaggtccttcacatcccttgtaagttggattcctaggtattttattctctttgaagcaattgcgaatgggagttcactcatgatttggctctctgtttgtctgttattggtgtataagaatgcttgtgatttttgcacattgattttgcatgctgagactttgctgaagttgcttatcagcttaaggagattttgggctgagacaatggggttttctagatatacaatcatgtcatctgcaaacaggaacaatttgacttcctcttttcctgattgaataccctttatttccttctcctgcctaattgccctggccagaacttccaacagtatgttgaataggagcagtgagagagggcacccctgtcttgtgccagttttcaaagggaatgcttccagtttttgcccattcagtatgatattggctgtgggttcatcatagatagctcttattattttgagatttgtcccatcaatacctaatttattgagaatttttagcatgaggggtagttgaatattgtcaaaggccttttctggatctattgagataatcatgtggtatttgtgattggttctgtttatatgctggattacgtttattgatttgcatatattgaaccagccttgcatcccagggatgaagcccacttggtcatggtgcataagctttttgatgtgctgctggattcggtttgccagtattttattgaggatttttgcatcgatgttcatcagggatattggtctaaaattctctttttctgtatattacaaggctacagtaaccaaaacagcatggtactggtaccaaaacagagatatagatcaatggaacagaacaaagccctcataaataatgccacatatctacaactatctgatctttgacaaacctcacaaaaacaagaaatggggaaacgattccctatttaataaatggtgctgggaaaactggctagccatatgtagaaagctgaaactggatcccttccttacaccttatacaaaaattaactcaagatggattaaagacttacatgttagacttaaaaccataaaaaccctagaagaaaacctaggcattaccattcaggacataggcacgggcaaggacttcatgacgaaaacaacaaaagcaatggcaacaaaagccaaaattgacaaatgggatctaattaaactaaagagcttctgcacagcaaaagaaactaccatcagagtgaacaggcaacctacagaatgggagaagattttcgcaacctactcctctgacaaagggctaatatccagaatctacaatgaactcaaacaaatgtacaagaaaaaagcaaacaaccccatcaacaagtgggtgaaggatatgaacagacacttctcaaaagaagacatttatgcagccaaaagacacataaaaaaatgctcatcatcactggccatcagagaaatgcaaatcaaaacaacgagataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccgttactgggtatatacccaaaggattataaatcatgctgctataaagacacatgcacacgtatgtttattgcggcactattctcaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggaatgttgtggggtggggggaggggggagggatagcattaggagatatacctaatgttaaatgacgagttaatgggtgtagcacaccaacatggcacatgtatacatatgcaactaacctgcacgttgtgcacatgtaccctaaaacttaaagtattaaaaaaaaagactgtgaattggctaagtgttatcttttgaaataaaatactcctaggtcaacacatgctgttacatcctggcagcatgcagctttattttctaaaagtgtaagctttgcttctgtaggtaagctcatgtcactaaaataagtaacataattttaaatccaattcagaatctgagggcccagagaaataactgatcaattaacacactaaggaagtgagcagctcttttctttcctatagtaataaatgccaatgtgaatgtaaagaagcatcctgatctacatctacttttatatataacaagagtatggttgtcagaaagttgtacatacagtatgcatttccttagtgccatagcttttatatctgaggatctcaaacgatcttaaaatgcagaaaaaataatgctctaaaagattcaaattaactagcaaaactctcagtgcaccacacggtggagtcagacacccacaaatctgcgtgaccagtatatgacagaaaatctgagcaggtatttcaaagaggacttaatatggtaacttcatacattttttcctgcttctccgtgatgaattaagctaaatataccatttatgagaaaagaaattatagtgcactaatattttaattagcaataacctttttatctttaagtgcaaatttatagaaacacatttttgttaatacaatgcattgaagttagtccctattctattcctttcttttctttctttcatctatctatctatctatctatctatctatctatctatctatctatccatccatcaatccatacatccatccatctatccaccccatctctatatttaaaatgtcattttggtggcattcttagtggatccttcatcttacacactgtgcttatgttatttcactatctaacttttgactctctattttatttcatgggaatttcgagctgcttttcaggaaatataatccttgaagcaaatctgagtacctgagaactctgttctagaaaacaattcacttactgccatattaaaataaaaccctggagcagaagaatgttttaagagctttcagatggcttgtattctccaatattatgtattaccattggggagactcaatgtcaagaactatgttgataatgcaggtgtgacctgaaatgcatggaaaatagatttgatctgaatgcccaaaatctctttcttgaagtagatctgaaatttcataatttatctgtgttctgctgtttactagtacttttctactgatgtagttaataacatttttattgtagtatttttttagaaaaaccaagcaaaatattttgctattaaaaacaagtaatgtttataaaatcctgaatccatttctaaataagaaaaaacacacagtgccccttatcacaacctgttcaactaaagatgcttcgccctaaaagctccaattttccttgaaagacaatagtataatagctttgcctatcaaatttgctactcataatttcattccgcaagtctgtcacaaagtaattctttatgcattttgaagtacaaacttgcaatattaatgtctagtattcatactgctcaaatttttccttaattccattcagaacgtcacaagcatttttaatcaaacattccttcaaaactcatgtcattagtttaaatgaaagcagttctactctgtatttcatttatagtcatgtagttcttctcaattcagaaacaattactcattcctatcatgcattttactaaaccctgccgtggtagacacactaaataccctgacttgatcattacactttctatacatgtaagaaaatattacataaatgttgtatccataaatatgtataaatattttatatcaaaaaacctttttcattatgactcaaactgggacggacttaggaatagttaattctagagaacctggcttgtgtaagtttgaaaaatatatatactggagtaggtttgtataaacctatcacacttaccctctaaaatatgtacaatcattatatatcaagacaaattaaaaattgaatcctcaagtatgtttactattatccctcacttctactacaatatttactcttgttgcccagtggaaaactatgatgaggattttatcatcaggattctccccaaaattctctttcttcatccactattgcaattgtatgcactccataaggaaataatattccctggactttttaagcctatcaaaactacctatactctgccacatattatcagggacattcttggtcaaagttagacaatatggtaaattaactcatgctattgtgtatactgttgcccagaacacctattaacggtgattcattaactgtaattgcattgtaaccatgatctacaaatctaatatatcacccccaaattcattttaaagtgaaaaacttcagacatcttcaccaactggcagggagaaggctttgagatttgcagctaaccttctagtgctcctctcatcatagcatggacttggtgattgggttcacaacatgtatataagatttgaaaagcagatctagtaattgcgatcacacaaccctaaagacttttgaataaataatacctatgataacttcacatatgtttaaatgttaattaaaaaatgagaacagcattttaaaaatacttcttacagtgaatgtaaatttagttatggcctaaaatttactcatttaaaagtcaactcagatttattttcaacactattttaattctcattctagaaaaacaggtaaacacgttttatattttcgtttgaatgaagcatgggagtgagtgcatgtagctatattgagcatgatcattaataattgaggtgtaaatttatatcgataattttgtgttactcactgcttgtaactaacacatttttataaaacaatatagaccatgtgactaaacgaggagtttataataaaatgtttgagactgctttccaacaatgccatagaaaatattttctttttttctttttataagatagagtctcgctctgttccaggctggagtacagtggtgcaatctcggctcactgcaacctccgcctcccgtgttcaagtgattctcctgcctcagcctcccgagtagctgggattacaggcgcgtgccaacaaacctggctaatttttgtatttttagtagagacagggtttcaccatgttggccaggctggtcttgaactcctgacattgtgattcgtgggcctcagcatcccaaagggctgggattacaggtgtgagccaccacacccggccaaaaaacattttctttaccatttactatcctatggttttactctagcttttagtatagtttgaagtcagaaacaccagaacgtattgctcctgtctttgaaatgtctttatttcaaattcctccattacatccttaaaaaaataaatcttagactaatgatctagacccccttttcttcctacctacctccaaatagtcaaatcagtgaatcaaaacaaccccatggaaaactagttgaataaatttaaagttagaaacactgcaacattttgttgaagtaataaaaacaaaagaatggaagctgattcccagatgtacttgcctgggcttcctgaggcatttgagctgcgtccaccttgtctgcaatataagctgccaactgcttgtcaatgaatgtgagggactcctggattaagtgtaaggatttttcagtctcctgggcagactggatgctctgttcaagcaacttttgcctccttacagcctaaaaagaaggaataagagtgtatcagttaaatgtttactcttgatagcttttctgtaatcctgctgaacaataaatgaagattctagactcttccacaatcacctttttgtaagacagatttcgcagcttcctggcactcattcagctctgttgatagaaaaaaaatgtgaaggagaaaaataaatagcaaacaaaactataggatcagggatctctgcatgaaaatcaatcacaatatcacgtacattaaggaaataggctggaaaaaaaattagcaaaatcatctcagtcattgcaatctgtctttctcaggtcgaatgttcctcctgatctcattatatagttcaagagatttggtttgcttagaatagggtcatcgtcatcacaatccaattcaagacagataatctgcttccaccagtgagatacatgtacaatctgttcagaatcagctccttgtcaaaaacagaattttagataacagtctggttaaagatttattttgaatactatttcaaccagctttgcatgatcttttttctccctactttctttcacaatttggattacagaaattgtttgtacaattgggtttatgttactgctgaagtagaaaaaataataagtaatcctaatatagctgcaattaatcttgattgtaactataagtatgattaggataattcaataatgttcaagtataaataccatgctgcacagattggaaagtctcccttcaaggatctgttcacttttaacagagtagttgtaaaagtaagaaatagggcaggcaacttattgggaattcattatgtgtcatttaaaatacatttccttaatatacaatgtaaaggcatgattatcaggtacaatataactttctttcccacagagcatgactgaggttttaagatgatcttggtttttatattatatatagaatattagatattacataaatactatactttttaagctttaaaaatattagtgatgtcattattcttcagtgaagccagcctataacacagctttgcccaagtaaaactacagttaaaggcatctagactaaggcaaaagaacaggaagtttagtgatgctgcaggaagagggaaggctttcccagtacttctccctgtaccataaattttgactccattaagattttatcctgggctttcctttcttctcattctacccataccttaacttcaattcctcctcacattctgacaactctcaactctacatctctcaagtccagatctccccttgatctccatacttgcatgttatctcaccctattggacatctcctcatgaatattctgcaaccaccaaaagctaacactcccacacatgaactccttgcatatactcttctcacctacttctcaactccccaacttgcttttcctccttctctgtattttttccggtttcagcgaaaaacaaataatgattccctttattagatgtaattctagatatttctacttcctctatcatgtccttcatcatgttgcatctaatcagtcaatcactaattatttattataccttctaaatagttcttgattccaatcttttctctctctctccattgtctttactctagttaaaatcattactatatcttacctcaaatatgctatcagtttcttcactggcattttactctgccacatcccacctgtaaagcagctgcaatgtgttctctcaataacgaattggggcttcctgtctaaaattctctagtgattctttactgtccttcaaataaaagctctattcttttttttttttttttttttttgagatggaggcggagtctctctctgtcacccagactggagtgcagtggcacaatctctgctcactgcaacctctgcctccctggttcaagtgattctcctgcctcagcctctcaagtagctgggattacaggtacctgccaccatgcctggcgaatttttgtatttttagtagagacagggtttcaccaatttgcccaggctggtctcaaactcctgacctaagatgatccacccacctcggcctccctaagtgctgggattataggcgtgagacattgcgcgcagccaaaagctttatccttaatgtggcttaaaagtcccttcataatataagtcctgctggtgtcttttactccctgctctagctatacagaaattttattttttatttcccaacctacactgtggccctcttgattcttggccttaaacatgttgttcccttttactggcataatctcaattctgacttccttttattggctaatttacatttatcttcttaatgtagtggacatctcttccaagtggctacctctggcaccttctaagttcagggaggtaattcttgcatgttctttgaattttgtatttttttgatttgacaagtaaaaattctatcaagttagagcacgtaacatgatgttttaatatatgaatatgttacgggatggctaaattaagctatttatgcattccctcacatgacattatgttctttcttgcactttgtatgtgccataacatatttaatctcccattaatggtctgcatttactttagactatcaactctaatgagttcaaggattacggctgtcctgttcattgctcaataccagttcctagaatgaagcccaatagctttatttatgactgggtgaaaagtataaggagaaattttaatgagaaaaacagaaaactttaaatagtcaaagacgaaaatggatttacagaagaaattgtaaacaaaggtcaccactgctcagagatgtatcttttggacaataaatctatctgtttttgtattaaaagtgtcagaatgggggtgggacattatttggagaaaattttaatctctttctattaaaattctgtatccaagattggtgaccgaggctttgccctatattccaattcaaacatagcttccttttgttctcagtcaaaatttcaactaaaatttacatcaggtaatttactatttcagataacagtgttcagggctataatcagagcctctattgcagaggagactggctgcagcctacccacagctcttccaaagaaatggatctctagtgataaaatttcagcattgtgacaggtggttggagaaaacttccaatcacagcgtgtaataattgcctagccaggtattaaatttggtccttcctctggctaaaggcaaaaacagtgtactctacaaggcacatctgtagattttaattgtataggatgtaatatagaataacattaaaccacatatctagcctcaaaattctttttagaaacctaactttttctattcatgagattctatgagctgaaaggaacagtgtggcttaagaaatgatggcagagttgacttcgggtgggttggctcttttcctggcctgacagtcaataagagaggctgatttacacagattccttgattatctcagtcattgaaaagacctcatgtcaatgcaagcttgcagaattctttcaactagtcatggcataagctgccttctatttctaaacatctgattaggcgcaccctgatggaatgtcaggcttatgaattttctgactttctgcccgcttgacctgtgctgtctcattgaatgaagtttgtagaaagtcttcaaccataatctgattttttgttgttgttccagaatactgttccgctgttgttttaaaatgttatttcatgtctttagctaatccacttagcagtaagaggaattatatagctagacagaaacagcaaatataaggaaagttagaaagacatcttttaataactggcgatcaatgacaaaaatataaaaatagaaaacaatcctagtaatggttaccaagaaaaacacataatatattttaacccagttttcaatgaaaattaaaactaagtaaaagttaacacaaattaattattttatatctttaaagtactatggaaatataaaataagtttaagaaaaagttttaagagtttaatgagttttgctggcaatgtaaagtcatctctacaatgaattgacagtttctcacatttccattttaaaaataatgtactaacctttgtaccacaatattacaaacacataaatcaaagtgtagcatgtctaagaaactctggaagagaaaactctgcatgtgaaataaaaaaccgaatattgaaaccaaaaaatgtatttaacatatgaatgcatgctttaaaaagccaaattagaaaaaaaatcatttaataatattttacaaaaaacacattcattaaaggagctaggtatcctatactatacttattaaactcaatacaaaaagcaattttactgcatttatgaggtgatgggtaagcttatgcttgcaaatggattaagaatgtgggtgcactgtttacaatcatctcgtaataagacacttttatttttggtgtttaaatactcatcattgtattcatcattgtgatgtagacatgtaaaacatttcaatttccagcagttttaaatattttcttctgagtaaagaaggatttttgccaatgtcaaaataaagccctcatttttatgagtgattttagtagtaaatgaactaacgaaaactaaatcccaaattccaattcaaataaagcaaagcaacgacaaagtcttgaagtttctgcttagggtagtgcattaattggccccaacctgactgtccgtaccttgcagaaagtagagcaatatggaatatgttttattttatagaaagtgtcttgggataggagtcctgcaagagatgtgctaaaaccaaatcctactcaacctgcccttcagaaactacagtggagacccatgagaggacattaatctccatttgacaaccacgcttcacttcacagagtttaccagtcaagttttctttcccagagtctcaacttcagtggaccaagcaacacttgcttcagtggatcaagcaatagttcagtggtccaactatttccttttagtgtttcttttttacctactaacaggttgcaatttgttcaagtgccaagtactaagaatactggtgggtgtatatcatttttgataaactatttcctcctgacctaactcttctatttaacttaagagcaagtgtgaaactgtcactatggatatgaatgcattgaattctatctgttgtcttagaattttgggtatagtcttaaactgaaaataacaagtaataagtctctctcattctaagagatggaaatagcagggcatagcaaagggcttacaaaagagctgggaaaactggccctgcctttgttgctccaccatacccacttatactaaaactctctgaaggttttagaaagaatcggtcttctgaattcatggcccagagggagagtagggatggctccctctgtttattccgtaagggggaaaagaagatggtacttcaacctttttgtcccatgcaagtaagtggagctccaagaccactgatcacagggtctgggagtccagagtagatagggatgacacctaattaccaactctgcttctgaagatgtctgcttcagaaattatatgcctacttgataggtaaaaaatgaatgagaaatgatacagtgaagaaggggggcagcctgtactccccagtgcttggtgtggcaaacgtttctcaataggtcaagtgaacgtggaagaagacagccatgtttgagctatctaccaggaacactctttatggagcaagagtacctcaggatcaagaggcttgaagatgtttttatagagcatattttccttcttaaagatggggaaaacaaaagagcttctgcaagacttcttaaagatcccatacttgtaccccaaataaacccgaactttgtatctctgttacacacacacacacacacacacaaatcataaactcaaagctacaaatagctagttaacaggagacatttgcctattttccttaactcctacttcccaagacattggagaataatataactgaagtgcagttaaaaaaaaaaaaaagaaaaagaggcagtggaggtgtaagatggaatctaaccacacttgccttccagagaaagtcttttagaccatggcttaagcttgagctggaaacaaggaagcatattaaattaaatatgacattgagattttaagctgaacccaattagatttaagtctttattacctcagaggccagaaagcaaagggatctattcatggcgccatctacctggatgatgtaaaagcatttcatgtttctgatctatctggctgaaactacgcatcaaactactaacacagtccacgaattcagcacttactcaaataaagcaaaggcaaaggagaatgatagacatccagatcatctagaatgtggtccagcagaagacagaaaatggtttacgggaggtctgaagagataaagaacttaagaaatatctgtgaaaaatggagcattatagtagtatcacatgattgaaaagctaagatagatatgttgatgcttttgtctcatgcaactgcaagttgcatgttttatatccgtctaccaacatacatgaatataaataatccacgtgaaaactattgctcctgtcaaatgcaacaacttgcctactgattggtaactttgctgaacaaccaatttaaattcctgaagcataattctaaggtctttaaagaagcatgccataaaagtatcaggaattatttaaggaccactaagaatgttctatttgtctcagaaattggttcttacaatttttagttgtttagaaccggcaagatgacagccttaaagaagttgacacttcaggagatcgaaaccatcctggctgacacggtgaaaccctgtttctactaaaaatacaaaaaattagcctggcatggtggcaggcgcctgtagtcccagctacgcaggaggctgaggcaggagaatggtgtgaacccgggaggtagagctggcagtgagctgagatcgtgccattgcactacagtctgggtgacagagtgagactctgtctcaaaaaaaaaaaaaaaaaaaaaaaaaagaagctgacacttgaagcacacattgtattgtacacttgaaaaatctttgagattgattagataggaacactttattttccataatttcatatggtgttaagtaatagatcctttaaaagttatacaaaaatttccagatgtctagatatgcttataccagcttaatgaaatgttttccaaaaagaatagagttaggattttgaaaagggaattaaatggagattaagagaaaagcagagggagaagaggataatttacaacagaagaaataatttaccaatgctcatagctcatcacaagattcactttgttgctttctttgttttcaaattagttcatcctattttttcctaaagaaaggaggtctcacactgtgttccttggacaagaaagactaagtaaattaaaaccatgttgctttaacccactttaaatataactcttgtgaggggctttggtacagtggtttttcctgtggcatatttgttaatgtatttaatagggatataggcggtaaataattacaaagatgtgtacatgtctgcatatatatcctttaaatataaaataaagaaggttacattattcacgaaaggcttctagatttatgttttgttaatgtcactaggtttgaacacacctgggagaaaactcaaaagccgtgagcatggagctcctataattttctttaccaggaaagaatataaatgtgaaaactcttggtgtcatggttaataggaacttcacctgttttaggttttagcaggttactgaagttcttctgtgacctctgaaggaagcatacttgaaagtaacgtttgggaatcattttatcaatggaacttgacatcagatagccatcactttcaagtaaagcattgagcattgatagaatggtcaatgagctatagagtaatatatctaagacatttctggattcttgctgcatccatttatcctcatgggtagacaagtgaaattggtcttctgccctgacaggagcaaactgatgctttatttaagcttcaaaaagaaagtgaatgaagcattattcagtaaacataaaataagtctacaggattcatcatatccaagctttctcaaggtaccttcaggagccaccctaagtcagtgaaatttttccggcccaatggcgaggtactctttgactgcacatgtgttcatattattaaagtctaaactttaggcagtgaataatttattgatacaggaaataattaaaatatttaagtcgctgtctcctgatatggaatagtgagacagaatcagattctagggatgacttggtcagcattgagaccacatgttcaagcaaaatataaagtttatacatgagacaaaagtccaaatctggggataaaatcaagttggaaaagatgagaagtcaaaattagaaaaaatgtagctggtgcttctaagccaagtggtataggttaattagccaaatacagaagtacccaagtgagagagagcatactgaggccaattacagataggttggtggttgtgagcaaactagtccttacaatgtagatgaactagccagttgatagtcctcttaaataaggtcagtgatatccagtcagtacagtagtgtgacaaagatctcagagtgaaagaactttggaactcgttagtccctctacttaggaattcagactctcaggaaagaaactcaacacagcatctctggctttctggacttaatatgatgtatgggaagcaaattcatcacacttccttttatagaccaggtaaggatggccacacaggttgcctatgaataaaatagtttccaatcttcagtcaagcagtgtgaaatacagccttgataactagaaatggtgcttttctgatgtgcattagagatctctgctggattccttctactgtgatgtaggctcataatactctaaggccagtgttcaggttctcttggactacagtgccatggattttgccggcctctgtggtcaactgtaattcatattggttcgaacttgaaattgtatctgagcaactggaaaaatgctcctctctcctgggatgtctgggacgactggtcctttttcatcctacccaattacatgaagattaacaatatttatttatcacaaatactccagatgattgtcatggctctggagaagttgatgtgcaaggcacagtatgcttatggcttcctgtcatcttacttatccacactacattgaaaaagtcctcaggtctagctcagtcagtatctacattattgtgtcctaaggttattacaaggttttctaatattttgtcctccaagttgttaggatagacaagactgcagttttgtagaaaagaactcctaccaggatctttggctctgatatgattcatttggatgggatgtgcaccttgaacagcaggaacatggtgtatggaacagctgcttttccttctgctttcgaaacattctgtatagtgctttaggagtaggttgggagtgcagaaagatgactcgtgtgtttatatgagcatagggaacagataaacactggcagaatgatgcattacaatcgattccttgttacagactagggtcatctgccacaaaatgttcttacaatacattaagcttgctgaaatagaaataaactggttccaaacttcctctcttctctatgtcctcaccccacaatggcatcttctcatcgtctatagatgaaacccatcgtgctggaattatttggcatgggagaagaataaacaggtttccggtgtgacgctttaacttgtaggattgttaaacttgtcatacctcagatatagctgaagattaagatgtggacaatgcctacagccatgcaggactgcttagcatcttccccacaggaagtatctgttccgtcaacattgtggttcgggtgagggagagaggtaatatataatgaggatcctagtgatgccctttccgtgtcatcaaaaatctgctgcagtttcctagaaagcgttcattctacttcagcagggaactatggctgtgaaggaaaaccactttttcctctgcttggtttagttgttgaggaattggaaaggagcttcatttctggaatacagagatcatctatctgtcatgagcagtggttgggcaagaataaattactggtccacagtgggaatgaacctgacacataatgcaccttagcaaagtgcaccttatacatgtgctgataaaggtctatctagactggggttcacaaacctgaataatcatcagaatgaacttttccaaatacagttctcagcctcaattaaaatctactaaattagaaaatcagagggagtcaaaagtgggtatgtgtacaccaaagtccctatattcttctatctgtgtaattttggtgatgagctgaaattgagaaggtctatgaagaccgaagttagaaagaaaagatgtcttaaataacaacaacgaaaaataacaggtaagaaaatgcaatcagttgggcttacagcaaaaaagagcgaacagtagagtgctatgaaattggtattaatgctggtcagaatatacgaaacatagtgaggtagaaacagtaaggaaattctccaattttctttgatactttcaatgaaaaattactaataaatatatgcattttatgatttaaaagacagcatgatgaacttgaaaaatatttttattcctcattccatctagggacactggaatacactgcaaagaaatgttgtttaacattcccttttccatttatcattttttttaaaaaaataaacattttcagaaatttggcctgaatattaaataacagatttgattattcaatctcaagaatctatgaagtagcttgcaaagaaaacggttttaaaaagttgagagtggtaaaacgtaagatgaaagagagagatgaatatgtaccctcagaacagtattgtgtgttatagaaattaagtattagttgtcaatcatcatagataattaaagttattgacaagtttcattaacataaagatataaactcgaggaatttttctgaaaaggtacattgataaacttaaaagagaaacttcaatccaaaaatttatcactaaaatgctactttatcaatccatactactgatttagcttttacaactgattagtttttcggccttaatggttttcctttatgtattaactccctcttttgttattccaactttattattctttttttttttttttggtaggcccttgtagaaaagctattccaacttcagaagaaataactcaactatcaaattatgagatatttgaagacaagataccattaaatggatatgttaacactcattcacaaagatattaatgccctccaagagcaaacataatttgtctagagtgaatattaaatacttaaatattaatcatatattgaaatgcagtacatgattatatgtatacatatgtgcttatatacatgtatatataaatacatgcaagtatatatatgtgtttgtgtgtccctttgtgtctggaccccaaaaatgctaatattctataataggcatacagacgaacaaaaacatttaactactgttttatataatatttcggaaaagtaaatatgactgtccaaggaaacattattgattgaagtagggtaaattatatctaaaaataatggaattactacttacaaagaaaaaatccatgattcatggtgattaaaataagaattaaacacattcaccacagacccttttgtgaaggctatgtactctttcagttcctgtagctataaaatagagggtaactacatttaaaatacaagatgtattttaaaatattattaaaaacaagaatcaaggtaactcacacaattgatggtaggacaagaaaaatccctttctcaaataacaaaagaagatacatgaaatagagaaggaaaaatttctaatttacaaagaaaatagcatacacattcatgtctatttttcttacattaaagaggtctgggctattgagtttattatctatgtgtaaatattacacaagtgggtttcttcccctcaaaatgtaatcactcttgaccatttattcaattaatattattatgagaacaagttgcatagtccaccactcagctgaaaattgcagtcaccttgaacacagaggtctgccataatagtctgcttgcagtgcaatttttatataaagacaaaggttttttgcagagcattcaacctaggagaagtcaagattcaagatatccaatatcctttttactacttaaggaaagaaagccctgaattcaaagtatggaaagatgtaaacctagaagctatatccattattaacacactaagaataagattaaatttcacctttctaaatattaaagcatttattgttaattaattatcctcaatgaaatattttcaagtaatgataatctataaaagtgagcctaaattgttaactcccaaaccttatcaaaagcatttcaggtgtacaaataaccaaatgtataagatgacacccgaaattggcttcaaagccatgcaacctgtgcagttatgcagtaactcatgcttaggagagcccatgcttggtttaatgctctgctgttgccatcttacaatgcttaatttttgagtatgggacccagtattttctttcttccctgagtcccccaaattatggagccgatcctgacattttgggaaaaacagccaacagctaaaagactgacataaaaatctgaattaaattggttaagttagagagattgtaaaaaaaaaaaaaaaaatacatgaaattcacatttgacatactggcggtaaccagatgaatgacttgcaaatatgaatatagttggaagaagatacttcagactagaatcctagttgtttcagaatataatcaaatacaacctggagatgctaatcaaagataacgcaaagaaaaatcccttcgcttttgattttctatgcggctgtatgtgtgtggttctaaataaaattattttgcagaaaattacgggagaaagtcagataactgattatttccattgcgaataacttcattggctactactgagtccacgatattattctctaacacttctcctgattttaaacgaatctttaaaacaaaagagctcctattccaaatacttttcactctcatttcctcaatgacaccagttctcctttctcccaaccccctttaccgtgcagagtcctaaacaacctgaaaacagagttacctacttctcagggataaatttatccttggtggataaactttctcaaacttactactctccacctcagaacctccttgtattatctcaattttctctttcccacttccaaagtcaatccttccattttttttgctcgtgtatcctatcttgtaagactttgctcttatatattatgtctttctattggatcttcccttatactacaaacatgcttaaatttttattatcctgaaaatcaacaacacatcttttctgccctattactattcaatttcagttactggcctttctttctcattttttcatcatcacagatttattgtctctatttgccctgctcattttctcttttaccaaatcttaatctcacagttgttcctcctcactttggaacacagagactatatttaatgagagaaggagcaaagaaatacagctagtggaggcatcatgttagctgacttcaaactatactacagtgctacagtaaccaaaacaacacagtactggtacaaaaacagtcacatagaccaatgaaacagaatggaaagcccagaaataatgccacacacctatacccttctgatcttcgacaaagccgacaaaagcaagcaatgaggaaaggactccctattccataaatggtgctgggataactggctaaccgtatacagaagaataaaaccttacaccatatacaaaaatcaactcaagatgaatgaaagacttaaaatgtcaaagcaaaactttaaaaaccctggaggataacctaggcaataccatcctggacataggaatgggaaaagatgtaatgatgatgtcaaaagcaattgcaacaaaagcaaacactgacaaatgagacctaattaaattacacaacttcctcacagagttcctctgttgaactctgtcaacagagtaaacagacaaactacagaacgggagaaatattttgcaaactgtgaatctgataaaggtttaacatccagaatctctaagtaacttaaacaaatttattttaaaaactctactccattaaaaatgggcaaaggacatgaacacacatttttcacaagacgacacacatgtggccaacaatatgaaaaaaaatgctcaatatcaccaaccattagagaagtgcacattaaaaccacgataagatgccatctcgcaccagtcaaaatggctattattaaaatgtcaaaaaataacagatgctgttgggatggcagagaaaacagaacatttatacactgctggtgggggtgtaaattagttgagcccttgtggaaagcagtttggcagagctaaaaacagaacacagcaaccccattaccgggtgtatagccaaaggaatacaaattgttctaccacaaagacacatgcacacatatgttcattgcaacactattcacaatagcaaagatacagaatcaacctaaatgccctccatggtagactagataaagaaaatgtggtgcatatacaccatggaacactacgcagccacaaaaagaaggagttcgtgtcctttgcaggaacatggagggagctggagaccattctacttagcaaactaatgcaggaacagacaactaaatatcacatgttctcacttataagtgggagctaaataatgagaatacatggacacaatgagggaacagacactgggtcctacttgaggatagagaatgggaggaaggggaggatcagaaaaaatacctatcaggtagtatgcttattacctgggtgatgaaataatctgtacaccaaccccccatgacacactgtttacctgtataacaaacctgcatatatacccagaacataaaagtaaaacaacagctagatctgttgagaccatctttcagatctgctaagagaaaggctggtaaagaaagacaagaatcaaagttcattttaaaagttttggtatgagaaatttcaggaatgagatggcattaacagaggtggagaaaacggtgttgggtagctttgataggagctgtcatctgagtatgttaagtttgagtagcctatgagatatccaaagagaaaaatacacaatagaaggctggatatatggtctgaagttaagggcaaaagtctgtgccagagataatattttgggaataattagcatgtaaattttatttaaagccatgacactgcataaagtattataaagagtgaatatagaaaggaaagggagaacattaagcttaaacactgtttcatacacacttggatccagttggccaataatttgtttcagaacttttccttattaatttatgactgaaattggcatggggttttccttcctgtttcatttttgtctgattttggtaaaaaaaaaaaaaaattttctaaccttatattttccagacatgtatattgccttgtatgttctactgagtttgttgatgactggaattatctattcctagaaagtgtgttcaaatttgaatgtaaaataatttcagtctaatatagtctttgtaggaagacttttaatttgtgattaaatttctgtctcctcaggctttctatatccccttccatcatttttgtagcaatattctcctagaaattcatccatttcatgtaagtttctaaacttatttgcatagcttttagtattttctgtattttaaaaatatattataactgtagttataacattttcatccttaagattttatatttgtttttacttccctctcagttgatttgtctaattaaaacatgaatatgggcatttaaattttattgattccatgttgtttttatttatttctgctcttgaattcttctctttccatttactttctctgcatttattatacttttccctattttcttgagatgggcagttagctcactagttttcagcccttccgtctcttctacaaaaattaacaggaaccaattagttttaatttttatttttattatcactcggttctatgaattttaaccatccattttgaattcatctttgatccacaaattatttactttagtcaagtttttactattgattctagcttgttacaaatttaagagtatttccctaataataccaaatatgtgaaatgtattgacatttccatgtacttcagatgaaatttacactctgatttggggttctctatacagtctttatatccaccttatcaactgttaatcatcactatcttcactaacttttgtctggtgtcttgaaagaaagaggcattatgaaatctcccaccatgctgatatagttgtgtatttcttcttgttattctgtggatttttgctttacgtgttttaaaggtattttcccaggtatgtacgagatttttttgtttcttttgacagagtctcactccgtaacccaggctggagtggagactgcaatctcagctcactgcaacctctgcctcccagattcaagcaattctcccacctcagcctcccaagcagctgggactacaggcgtgcaccaccacagctggttaatttttgtatttttagcagagacggggtttcaccatgctgcccagattggtctcgaactcctgacctcaggtgagccacccacctcggcctctcaaagtgctgggattagaggcgtgagccaccatgcccggccaggtatgtacaagttttagaactgttatattttactccattttttgcctaataatgataatgaccataatgtctattttgctggaaataaattaggtgtctaagctttttattgattaatccttttcggaaaatctgtttccattttcgatatatgtgtctttatgtatttcttaaaaacaatgtattttgaattttgatgctttattctgaaaatttctacatttatatattaaatgtattgagcaaatagttctaggactacagatgtattttttttttctttttcttttctttccttttttttttttttttttgaggcagagttttgctctttcacccagtctggagtgaaatggcatgatctcagctcactgcaacttccgttccctgggttcaagtgattctcctgtctcagcctcccgagtagttgggattataggcacccaccaccaagcctggatacttttttttgggttttttttttttttttttttttttgtatttgtggtagagaccaggtatcaccttgttggcagcctggtctgcctgccttggcctcccaaagtgctgggattaaggcatgagctaccacgcccggccgctggtatttttctaccatctatttttttctatttctatttttctaccatcttttcttttattttatgctcatctcacatttttctgttttgttttccttctttcttgctttactgcgtactgattgagaactgttccttttatcattctttgattgtttcccaggtggatgctccattagtggttatccttgacaatttattacagcataaagtcgacatttaatcactatctctaccctctttctaaataaaagggcttgtggctgtaactcccctccatattgtttttaatctagtattttagatcaacattattttaaatgaaattagatattcttatatattttttgcaacaaatgccttttgtatttaaaagcttaactattttttcatcatacttattgcatctaaaacctttaaaacttatttttctactacttctaattcttcatacttattttagacatttttatagtaagggtctattggggtaaaatttcacttttttttcactctgataatgtctaatttcctcttactctgaagaactaattttgttgagttcagaattctaggttgacggtaattttttcaatatcttgaaaatattttccattgcttttttattcttattcattgttgtagataagaagtctaatgacagcctaaatttaattgctttgtaggttatccatctcacctctagctgctaatataaatttgtctttggatttctgcactttcactgtgatatgtctgagattggatttctatttatttactttgcctgttatataatgtgctttctgtttaagtggtttatgtcactggctcttggaaactttcctttaatatccttcatatattactccatctccatttctcaaaaaaattatgacatacaagaaagctgtatataattaacatacacaagttgctgagtttggagataaatatacactgataaaaacattacctcaatctatgacataaacctattcatcatctccaaaactttcctcctattctaatattattattattctgtaacagaacacttaacataaggtctatcctcttagcaaagtttaagtaaatagactaactataggcaatatgctttacagtagatctctaggaattatctatattgtataacctaaacattgtacccttttacaaatatctctccatttttcccttcccctagcccctggcaggaagcattccacattctccttccattagtttgactgtattagattcataatatgattgggatcatgtattatttgtctttctatgtctggcttacttcatgtagcataatgtcctccaggtttatccatgttgttacagcgaaatggtaggatttgcttattttttaagggctgaataatatttcattgtatgtatatatcacattttctttttcctttcacctgtcaatggacatttaggttgtctctatatctttgctattgtaaataatgctgcaataaacaatagagtgcagataatctccttgtgattctcattcaatttcctttggatatatccctagaagtggaattgctggatcatatagtaattctatttttaattttttttttgaggaatctccatactgttttccatagtgtcagcatgaattaacattcctgccatcagggtacaaggggcccttttctccacattcttgccaaacttgtcatctcttgattttctttttaagtaactgccattctaacagatgtgaagacatatatcattgtggttttgatttacatagccctgatgattaatgagtttgagcaccttttcatatatatgttggccatatgtaggtcttcattgaagaaatgccttttgagctcaactgctcatttttaaattgggttatataatttttttatattgaataataataatctccattttctttattctcctctttgaaaactcccattgagataagttatatgttcatattctactccccacccctgtatctattacctattgttcacatcttccacctccttagtttttggtaacacagtctgtacattctcttttagttttcttttaaatcatttctttcaactaatatgtttatatatgatatattcattttctaatttttaattgtagttgtttaattttgatttctttattccatttttacaatgttttcttttttataacttcaataacatttatttctataatattttacctatttattttatactatacatcttgcaattctaatatccggaattctagaagtaaactcaccgttcgttgtataggctgactgtgcttcatgagggcttttcttgtgcgtgtgagtgagtgtgtgtatgtctatgtgtttatgatgagctcaagttcccctgagtttaatctgtgaggacactgagggcacttttcatggtaaacaatttgcatttgcttctaactaatgctaggacgctcctaacctggtgctaccctgacttaatcacttgtttggatatttctttaccctttgtgataatatacactcaagagttcctcaccttacaagaataggccaacacacattttcaggtgacattattataattattctattactttgcactcacagtgagaagacagatgtctttttatgtttgttctctctgcagatagaattctctctgcccattatcttactgatagaaccccagttttatgtggaatctgtgtttagctccaccattttcgtgagccagaggatcatatttcttttccatcaaatgacttaattcacctaaaattggggttcccagtcttagcttttatctccaccatacaaatgtcagtggtcataggcatgttacggcatgacttcagtttcatctgatttttttcctagcctttaaaggtttacttatacttctttgaaagcaacataaaatacaactactagacattttccagcatcctagtgctttccagagggcattacagaagacttagctgtcctagcccttgagaacagaagtcagccctatcacaacaactgtgaagtaagctaatcaaatctatttcataaagcaaatgtgggatttaagtttgatgttgcttctaacggcttagcaaaaggactgacgtaaaactgtgctcaaaaagtaatggcttttactattattatagacagatattgtctacaaaacatattgacaaattaataaagcataatatgccacttattttcctagattactttatagtcttccttcaagcaatgttcttccgttctggtctatctatgctaaggtagatgtgacactgagggaaaaattcaaagtcataattaccaggaaaaattaatacggccctctctgagtctatcataaatgttactattacagaagaattaaccaatttagattttgtccctttcagtaaatttgctatttcatgtcaggcataacaacttacagacatctttgaaagggactgaaatacgggcattaataagccacgaaagaggtgaaataatcactcatcaagagaagtggtaaaggctttggacttctcaatgtgtgactttaatatttaagactctaaattttattttaattagtcagccataatacttttaaggccatgttttaagctttccttaaaaacggggaaactcgttaattgccatattcacttattagcagagtttttatttttaatatatgaaaagggtcacagagattggaggtagtgtagccaaatggtcacgtgcctaggcttcaagtgtaaagagatgggtctaaatgctcaatagctttttcctagggcctttaatatcctttcaatttctgtagaatgggaatatgaaaaaccatatatcggccggatgcggtggctcacgcctgtaattcaagcactttgggaggccgaggcgggcggataacctgaggtcaggtgtttgaggccagcctggccaacatggtgaagctccatctctactaaaaatacaaaaattagcctggcgtagtggcatgtgccagtaatcccagctactcgggaggctgaggcaagataatcgcttgaacccgggaggaggaggttgcagtgagctgagattgcacccttgtactctagcctgggcaacagggaaagactccatctcaaaaaaagaaaaaacaaaaacaaaaaccaccatgtatcataaggctattgtgagaactaaatgagaaaatgcatatctgacaattaaaagggtacctgagcctctgtaaccaaatactattaccaatattattattcattttgttgtattactaaatcatcttctgctgcttggttaccctgttagagaataaagctattacaatagttgtaaaaatgatatgatttggtacgtctgttggagatgttgcctggtttgctaaccatctttcaaatcattactgtgagtagaaaatatagtgctatatgattatcaagaatgaaagatgccttttgaagtgatggaaataatttattacttatttgaatgcaaactcacactctgaaattagggatgggatctagcaaatctcttttaaatattcataggcaataaaagtctggctgtttgactgatttaacaggcaattgaatgttaccttagttctgcataattgcagctataagaaacattaggtaggtgatataaaaacctcacaaacctctgacataggcacttaattgattttaaaaaataggttaaggctcatcttcaaattaaaaggcactttgtttattaatagcaaatctggctgaggcaggagaattgcttgaacccaggaggcagaggttgcagtgagccaagatcgtgccattgcactccagcctgggcttcagggagagactctgtctcaaaaaaataaaataaaataaaaatagaaaataaccacaaaataaaaacttttttgtttaaccaaccaaaaatcaagagaatcatggcctaaaacaaattcagaattcttgattataacacattaatgtacaacaagaattttttaaattgatttaaaaactcagttactgtaatcattttgtttcttcagcctctcagataatttatcccaaggcttattctactgcatcgaaacaacagtctttttaactagatagtggaaatatccaaaggattgatttagctaataaattattaggtgtgtcttttttacctaagtagtttgaaattgatcaaagtgctgagcaaagcctgagaaatacaaaagtcctattactacacattgttttaatttaacattgtatctttcaggtctaatcagcttatcacaggctgatacaacagaatttgagaaggatattatgtttaacatgatgtggttttcatgaaagccgtaaaaactaaatatgctttattttcattgtcaaataactcccaggttattactggccaaatatgtaatataaacacagctaggactgataatagtttcaagtttacttattttagatttattgttattttaacactctgcttaatcattgaggtacaagtggagagcttctgattttaagacttagagggtgataaaaatcctttttatctgtcttcacattttatttaactaatggaggcatgtgcatttcattatatttcatattgcactatctgcatttatttaccaatcactgccctcagtgggatatatatatatgtatatttacatatttttaaatatatatttacatattttaatatatacttacatatatatatatatatatatatttacacccatacaaacacacacacacaatttttgagggctgatactctagaatatcatctagtcaaaataaaaaggctgatcatgtattaaatttattgaataatttattgaatatgtactgtgttcctggaaccatagtactttaagtgccgtattttatattttgctcacaaaaaaaaccccctatgaaacaggatgaggaaacgtaagtttaaaactgttactcaaaatcacatagccagtgaattacagagggatttgccagttatcaattttttgcctttcaacatgatcctgtttttgacacgggaacatttctccccttgccagctgacatgatattaagttctgtcagtaaaggatgctggagtgacaatgggggaggtagaggtttgtctgtcccagtgtgcttttaattctttttcaaacctgtgactctgggctggcctatggaatgcccagtaaggctcacctcatccaccccactttacccagaagactttcagcaacactatgggtcgtgtttgacaagttctatgggtacccaataagcaaattgaggatgggtggcaaatccataggcagcttcctggagccccacctcatttcctcaagtttagtagcatccactacaggtagtttcccaccatgtccaatgaatacaccagacagctttctagcaaattcaatggttccccaccataggctacttccctgtgaattttgtcagcattcccctccaatattctcttcacactagcttcagctcactggctatagacttgttctggattgggtcaatgaaggaaacttctctgtcatcccatgggaggcagacacacactttctaaagaagtttgaatccagccttgggttgagctcctatctttccatattagttccttgtttgtgtactattcctcaggcttaaggtattctttagagatctcttttatttcctattaaaaattaatttccagtaagtagttaatacttatttgtgttaaaccatctctgtttaagtgactgagtggtttctgtgccctgtctggaccctgactactaatacaaggtgttattctagcccaagtttcaagtattttcttattcaaaagtttatgctttaaaaactcagtccagaaaataagataatacgtgttgaatcagggtatgttgctgaaatgaattattttttctttgggggaaatgtcagggtttataccaaaaacctttaaaatagaaggttataagtagttttgtgttaataaaggattgcaatataattacattaatagagttaataccaagatcaagttagagagtaagctattcctaaggacagaatagatgagtactgaaaaatgtcaaacactgaagttggatcttggccaggtgtatctcccagcactttgggaggccaaggcaagtggatagcttgagcccgggagttcaagaccagcctggacaacatggcaaaacaacatttccacacacacacacacaaataaccgggagtggcagcatgcacctgtagtcccagctactcaggaggctgaggtgggaagatcacctgagcccagggaggtcgaggctacagtgagccacgatcatgccactgcactccagtctcagggacagagcaagaccctgtctttaaaaaaaaaaaaatttgagtcttttcacagctaagccaaggtcagtttcacaatgacttttaattttttgatgcaactgctgtctcctacctgacactgatattcaaatagaaataaaaacacattccaattccatatcacaacccacattgaaatgatcttcaatttacttgccacatagcaatatctatttgactcagatccagcaatagtgcaacaatgatgaaggaccagagattgtttggaattccccttttccaatccccaattccttatgttgatttggataaaatatggatatgccacccaggattcaagactggaggtgctgctggtacatttgcagatatctgccctaccctcacatacttctcttcagaattggatagagaagaggttttcctactcaaggcgttccttttcaatctgtaagcatgtcaaaaggtccccgacattgactattcaataagtcattagtcaatggtttcatgcatactaccctagttactacccccccttattctcttttttctcttcatacgttatattatttgtttttatgtcttgcacattctaggaaatcagtaactcttccttaactaaccaatgtttttaagttatgaaggttagcaaatttttcctactcatcaaaccatagaaccatatctcacatgtagtagatgtactcagtaagtgaatataaaactaaacatcattataaaatgggttttcttcttgacaaataatccattcttaggagatagtatgcaaaacactgactaggagaaatttgctattttgttttagttttgatttgaaaaatcacaccatgtgtgatatatgaaaatttatctataagaaatgtagtgttatttatgaagaataaataatatggggtactaacagaattgcatgtattattagcagattacatgtgacataacaaatgtgtgtggaatggagggagaggaataaaatgagacagcgagagagaaaggatacccacacatactggtctatcttgagtaaggaaaagaactctgtggtcagagtaaccttcttgggatgtctcagttgccttttaagaatcctaacttacaatgtttttgtgaaatcacatgctataatacacatgtaaagaatttacccagtgtctggcattggattgtctctgaaacctgaaagctgagctaatatttaaactattgctcattttatctgagaggcctgtatctgctatacattaatgcaaattagattaaagagatttttcacttatcttcatacctcttcatgtagttccctccaacgagaattaaatgtctcaagttcctcattgattagctcatccatgactccgccatctgttagggtctgtgccaatatgcgaatctgatttgggttatcctctgaatgtcgcatcaaattttcaagtgactgaaacacatttgcaataattactatttctccttttttttctaaatacattggattatcagcaaatgctcagtatcttctgatttacatataattaagtcataatcaatttaaagcaaattttaattgggattaaaaacaccaaggagcatttttgcttcaaaaaataggatgtcattctatatgaatcttcatgggattatgacagtgttgcggactgagaacttaaaacttgattcacaaccacctttttccttgacgtcccctaactctaaaaccagaagaggtaaaacactaaatttctcaacttctctgatagctagtggtgtccacgtgacacaattctgaaaaagagtactctctcaagaagaatccttttgcccttcctacttttttgcacatacatggcctggaggtataacaatcatctttgcactgggaggcaatgactttgagtgtgaggtccttcatgctcaggaagagagagcagagagtgcctactcgcctcataatatggctgaaccatcctcaaccctgagtaacctcccttcactattcttttcgtggtgagaaaagatcattttgtgagcttaaaccgttgtctgattctctgttacgtacatcccaataatacccatctcctatactgctcaaaattgacaaagttgcctggctagataatatgatgaaagtgaatctcagtgtcataggcatgccagaaaacaagggattcaatttcatcttactggacctcaaacatatctataaaataagtgatgggcatatgttctcacaaatttattaaatcttctgttttccttgttttaaaaaaatgaaaatcttccaatacatatttgtaatttttcctgtttatgtatttttcttgaattttgagcaaactcaatacattgtcctattaagtttcaagaaaataaagagacttcctaaatacatttatattaaaaaaaatcactataacctgtaaaatactttaaaagccatcaaatttttgagtagaacaatgtgattgttaataattttcctaataatttatattccttattacttctaacaaatcttaattttgtaaatatttatttgcaaaatggatataaataattttaatggatacattattttataagtcttaacaaagtatataccttgttaaatttttttaaaggtggatgaaaagcaacaaagcaaaattaagggatcagttataaatatcttgagttgcaagaaaacctagaagtcgtgcagtttttctatccttgatacgtggtgatctagcccttttcactcaaaatgtcctcctggataagcatcagcaacactaccaaagagccaattttatgtatgtatttatttattttttcactgtggaatttcatttattggctccattatctgaattaggaacaatttgaaattatgaccacaacatagaaataaaagataagagcactcgcaattttcctcctccctgcttgtctgtgttgtgggcattgtgagggcctcgtctaaaatagtaaatagtaatggtaagttttgtttccccatcttttctaaatgctcttcattatggcttcaaattttctctctttccttaacattcctttgtgaacatgccctagtttttcagcacatcactgaaactgtgagagcaagaatttagcatggtgctccatgtacgatttgacaatttcataggctaacagcatcatcctatcttctgttctggccactgtccttttattaatgtgctgtaaatttgctgcaacttttctagaacatgtaacacattgctgattcacaagaaatgtttggtcaattaacttctctgaatacgacaaatttatagtcatagtcagatagagccaaaattaaagtccactggagatctacttcattgtactttaatatcttttcaggttttataatttccttttgaaaattaggaagttggataaaatgatctataggtgtctactctgatgttctaggattacaaattctattctgtctaaagaaataccttacattttcttcacatcttgaataatttatgctccttattttatagatttacagaggggctatactacttatagctttacgtacatatattacatattctaaaacaacatattcattacatatagataagtcaaaagtacactaaaatgcatagagcttgaatgattaaatgtcagaagttaaagtcaagtttataaatgcaaactcatttaattattgaaagtctccaaagtaaaacttaaaaatgtacttacattttatgaatactttaaagatatatttccaatattaaagcatatccatttaataactcaaaacattccgtaaggtgtaaatttgtgattttaagtaagtataaaataggttccaattcaatacgtgcagcttttaaactggaaataatatttcatattatcatcccgattagccctaaagcagtgagtttgtttattcacactgtctttgcaggtttgtggtacatttaattaggtgaagcatctatgtagaacttagtgatataataaaggcaaatttcctctgtgagaagccatttaaaccctttgcaaaatcttgtgacctagaaggttattagggggaacaaaggctttatccaaagtaccagtgctgagtgataacatagtaattatactctcttgggttgttttctttggatttgtcttctatttggtacttgacctcttttaatactgcatataaattatcatcatttggcttaatttacaacttacatctagcacctcagagatttcctcagctccgccaggaatgttttcagtggttttaagtttaaattctacttcatttagccacttgtttgctttctccaagtatgacaataactcatgccaacatgcccaaacttcctaagaaagaaatatatatcacagattaaatattatggtagaaaagtaaatgtgaaattttgccatttcattattaaaacttctgaaaatataacactttgtatttttcacctttactttgtagcaggtaattcaaaatgcagctagacagtttcatcatctaatacctctacaatcaaaagtcattaagaaaacattttattacatgaataatgaataaattcaaaagacagtaatttactttttaaaataaaaataagcaccaacattgcagtctgggaaacagaaaaataaaagcatatgtaaaaatgcatatgtaaatctaactccctcacacatcactgttaccagtattctgtgacctcctctgaaatttatcatatataatttgatagttaaaatttaagtgagtttaactatagctctcttttcactaaacattatatcataccattttctgtattactaagaagacatatttttaatgaaaatctaagacttctttaaagtggctctatcttagtttagcaatttcctttttttagatagactacttttagttttgtttgctattataaatttatggtaaacatcatcgtgaatatggactatttttccacattcttattatttccttgaggtatattatcggaaatattaccactaattcaaaggtttgattattttaaatggccattaatttgtattatgaaactgatttatacacagaagtactcataaaaaagcagaactttaaaatttctacaagaaaatatagaagaaaatatttctgactttggcatagagaagaatatcttaagtaagacatctcgtaaaaaactgaccgtaagaaaaaagagatgaatacattcgactacattaaaattaggaccttctattcatcaaaggacaccatcaagtaattgaaaaacagactcaaaatagaagaaaacaactgcaacatctgtaacacataagaatatgaaaaatgccagcaagtcaaatagaagatgaataacccaatcgataatgaaaagaaaacctgaaccaaaatcttaaagagaaatatgtatatacattaaacatgaagatatgttcaatctcattagtaatcaaggacatgtaggccaggattacaatgagataccatgttgattgacacaaatgagaagtttgacaattccacgtgtgagagaagatatacatgaacaaaaatttgtatttattgttggtgggtgtgtgtactgaaatggccatttcagaaaacaatttgttattctcaataaggtgaacattcacatacccatcaagacaacaactccactttttgatatgtgcatcctcagagaaactgtttaacatggataacaagactgttacaacaatgatcatttcagccctttttgtagtaatcaaaaaaaaggaaataatgtccactgcaaggagaatggaaaaatataccgtcatctttaaacagagaatacagacgtgacaatgaaaaatctcatcaaaaagaaccataagaatgaatctcagacacaaatatgttgggtgaaagacaaagccctaaaaaaactatattatagtttaccattactgtaatactgaaattaagcacaattgttttttcactcatatgtgtgtggattttttttaaacaaaggaataacaaaggtagctttctagatggtgattatgtctattggggaaaagataggaagatgcgagagaggataagaatgtaacaacggtcattttctgttagctttgtaactgttgaatgaacctataagtacagtaaacacaatgcagcaatcatcaccacttactaccacctgcccccgcctcactaccaccaaaattaaaggcttgaaaggaagatttatttcagaaggatctaaaaaattaatcagatttcccaaagttctctatgttcatagcccttagaatgacacagagtattcgatctctatctgatgaaaagtatcagtctcacctgcttggcaaacgtaccaacctttcatacctgcttgatatcttatgtacagtttattgcaaaaagtgaaattaagtgttttgctttaaaaggtgatagaaatctaaaatctgggtcatttccagctcctgctggactacaggctgtcttcattctgggcaaagatcccagtgggaaaatataaatatcttcttaaatacccgagggtaccttagagctttgaagacaaggagacgtgattggtaatgtgtcttattaactttggtgcagattgaggtaatgaactaccttgctgatttaactgtcagaatggatagcttcttctgtcctcaatgcatctgaaggacacagctggagaggctgaatgtaccagctttacaggtcacctttgcaaaataaaatatagtcttgaagcccgaattggagctaaaagccacttagaataactgttaagcttaacagtttggatcttaaaattactttgaaatcacagaatccaaagtggctttgaaggaaagtacaaataaaaaactaaacttctgttcaaaatagtagatggagctgatgaggtaactcccaacatatcctgcttcagttataccaaaatacatgttaaaatacaaaggaaacatttttaattcatagctgatctgtaaaacatgtatatagaacctcaggtgtgagaaagaaaaagagggaaatgaaagtagaaagtggaaaatcaagcttataaaaatactggcgtatcagaacagggtatacgacatcaaagctggggcatttaacactaacttgagatgggaaatgaggcaagccagggaaatgggaaagaatgaagcagtgtgccatccaccctgtaaggaagaagtagaacatccctagccattggaatattatgatttagcaaggaaactattgttgggggattttgggctgaaaaataaagatccacccataacaaacggaaacttaagcttgtatcacacatgagggcagagcataaaatctctacaatcctgatggcaacaatacaaaaactcaatagcccagagaaaaaaaaagacaaaaattccagtaaaggcaattcctattatagatgagctcgcaaataaacaaataaacaaacaaaaaccttactagccacatggggaaattcacttccattagagggagtcattagttgtaacaaatggtagaatccataccttatgacataaagataatagaacaattttggagaactgtacaataaatatgcctagcctcatggtgtatgtttcccatagagtttatttgcttgagactggcaagtggaattcacacctaagaaaaagggcttggttgcctacatttcattttgggagatcatctctttcttgttttcacaagccctggtttaaacagagagagctgacggagacttgaggggagtgaggtgaagagagtttgaatagttaggcaattcttctttctcacccttttatggggataggtagggtaaactcatctgaatcattttatttacaggatctaaaacaaaaccactcatctactgggtggatatattcaggaaggggtggttggtattcatttcctgttgagctgttggtatggccaagaaggaatcaaaaacaactctttcaaacttctcattcctgaaaggtacggagtataggtacttccagtgcccataggctctgagttgagatatggtaggtaaattagactccagggcatcactaaagcattggttaaaaagacataatattcaagagcagtttgtgtaaagctgttgacaagcgtcagcttgaaattcttgttaaacactacgaggtactataaaagcctaggagatcttttttggggggttcaaagctcatatgaataaggccaatctggatcctcaacagagcgaatcaagtctatagagaacgagccaggtcagtggtgataatatatagaagagggacaacagactaggcattatagatgtgtgtgggttttaacaaaagggaacagcagttgtgagcagcaaaaaaaggactttcacatgaagagagtatttttccctcttcaccctcccttatatcgacagtagatctgtatccagaaactgggatggaggaggagactgtgagaccatttattctcactcctgcgtctgtataaattgctgaagcaacagattaatctaaacttgtgaaatatttgattaagttatgatatttaaatttaaattagagtacattttaataactaaaagtgaataaaaagtaatgagatcccagagaaatattgttaaagaagccaactaccaggcagaaggtgaaatttgacagagttgggtgtagttattggaaaaataagacggtgtcatgtttattactcattaagttgaaacatttcagtcaaacagatggtatctgtttaagttgtttaaaggaatacatagaattaatcacaaaaaagaagaaaaccataacaaagaacagatttgtgaaacaactcaataaaatattgagaaatggaaaatatgttttttgaaaaaatataaacacacatacataaatgtagagagataaatatatatacagacaaagatgagactatttctctattgaaggataaattacgccacaggcagctgaagcgagaatttgagagttggaagacagattttagaaaagtatccaaaattgagcagatagagataagaatatagaaaatattaaagggaaaccagtaactggaatataagaaggggatagtcttaatagctctaagaaagttttcccttaggaaggaatgaagagattgggaaaaagaaaatcttcacaaagacaatgcagaaccactaaagaaataacgtatctgttctaattaacacaccaggtgacaaagtataaatgaaagcaaatttacacacagacaaagttgagtgaaactgtagaagacaaaatagggtgaaactgcagagcagacaggacgaagagaaaatttaaaggtaccagagaaaatgataaagaaacaataacttgacagcagatttcctaaaggcaaaaaatttcaaaagacaaataatattttcagtgttgtaggaaaaaaaaaaacctgtccttacataatttcctgctcaactgcatcattatccaatactcagggcaaaataaaggcattttcaatatgtaaaatctgaacacatttgctactcacactcaaggaaagagcaagaaagaaactgaacacagaagcaaagggaagaacaaaaggcaaaactgatcacaaaaactgggaaaatagcatcggtaaatctaaataaatattatatgaaatagttaaaacaacagcagcagcaacagcaattatatggactaatttgggggaaataaggtgaaaatgaaatatgaggcaacaataacgcggaaaacggaagaggtaggttcagagttaaactatgctaatgtttccaccatattattgttagagaggtatagagaaatatttataagataaaataaagtacatattccaaaccagtgaaaaaggactaaaatggaactcaataatttgataacttcaatatgaatagggaatgttagaaatgttattatacatgagaaggaaatggaaaaataatccaataattggtcttgaaaagtttgttattaatacgaaaacttaagaaaatcccttcggaaaatgtactccaatataaatttctaatgaatcacggagtatcatttaaatgaacaacatgaataatagggaacaatgatgcttatttaaggacattaagaacataagaaagtaatagtaggtgttttatttaaacattgtcagaaagcatttcctgggtacaaaaagtccctccctattgtaacatgttagtgaattaattgtggttttcttgagacatgtacagtgccatcagatcccttcccttcccattctttgttatattttatatagcactcacataacactgatacataagatacgtcattatatcctcagaaactgtaatatttcctgacatatagaaggcacttttcaagagtctgaggagtgaattgcatttaaaagaaaagaataaggatgagtaaagaagagcttagaactgataatggagaaactcggatcacattttacaattggaaaatgataatactgtattgggaatatatggggtactttagctacaaatacattttaaaatatttttaaaggtgtactttattattgatctgaatcgtatctttctttaaatatcaaaccctcaacataggaagcaaactaaataatgtttttcaaaagtaaagaggtacctgaacactttattaaccatattcaccaaaataactcagtctgtgtgagggaagggggcttaaagtccaactcatgtgcaatgtctggcagcatcagcatttgtagtggataaagttttgtgccccttggcacagtattttcataagaaaggtcatagcttatttttgatgcaattacatggccatcatttgaggcacctgctttctttatctaaattcagataagcataatctagacagtaaggcccatccataaaagttaaagcagaagttgtgataatacataaatataatgcaaaccatcaaaaaatatagagctggttaggtaacatgtctaacaaagaactctatggggcacggcaattactaaagacaattgtagtaaaaacatacttctctacagaatgcttttccccaaagatacttaaataagtttatgtacatacaaaaataagaaaaaataaagatcattgtctataaatctggagaaaatttataggattttatgacctaataatagtaatgagaattagaagcatagctactcacatatattgagtactaggctaagtagtttaaagagaatagctcatttaattttctcaacaacttatgaattatgtattatgtctagttgacagattgaaaacaggtttacacaagttaagcaaatggcccaaagtcatacaacttataagtgcctgaatgaggaattcaagccaaagttgttttgcactggtatccatgttcttaaccactatgcctcacatatgaccatgtattgacatatcattgacaaagaccaagaaaagcaactgacttccaaagtcttgcatttcccattcagcctagtgcagagccactggtagttggtggttagagtttcaagttccttttttaaggcctcttgtgctacaggtggagcttgagctatgacactatttacagactcagtaaggagtttcactttcgcttctttttgttgggcctcttctttagctctctgaaaaataaagaatgctctcttaatagcatgaaaataactttacatccaaaatgcatttctatgaatcatataatttctttctcacaacatcccagttagaatgagaattacaaaaataaatctaatatgaactccagtctcttccataaatttaagtttagttgaaattggaaagttaaagaaataatttattataagaatacaacagatctgtaacaagaatagactgaaaagtagtctgcatggaggtatggatttgtggtcaaatatatacacattgatataaatacaattgtttggaaaaggcaagaaacaaatatttcaatattaactaggttaaaaaatatttggcagtctagaattgaaatcacttataaattacttggatgaataatattgaaaccatcacaaatatcattatttaagttaaaggatacttaacatagaaaggtccccttgatgctatatttaggaacatattttgataaaagaaagtttcgttcgagaattgaaaacacatgagagaaagagaaaccaaaaaaggagctgctgatatcagaagctggcctgacacccagctatgccttggtcttctcaagtggaaaataaactgtttcacagaatttcaacattggaaaaggccactttgtttccataatggatcaagaccatgacaagatcattccataatcatgtctgaatccagacaaaaacatcaacattacccaaaccacaaaacgcccaacactctcctatcctggttaatatgaacgaacgccgtttctttattaattgcaactttagcctcattctggtcttctctccttctggacaagatacgatacccatatagctatccctacacactaatgacaagcaatccaaagtaaagcttttaaaccctccctcaaatcccctaacacaagcacaaatcctacaatgttttttttttttttcatccacacgcaccccctggcctccatgttgtgtattctccctcattgcaaaaaataatgaacccaacttgttcagctacaagagagttggtggtggtcttcggttgggagacatttacactccttaacttcaaatgcgtacatgtattttagaaacacacacacatacacactgtatctttagtctgtgttcctccaggggtcaaacctgacattagctttcaaatataagtagtttatttatgtgtgccatgtaaaagaaattctggtagctgaatggggaattgagacaagaaagggaagagacatccatatgggcatacttattaatcccagcaaacactgttaatgactagagtttaatcctgttagaaagccctgagaaatatatgcctgcgggttatcccattcaggggtgaagaaattggggtattatttctgtatcatcttccctaattgttaaaggctgttggggaaatgttaatttcccagtacttgcaagcctaccacacaagtgcaaaagtgggattcagtggccacagaaagccctcaagtaaaggaactcaggttctataatgtagaagttgggcctgcatacaatgcggtggttaaggtaagggcttattggcaggatatggataaggtcagctataaaatgcctttgtatgtgtcagcataatcaccctactcctttggatttagtcccacaattccttaaaagtatgcattatgtcagaaaatgcaaattgttttgtctatagaatgcttaacttcaccgattttaattgattgaaatctttagttcaatattctaaataaatcagctttttggcatcactgagcatagagattgtttttacacaaattgcattttgactttagtaattatagtataatcaacaagtttgattaccattcatcatttaatatgtgctactgtgttctgtgccagccatgtcataagtgctacctcattagatctttacccaaaccttctcggatgtgttttgttacctctatattggacattagaaaactgaggttcagagagtttaaggaaatcatcctcagagttatatcctctctttctcatagtttctgttaagcgggtctcaaatgttccatgagctgaagaaggagcatgctgtagtcagtctaatgaataaaattacaatttatgctcattataaataacccaagcaactatataaaaatgtagaatgaagaacacttctttccatggtttttagacttcatatattcttggtttaataagaggctcagatcttgggaaaggttcgaagaacaaacagcaaaatttattaatccaggtacatatgaggaaagaagatgatgatgaatttctctactaggagaaaaggtagaaagctaaatgactggtacagtttctatacaaatcctcataaaaacggtggctcttgtttctttccatgaatctaactatgatatgctctgccatctttcattgctaggatttcacacccgtgcttcttaaagtgagcacccttggaatcactctgcaacttgttctttggtatcaaactcaaacttgttaaaaatgaaaaactacaggcctcacccaagactcactgaatcagaaattctggggtcagggcccagcactctgtgtattaaacaagacttccaggtgattctgatgtccattcagatgcaggaatcactgctgtagtgattatacaaatttatttgtgtatttactattctcactttatgtgtaagttctggtaagcactagtactagagttataatagagtaaaaattaaaaaaaaataaaaccagttaataactttccagagtgtttttcaaagggttttagtataaagttttaccatatagtgattgctgatctccataaaagttttaaagtcagaggttgtttatcaaactgtaccctgggttcttttatgtcaaaaaaactttccttttcaggggaaaaataagttattaaaacagcacttccattttcaggtaaaacacaggaaagaacataaacagaagggggggtctctatttcttctttgagtatcagggagagatgtcaaaataggtctgttagtatcttctgacaataaagaaaaattagctatcaaatgagcacaggtagaagtctggacaaggtactattgctaacctccaggtagtgaagttgccttaaagaaactgtcttgagtagcaggctgaaaactcaagaaatgaaatcttcctgccaactcttccagtggttgttgccagaggcttccagagtttacctctttttactatcacccccatactaaaccaattttgtagctagaccaattatcaaaacatgtcaatcaatgtagacaaatttgttggaacactcatttcaaggatggttttcaaattttaaaaatttgagacagtttactctagagcacaggaaaataagagagatctgactgggttgttggtgacataggcaaatcgctcatagggagagggaagagggccagaagaggcactgaaccaaaggaacccagggataatcagagcagctgaacacaaatgactctatagtatctacttacggatctgaggtagtggccatatataaatagacgcagtgagaaaggaattgagatacaagagaaaaggccatatgagtgacacacaatggaaaagaaaggaaaggaaaaggaaagggaaagtgaaagtgaaagtgaaagtgaaagtgaaagggaaagggaaagggaaagggaaagggaaagggaaagggaaagggaaagggaaagggaagggaaaggaaagggaaagggaaagggaaagggaaagggaaagggaaaggaaaggaaaggaaaggaaaggaaaggaaaggaaaggaaaggaaaggaaaggaaaggaaaggaaaggaaaggaaaggaaaaaagagatgaaatagaataaaataccttcaatcctgtgggctctaccacaaataaagtctgtgactatggctaaatcatttgacctatctgggaattgcagttttctgataagcagagagagaagtgtgaattacacaagtttcaaagtaccttctagctctcacattctgataaagttttcctcaggggtgacctccccaaagtcaaattttaaattattttggtcttttgaaatactccaatggtttttcttgtccatttagaataaaaactgtgatactctaacaaaacccgtttgttaacagatatttgcccacctcctaagacttatctgaggtaattttatcccattttccttccttcaggcagatttctttctcttcccaattagcttcagggtctttgcagaagctatgctctctgaatagaatgtgtttccataaagatttttttaagtggttggcttttccttatgattcagttctctcatattacatacaattcttcataaatgctctataagtcaagtttttctaaaatagcatcctaccaccctcaaatcctgcctgaacattattcattcttgatttcaaaatccatgtttacttctaggcaaattatcatgatttcatttatttttccatttattgcctgctcctcaccacacgctagaacactagaatgtaaattccaaggcagtggtcttgctcaccaccctctatattcagtagccagagggtgtttggcacacagtaagtatgcaataagttttagttgataaatatgctattgctagattagaataattctgtgtttttaatactctagaaatgattatactaattttttcttcattatagttttatacacacataatatttatacatatttatggagtatattagatatttactttcaacatttgactaaagccgtatgacagattcgatatttaaacatctgagttttcatgtgagttactttctgctattaactataatagatatttctgaattaccatttaattatataattttttaccatgtggccctttcacaattaaaataataaataatgagtcatggtcatttatactgtgctaggcattgtgttagaaatttcatatttcatccctctaatgattctgaaagcagacattctgatacccagttcacaaacgaaggaatttggctcagtaagctcatgtaactcaccccaatttatacagttggcatggggccgaactaagttttaaactcaagtatctggctccacattgatttttccttgtcacaatccttgaaccaaaaaaagatctacagtattaatatttcaagtcattctctaagttcttgctagcacataaaaataataattatgattatagctactaattgagcaccaactctgagttaggcaatttactcacatggtagttacaatcaacagttcatacattcaagtgaggaagtatgatgatataaacatgataaaacagaggattatattgactattatattgttgcccaaggccatacgaaatgccactatgtaggttcaagtccaggcttcacctccaaatccatactacatactacataccagtttccttcgtaataagtcaatgttatattttgtcctattgtttcaagaaaagtacatgtaaactcagtcctttctatccatattaaaggctacgggttcaaatatttagtgtttccaaattctcagaaatgccttcaaactaccaaattaacacagtttgttgactacattataaatttgtcttttcaagaatacttttgcacagtttcaacgtacatttacatcagctacagacagttaatgaaatgagttgattctgctctcttaatactacatgatttcaagggaaaattgtttcaaattgtgattttcaattttcataattgaccacaatgcattaaaattaaacagtttaaggttgttaaaatgtatattaaacttgaagctaaattaaaattattaattaaaaatcaacctcttctcttagaaccaggaaagagcagactgtatacaacttcaagcattgttgcatttctttctttttccatttatttcctttgttttacttagtttttctttttttttttttaccttcatctcttcaactgctttctgtaattcatctggagttttatattcaaaatctctctcaagatactcttcttcagcttgtgtcatccattcgtgcatctctgatagatctttctggaggcttacagttttctccaaacctcccttcaaggcctcctttctggcatagaccttccacaaaacaaacaaacaaaacacgattattgacagtgatgaaacattattattatattatttcatcagtatgtaaataacagaaagcttagatagtaatgataaagaagtaaaaagcttatatgcataagaaaataactcatggggatcagatacactcaatttcccataagtgtgaaaataagacatgtctgtttatttggcatacttaataaaatgaacgtattgcccgatgatgataattcagctgtttgtgtgacaatgcttttctgtgaatggagaaaaacaaggctttttaaaataatatgtttcagttggaaaagtaattttattggcatacatagaaatagttattctttgtgttctttcataatgttttactattttaaatattctaagaacttcataatcatgtatctacagaaactctcataaattaaaaagaaaaaacgaaaagtgcataaaacgtagtttggcaattcacaaagaagataatatatggcaatacatgtatataaaagatgttctaataccatttatagttaaatgattgcaaatcgaagtgaattaatgcattttcacatgttaagacagggaaaaataataattaataaagagcccattttgggcagggatgtgggaaaatcaaagtttttatacttgttgagggaaatatccaacataatacaaccttttagatagtaagatggcaaaacatataaaaatgttaatgtccacgaatctgagtcaactgctccattttttgagagtgaatcatgccaaccaaagtgtagagactaacatgtacaatatttaattcagctttaaagaccaaacatcttgaaaacaaacccaaaggtgctttcatgagagattaaattatgacatatatatactatgggatactgtgcatcacaaatacatctttactgaaatgaaaagtggctcaatataaagttttacgtgtaaaatgcaagttgcaaaagagtctgtctgtggttatagaaaacatctgctatttaaagcctcacgcatttttgaaaactaaaactttctacaatggactccattactcattaaccagaaaaatgcaaaacttaaaacatctaaaagaaaatcatacaccttgttacaaggcactctatagtattacaatcattatacatagtgcttttactttaaaaagtaactctattcaaaagatggtattcttctctctggttgaaacaacattatacattttaagtaacagagttttcatagtattaatatataatgcacagttttagtaaaatgaagtgttcatggtactttgcccaatagtaaatatgtgtagaatcactatcgcattgattttccttataatttacaaccattttgagcctaatatagataatacttcattttaggttctttacttacctaggtaaatgtagtacttgatctactacaatgtaaataaatgtttcaccctaacacatctagaacaatatgtcttgcaattgtactagaaaaggtataaatgttattttgtgcagtcaatgaacctataataaacttaagaaaacatgctgctatttttgctattttataaattaagaaatcctgctgctaaatttctacttagaaactctgctctgttataatcttttaaggcagttggtgaagctacaaaaatattagagggactaatggaattcagccaagacttctagtaaaaactatacattcacatacatactttgtgtgtgtgtgtgtgtgtgtgtgtgtgtgtgtgtgtgtatgtgtgtgtgtgtgtgcacgtgctcaagtatggtgagatattgttggatcctggaaattttgaaggcaaaaacgacagcatttggtgatagatttgatgttcggctgtaagagaaatataggagacaagaaaatctcgtgggatttggcttgaataagtggaaagatggaggtgccatttgtaataacaggcaaatttctagggtagtagactggggtatacatcaggaattttgttttaacatgttagatttaatatgcctattattaattgatgtggaggtgttgagtgggcaaatgggtatgcaggtctaggatcattagaaagggtccagattgttaaaaaaaaaaaaaaaaaaaacttacagcaggaacaacttacagattacatttaaaactatggagcttgataagttgacccggagagtgggtggtaatagggggaaaaaaaaaaggagtccacagactgagccctggaacactttcaaatttagtggtcagggcaatagaaccaccaaggatattgacagtggtcagggaaaactaagagataattaagaaagaatgatgacacagaagccaactgaatttagcgatttagtaatacgaattcactgatgaccctgacaaaatctgctttaatagaatagtgaggataacagtttgattagctctcttaattggcatcaagagagaagggaaggagtgaaatggagagaaaggaatgtctgtaaagggaaacgggaatggagaggttgctagagagattgttgtccaattgaggattcttttaaatgacaggagatattacagaataattctctactgatgggaatgatgggaatgatgtagcgtggagaagatgtaggaggtagagggctgttcattagctgttacaatgtccttgtgcagagacaagggaaagggatccaggtacgtaagtggaaaagctggccttagacaaaagcacagaaagttcatctatgtaaacaaagggaaagtagagtctgtgagcttatatgcaggtcagtgggagtactgcaacttctattctgattgcttatattttctcggtaaaacaagaagctagttttttgcagaaagatggaaaaacagactgttagagatctgacgaaagagatctggggatcactacacccaaagagtatactgacccagagaaagacaatgatctgcaagctggcagaaagacatccacgtaacctctaaatcccatttattgataactatttactataaatttaaagccactaataattaaaatatataaccatatattatttacttagaaagtatacatgttttataattctatatatgtaggtttctatttgttttctatctaacaaacatgtacagtgattaatctaggttagatgaggctctatacaccttgaaaagatgaattcatttaattattatatacttatgaattatgtattaatatcatcacattttaaagattgggagactcaagcacaaaaaggttaaacaacttttctagaatcacacaggcagtttatgatgtggatagacttaaacccaggcgatctgatctcagagcttctggtcttacacactgtgcctttccatccacaaaaaaaatattctccagtatttgaccgcgtgtgtctggtttatttcacttagcatactatcctccaagttcatctatgctgctgcaaatggaagaattttcttttttaaagctacataatattccgttatatgcatataccatgttttatttatttgacaatatacatttagattgtttccatgtcttggctattgtaaatattgctgctgtaaacataggggtgcagatacctccttgagatcctgattttatttcctttggatatatatccagaagcgggattggtgaatcaaatgggaattctatttgtaattttttgaggaacctccaaactgttctcccaaatggctgcaccaatttacattccaaccaacaccataaaagaattcccttttctccacattcttgccaacacttagtatcttttgctttgttttgttctgataatagccaccctaacaggtatgaagaggttcttgtggcttttaactgcatttttcagatgattagtgatgcaccttttcatatacctgttggtcatttctacgtattctttagagaaatgactattcaagtcctgtgctcatttttaatcaggttatttttcagttttatttttgctattgaattttagaagttccttatatattttggatattaatcatttgccagacatatgatttgtgaatatttccttccattccctagaatctaaaatagtcaaactcacagaactagagagtagaatagtggtttccaaaggctgagagaggggaaaatggcaaaatgatgcccaaaggatacaaagcttcagttatgcaagatgaattagctctgcagatctactgtacaacattgggcctatagttaaaaatactgtattgttaaaaatattccaagaggatagatcttaggagctcttatcacaaaacaaaaaaaataaataaattaaggggcagaaggaaacttttggaggtgataggtaagtttatcatcttgaatgtggtaataagtctcatgggtatacgcttatccccaaactaatcaagttgtataaattaaatatgtacagcttttggtatgtcagtcatacctcaacaaagtggtttaaacaaaaatagattctcttccatctctaagagtttacgaattatccaatttgaccaagcattttagggatgggagcatggggaaatcttctcaataggcaagaaacagtatcttatatacatgttatctttatttttatgtacctcgtttatatgcccagtttgaaaagtgtacttgacttccagatacatgtctgattgtctttttctccgaaataaatatggctaagatggaaccgctagtcactctagtaagctattccattttgttcttctcttagtacccactctttctttaaaatcacaatgacctacaatgtagctcataacagaaatatatctgaaaacactttgattcttccctcattcttcctctagactatcaacaaacactctccttcagcaagtactgccagatctaatgggatctgttaaaaagaataaaggaatgtgtcatgttaggataggaataatacttctgggtagatgtaagtgtgaaagtcctcatcaaaaatgtaatgaggatactaatcctctgttggatgagtagtttgcaaatattttttcccattctgtggattgtcttttcattctgtttactgtttcctttgctgtgcagaagctagaaactcagatatcataaaaagaaaaataacgattttatgatataaaacatcatatcatatgtggatgtgatgggattcaaaaatgggcaaataatctgaacagttatttccaaaagaagaaaaaaatggccaattaatatatgaaaaaaaaattccacatcggtaatcatcaaataaatgcaaaccaaaaccacaatgaggtatcacctcaccccagctaggatgtatattgccaaaaagacaaaaaataattgttggcacggatgcagataaaaaggaactacactacactgttagtgggaatataaatggtacagtcactgtagagaacagcatggaggttcctcagaaaactacaatatccacaaatatcccctttttcctgcctgttttttttttctacctggacaattgcaatccctacctgcttccacttcagcccttttgatttattcttcttctaataggaatatgcagcaaacttaaaacaaccattttaaatgaaatgaaatgatgccactcctatgcttaaaagtcagatgactttccaaagtacttgacataatgactaaatcatcactgtggcttccatattcctttctgactcattttcccactctttttctcctggcttcctttgagctcctcaaacatgctaagccctctcttgcctcagatgttttctccacttcattttctggcagaattccttgacacaacaaattgtcaagttcctactactcgggtatcagctttaatttcgcctcttcagaaaacactctactgactacccaatagaaagtagttttcctgctcctgtcactctcatttaaagggttcttattgctacattcagagtgtaagcaagacttcaaacaagacattgttgtgataatgtgttaacctatttactttccattttcaccactaaactattatctccgtgaaggtaactacaatgtctattttattccctcacttatatctgatcatttttttagaaatagctagaatctagatttttaaacttatatacataccctttaaaatttaaaataataaccattttatatacccaaaattagatcatgggatgtgaaagcatcttcaaatgtatcagatatttggacaattttgtttcaaattatttatgttttcgcagacattggcatctggtgacaaaaaaggaattatctttaacccaaaagagtgtatcacacacttattttgtctgtagatatttctgtaatgcatagatttacacttcatttccattattctctctggaatgctgaattggtaacaatattcacatatggcttccttgtttttaccgcatcgtcttcttcttctccttgagcgccattgttccttccttttacaacctaactcatttggctacaaagtcagaacatggccagagtgatacttgtaggaaaagcacagatacatataatattctaagattagaaaatggagatcagaacatagcttggatctatagcttttttgctatgcaacagatgagtgtgtttaaaatatatctcttgaacaacaaattcttagtacatataacagacataaggtcttaagcaaagacatttttagagagcctttacaaattgtactcctgtaaaatgtaaaaaccttgaggttttagtaatattgttggttttatactttttttttttggctgatgttttccccttgctctacataaattggtgatgttctttttattcatccattaagaacattcaacaaacaaaaaacaaatacctttcacactggccttccaggaaaacatcaatggtataatctattatttaagtaatattttttttttttcctaaacaactcttctagcactgacttacttcaggagaagaatgtgagctagctgacccagggacagctcatctgtgaattaacagaaccaatgaacacttgtcagtgattgtattagctgagtgatttcccttgacttttctaattttttttttcattttcaaatgtagcttttgccttttgacattacttcttttctattttgaaagtttacttagcagtaaccaaagaccaactgcctctaacacgtaaattgaaaccccttattaatttccaaaaaggtacagtagttcccttgtatctttggaagatatgttcataccaagacctccaatagatgcctgaaaccatagatgatacctaaccctatatacactagattttttcctactcatacatacctataaaatttaatttataaattaggcatagtaagagattaacaactaataaaatagaacaagttatctctcttcttctccctctcaaaatatcttattttactgtgctcaccgattttaggattccaattgaccacaagcatttgaaaccagggaaagcaaaactgcagatgatcggggactaatgtattggtgaacttaaaagtattcattgctttagttcaaaattttatctttcgaacaagaagtatttgatatacactatttttgaatatatcttactatccgtaattgaatatttaaatataagagagatatctataaaatattcttctgtagaaaaatgagaaactcaaatatgagtgtacagtcattttgtgtgtgtttttttttgaaattcagctattcttaatggttactgaatcttaattgttatttaaaactagatgtcagccaggtgtggtaactcacacctataattccagcattttgggaggccaaggaaagagcattgtttgagcccaggaattcaaaaccagcctgggaaacacagcaagaccctgtctctaccaaaaaataacaaaaaattagccaggcatggtggcacacacctgtacttctagctacttgtggggactgagatgggagaattgcttgagcccaggaggttgaggctgcagtgagccgagttcacaccactgcactccagcctgggtgacagagggagaccctgtcccaaaaaataaaataaataaataataaatgtgtcgaagaggccaaacttggaaatgttaatcgaaagttataattatttatcctatttctacatacacatatattagccatgcattttattttgtaccaaatatctccgtgtaacaaatttttcttaatcccattattattatacatttatgttctgaagaaaacatggattggaaataatgactaagaataggatttcattttttagtatgacagttgtgttcaagaaagtcattttaggatcaaaataagatgaatgtgtactatttaaaatatataccatgaaaatatttagatatgctagaaaaaagattaatttgtcagaattaattgtgctttaaagcaaaaacataggaacaaagccttaaccaaaagtaacggtgaagggagacattaggaaatcttagttaagtacgttgaggcaagccacagtgaaagagattgtctatacctgttggcacatgtgatcccactgagtgttaagttctttgagttctgtctcaagtctcgaagcaaactctggctctgcttcattctttatcttctgcccaccttcattgacactgtttagactgggctgaattgtctgaatatcactgactaaaagctaagaaaataaatcaatttaagccagctgaaaaaaattactgccacatattagatatgaaacatagctagaaaatgtaaaattgggactgatggcattgcatatggatttttgtcttttaaaatctgagatacagagatattgatatagatgactgcctaacagtcttgcaaaaatgttcaatggttattatggcatgaatccagtggggaattatttgtattctacttatatcagaaacaaaaggaaataaatttaatatttctggttagaaaaatgtgtgaaaatgatgggcttcatactttattatctttgttagtattttcattttcaaacacaggatactgcagaaattgtttacagtgtaatgggtgtgaaggttatttgtgaggtggatttgcttttttagcttgtattgtaaaaaaatttccttaaagagcaagattgttttcttcctgctgcatgacaatggtataatgaatattatttcaaaatgcatactgtgttatattatagtacagtgcattatagatgaagagaacaacacagtatgaatagtaatttatcataagaaataacaagtagctcaaaggattctttacctttaaattatactgcattttatagtaaaataatgttatcaaatgaggttgagtacaaggcaatgttttgtcagttcctcatttactcaacccagggtttctcaacattggcactagtgacattttagattgtgcagttccttgttctggaggaatgttctatggactgtacgatatttagcagcatctctctcctctacctattagacaccagtagcatctaaccaccacccccaacccagctgtgacaatcaaaaacgtctagaaacattaaaaaaaatccactggggagaggagagcaaaatccaccccagctgtaaaacactgatctaaccaaataatattcatacaaaattattcatattaaaggcatcatataaaaatcttactctgcactgtttcagctgcttttttagaatttctgaatccccaagggcaggccattcctccttcagaaaaacatcaacttcagccatccatttcttcagggtttgtatgtgattctgaaacgagacccgttataaggcattactggtgtgctgattacttttaacacaattcatcattgtgttatgtctaaacacaggcccaaaaacaattcccatgtttaaaggatgtctctaagtagttcttgaggcaaagaatatttttactaagactgcatttttatggtctactgtatgagcactggtgtgtgaagtctgctattgttaaaaatacaaaattactaccaaatgtggttttatgatgttactctcgagaacattaaatcatatccccctctagagaaattttaagttacaaaacaactcatgagaatactaaaaatgtgtccttacagtacataaaacaaactatgaacaataaactcaatgtaatggtgtctttatagcctccctaaacccgaactttcacaaattattttctacagatgacagtttaaatagtccttccagttgggaacttttggactaatattttgtcatcttcaaagacagagcttttgcttttatttgtctgaccagtacgaagtaatgatcaggtaaaaatcatcatcttttatcatttataaatagccagtatctctcacccatgattctttcccgtattacctttttttctgctgttttgccacttctaaaaagtatgattcaactatgctgtctacatgtgttattttcttctgttttacttaaatttacattgaaaatatgtgctccacagaaagtttcccctttaatgtgattattaataataatttttaaactatttatctaagagaacttcaagacgatcaccttgctgttatctttcaagtctacatttgttcttatttcacatcttcactgtccttgttcaggtctttttttttttgtttgttttttgtttttttttttttttttttttgagatggagtcttgctctgtcgcccaggctggagtgaagtggcacaatcttggctcactgcagcctccacctcccaggttcacgccattctcctgcctcagcctcccaagtagctgggattacaggcgtgcactaccatgcccagctaatttttgtgtttttagtagagacagggtttcgccatgttggccagcatggtcttgatctcttgacctcgtgatctacctgcctcagctgcccagagtgctgggattataggcatgagccactacgcctgggctgttcaggtctcattagtgactccattaatgcactggctcgttttgatatctgcctcggtctcacctcattctaattactgatctacagtgatgccagtaatctcctctcctccttcctctcatcttgggaatgttttgaaaacacaagtggaatcatattatttccctctttaaccaatagcagttttttcttattaagtttttattgttattattatcagtcccatcaccactagattaaaactcagattgtaaaacatagcatccaaggacattcactgtctactctcaatccagttttccaaccataatattttattaatccccatatatattgtctacccagtgttgaacttatatcatttaactgaaaatgctgctatgctttctcaagaactctttctttctcggtattagctaactaaattctacctatttaatctatagcagagacaacctatgttccgataatatttcataatcctttttcctagtttatgttggatttccttcctgcctactgtgacaacctttcccatactgtttaatttatttaccatgcaaggctgaataatgctacccccaagatgtcctcaccctaatctctgaaacctgtgagtatattaccagaaaggactttgcagatgtgattacattaaggattctgagatggggagattatactggatcatccaccagggcataatgtaatcacaaaggtcctaattaaaaggaagtcaacacagggaacaggatagggaaaggaaggtgagaaggagaggtagaaagagagggagagggagatagacagggagagagaaattgacactagatgatgttacactgctgactttgaagatggaggatggggacatgagacaaggaatgcttctagaagctaaaaatgccaataaaacagactctgtcgcaaagcctccaaaacagacaaagtcctgctgacaccttaattttagcccactgagactaatcctgaacttttgacttccagaactctaataaatttgtgttgcttgaagttattaaatttccggcaatttgttaggagtgccataggaaatgaatacacctaccttcctccttcactagaatgtgggctccttgataacaagagccatgtaattgtgccctcttaggccactggtcttgacaaataatagatattttcatgcagtatttacataggtatgcatgtacacatatgtttataagtaaagaaatgctatgcattaaaaaatgttttaggtttgcttagtgctttggtttgtaaaaggtaagcacaaaaactaagcagctagactgggatttaaatccaggagcatattgttgcaatgtttttccatcataccataacgttttcgacatttccttcccagcattaacatttgtcacaataattgaccactcaagggacacattacttaccttattgaatattttaggcttttagaccttaatgcaattgttggtttactgtttttctttagcttgagtggttattagtatggtggcactattcaaacaaattaagtcaagggaatttggtttcaggaagaaggtgatgtggtaaaatttaagcatataattacaaattcgatatggtgataaaataagttattactatatattacatatgtaacattaatatacatatacaacaggttacatatgtgatatatattacattagatatgtatatatgtacatgatatataattccattatacacgtatatatatatatatatacacacatatatacatgttatatgtatgtgtgtgtatatatatacatatatatatggaagctaaaaatgccaataacacacattctctttcaaagtctccaaaacagacacagttctgctaacaccttaattttagcccacagagattaattctgaacttctgacctccagaacagtaatgtaataaatttgtgttgtttgaagccattaaatttctgctaatttcttaggagtatcataggacattaatacacctacatttctactgcacatatacatatatggagttatacataatgggatgaatatataatgcaattttatgaacatatcaccatattttatatataatagcacatatagacagcatagttgactcctactttttataagtagcaaaacagcagaaatgaaaggtaatataggaaataatcatatacatactatacattatatatataaaatgattacaatatacctctgtataatgtatatatacataacttttttctagtcataagctaaatgattacccgtatcttaaaagacaaccagactaaatggatgattggttttgaaaattattaaactaaaaacatgtttaattcctattggtaatggtgaaaatagaaaattcattctaaaaacactgagaaaactcctattcttttcctagaaggaataagcaaatcgccatcctttgtaaaagactcatgtcttttcatcttctcactaactttgaaagatgctgaaggtcaaatgcttatgtacctttacagtttacagtgtatcgttagggaaaaaacaagtaaataaaaatgagggtagaaagtaaaatcttgaattacctgaatttttcggagtttattcatttgctcctctagcttttgacaatgctcaaccagctgggaggagagcttcttccagcgtccctcaatttcttcaaattctgattgatatttccggctaatttcagagggcgctttcttcgacatctctttcacagtggtgctgagatagtataggccactttgttgctcttgcagagaactttgtaaagcctaaaaaacaattttttaaatacatttaccctaattgatgaataataattgatgagttttagtgaaattaactgtacttgaaatctatatgattcaaacatgtaaacaaagtagatgatcttctatcagttataaacttctagtggtaatttaaattttacatattatcctaagagtaacttgaatattatttagtggtatttaacactccatatgtatttttctgaacaatgtcaaatatatctcaaaactatatcttacagagccaaaaagttttggtgcatctaattttactgaattaagtatatatattaataactgcatttgtgatacagttaatggagttgaaattaattatactgagctttcaggaaagtaaactctacataaaactatagctaataatattgatatatggaatagaaaaacttattgaacaatctatgtacttaatatattttcaaaaaatgttattctgttatgtagtattatggtgggattcaaggatagttttgtggagaatttataaaatttatttatacttattctgtataacacatgtaatttcttacagtaggatcataactttagacttcccctgttcaatatttactttaatgttacttttactttataaaataataaaggctcatgacaaaaatggaaaaaaaaaccagaactactagtactttatataaattttcaatttgttctatgtatagctaaatattaaatatatgatcatgtatgcacatataaacagttattctttcccctataatgtgacctatatcaacccaaaatttgtcaaatatctaagttttatagtttcatagtatcctatgcctatttggtggtacttaatttgtttttttactttacttttttaagtttatttcactttttcaaattgttcccctatgactgattatttagacaatatctagcatataactacactttgagctaggtgttttagtgtgagcatttgcccatgtcaaataattattttttcaaaaacaaaaattgtaatggcttttctagttcaacaatttccattattagttctacacattcatttctagttttccactcctgtaaattatgtttatctctatctacctacctatctaatccatccatccatccctcaatcaatcaatatcctatctatctccagttccatttacatctttgagtgtattctgattatttccatcagatacagatttcatggaaattatattaatgttgtatgttattaggatgcactgaagagttaacctcagtaaaattcatattgaatttacatttccagcagtaagagacaatttttatttcaccacttgcaaattggtacttatatcttttgtgtgtatgcaatttagtatgcaaaaaaaattctcatcttgtaatttttttacttcttcctttacaatttaagttacaattattcataggtttattattcatatatgtctctttttggaggataccttactcaagactttcttccttactcacagaaaaaaaaagattccttggtatcatatttctttaaaattgtctctggtgtttttacaatgtttgtgattgtttccatcgatttttatgcttctccacctaaatttttataacattattattttaaatattttccaaaatttgggcttccccacattttttgaacattttattgtatgtggtttttattttggtgtaactttgggggaaatgttcatatctttttttttagttagttaatacatttcccaataatatttatgaacaattattttctttcctatctttttcagtggaaatagtctcttctgctcatctaactgccttttcttgtgttttctccactcttattcttgcacatttttattcttatgtttaaaagtttactagttctattaggcaacacatttttccagatagactttggaatcattatgccaagcattaaaaaccacaacaaaaggaaacaaaaaaggtgaaacagctaccatttggtattgtagtagaataaatatctaaataggacaatacataatgaaagttgtttaaatgtatttttctttgaatacattacttcaaaaaaatatttaattatccaaaaaaaattctatgtgataaagtttaaatttgaatttttaaacatttttcttaaaatgcacatattatctcagcttctaaatataactaatacgttttcatgtcttcagaaataaaaagttattgaacatataatgtagtattttataataagtaggaaaagggctgggcgcagtggctcacacctgtaatcccagcactttgggaggctgaggcaggcagatcatctgaggtcaggagtttgagaccagcatggccaagatggtgaaaccccatctttactttaaaaatacaaaaattagccaggcgtgatggcacgcactataatcccagctactcaggaggctaaggcaggagaatcacttgaacccgggaggcgtaggttgcagtgagccgagatagcactgctgcactccagcctgggcaacaagaatgaaactccgtctaaaaataaaataaagtaggaaaagtattataaaatctcttacaaattatttctttcatttcccatattagtatatctttcctgatagaaggatgttaaaaaaatgtagctattagaattcaaatgtctcattacattacagaaaattaatgtttaaatttaaaccaattttataaatatagccagccctccatatttgtggattctgaatgagtggattcagtcaactactaatagataatatttgacaaaaataactacatctgtactaaacatgtaagactttttcattgtcactacttcctaaataatacagtataacacatattttcataatatttacattgtattaggcattataagtaatccagagatgagttaaagtatatgggagcatgttcataagttatatgcaaatattacaccattcatataaaggacttgaacatctgtgaattctgatattcataggagttcctggaaccacttccccatggatacgaagggatgactgtacactgattttacccaccagtttgagaatgtgacaggagttacaaataaagaagcaaaggtggggaataaaacaatggtttttctaataatcaaaatcaatacatctgaaaatgcatgctaaattaaaaatatacttcataaatagatcatacaattgttttcaaaaacagcatgtatatatgcccatacatatatatccatagatagagtatatgcataaataatactgtaaagtctcattttcatttgctcaatgggcaaactaccatacttgtcagaatgacttaaattctaatattatttaaaggttatatcaatgtgaatgcttgataagcgtgctttattgttttgacattcaaatattcacagacctgcaattccccgagtctctgctccatgatttcatagtcggtgacactaagttgaggtatggagagtttggtttctgactgctggacccatgtcctgatggcactcatggtctcctgatagcgcattggtggcaaagtgtcaaaaactttatcaaaagggaaaaaagaatgagaatcacttaattgtttcacactttgccatgttttcctaaattgtcagcaaactcaattatattactagtttcaaatattaacaaaattagaaaatctgaaaaatatatttaatatgattatgaagatacattcctgctacatgtgtaatatgccagggaccttacacatattacattaaattcacaaatcagcctgtaaaatctatattgttcaattcgttttataaggtcaggaaacagaaaaacagataagggcaggaaacagaaaaacagagaagctaagtaaattgcccaaggtgatacagatggtatttgcagaaaccgagcagggtccaattgtatctgatactgaaaggctactctctctcagtgttatcatttgccttggaaaaaaaatagtatcattatccgaagaccttgatttttaaattatatcatgtcatgtctaattttactgaaagaacacccatgtacgcatgcttagtatatgtatcaagaactctagtaataaccccataaatattatcattcttaattcttataataaacctgtgagacatatacattgttaatcccaattgcaattgagaaaacaggctattaaagaggcatatgtgtatgtatatacttttatatgtataattatattagggaaagtattatatagagatatacagtatgtatatacaaacaagtttatacgttttaaagtatgtatgtgtatatgtatatatatgaaatgtgacttaagcagccacatggactatattgaaagagattagacacaagattgagaacgctgcagagaactgtaaaccataaaaaggacataacatattttagggataatccaaaagaaattctagaattaaaaatacagtaagtgaaaaataagaattaagtgcatgggtttaacagcaaatttgacaggggtaaatagaaaattactaaatcttaagattcagaaggaaatacctggaatgaagcatggagacacaaaaagatagagaacacagtaaaacggtctaatatatatgcatcccagaatgtggcagaagccatatttaaacagataatggctaataatgtttctaaatacatgaaatcacactgcaaagtcctggtttatatcaccacatcaaataacattatctaaatcatattattttaattgctgggatatgaatgtcatttcaatataccaattccttctacactaaatgagaagaatataggaaagtattttgcatgtatttaatgtagtattcagatggttgcgataatcttagagagtgtgttggcaatggatgctgaaatgttagaaatggataatttttttcaatatgtttatattgcatttatttgggaactcataaaaatgttaagagattatatttaatctgagcacttctgatttcttattaaaagatatttgtagtacttaaaatctgttttaatttacataaataatatgtttctctattaacctgatgcatttattttttatttttccataagttattgggggtaaaggtggtatttggttacatgagtaagttctttagtggtgatttgtgagattttggtgcacccatcacctaagcagtatacactgtaccctatttgtagtcttttctctctccccccaaccttccccacaagttcccaaagtccattatatcattctaatgcctgtgtgtcctcatagattatctcccacatatcagtgagaacatacaatgtttggttttccattcctgagttacttcacttagaataatagtctccaatctcattcaggtcactgcaaatgctgttaattcattcatttttatgactgagtagtattccatcatatatacatacatacatacacacacacacacacacacacacacactcaccacagtttctttaaccactcattcagtgatgggcatttggattggttccacgattgtgctggtgtgaactgtgctgctataaacatgcatgtgcaagtatcttttttgaataatgactttttttcctctgggtagatacccagtaatgggattgctggatcgagtggtagttctacttttagttaaggaatctccacactcttttccatagtggctgtacttgtttaaatccccatcagcagtgtagaagtgttacctgatcaccacatccacgcaaacatgtactttttaaaatttttttgattatggtcattcttgcaagagtaaggtggtatcacatggtggttttgatttgcatttccctgatcattcataatgttagcattttttcataagtttgttgaccatttgtatatctccttttgagaactgtctattcatgtccttagcccactttttgatgggattgtatttttcttactgatttgagtttgttgtagattctggatattagtcctttgtcagatgtatagattgtgaagattttatcccactccatgggttgcctgtttgctgtgctgattgttccttttgctgtgcaaaagctttttaatttaaattaggtaccagctatttatctttgtttttattacatttgcttttgggttcctggtcatgaaatccttgcctaagccaatgtctagaaagttttttccaatgttatcttctagaatttttatagtttcaggtcttaggtttaagtctttaaaccatctttagttggtttttgtataatgtgagagatgaggagccaatttcagtctcccacatgtggctagccaattatcccagcaccatttgatgaaaagggtgtcctttctttactgtatgtttttgtttgctttgttgaagatcagtttgtgtaagtattttggtttatttctgggttctctattctgttctgttggtctatgtgcctatatttataccagtaccatgctgttttggtgactatggccttatagtatagtttgaaatcaggtagtgtgatgcctccagatttgttctttttgcttagtcttgctttggctgtgcaggctcctttttggttccatattaattttagaattttttttctaattctgtgaagaatgatgctgttattttgatggggattgcactgaatttgtagattgcctttggcagtatggtcattttcacaatactgattgtacccatccacgactatgggatgtgttttcatttgtttgtgtcatctatgatttctttcagcagtgtttggtagttttccttggagaggtctttcgactccttggttaggtatattcctaagttttttgttgttgttgttgttattttattttattttttgcagctattgtaaaaggggttgagttcttaatttgattctctgcttggtcgttgttggtatacagaagagctactgatttttgtacattaatcttgtatctggaaatgttgctgaattattttatcagttctagaaactttctggaggaatccttagggttttgaaggtaaatgatcatatagtcggcaaacactgacagtttgacttcctctttaccgatttggatgccctttatttctttctcttgtctgactgctctggctaggacttctagtactatgctgaagaggagtggcaagagtggcatatgcatttatttgaattctagatgattattaataaacaaaatccaaaagggaccttataaatagcagtgaagtaaagaggtatttagttacaatgaagcaaatgattgtgtctgagatgtcatttcagcaaatgatctagaaggagaggggactatgggcagacacatggcggtatgttggatgaatcataagcttcataaaatttggtttaattgaacttgaacatgtctcctctttaacttctttctggtctttctgtttaatgaaaactgaaacacttcagtctctgaattattgatctttttctgtataacttctgatctgtccaacaactgaatctcacaggaatcacttcatattggtaaactataattaaaacatgcatattttaattcctccttgcattccaaccctcatcctagttttgtattaaattcatttgaaactggtcatttcaaaaaatctaatctcttggaaattcttttgtagctttaagaaataaacttccaaagattggtttgggaacttgtccatctaatatagtttgtgaggcaagctggaaaaaaaaatacacacctactaacataaatatcacaatttctttttctgattttcttatgtggaatgtaatgacactatgtaatgacagcagtaattgctatcaaggttcaggaaatgcttgacaaatttgcaacggtatagagtatctcatttaaaccatgcaggccagggaatgccagtgaagaattctaaatctgtttcagataagaagaaagaaaaagtcttatacagaagctaatgtacccaagggcaaacacagtatgagctgccccacctactagctggtgagatatctgtagatgctgcccttgtgatcccaacataggagcagaaatagaccagctccatctacggaaactcactttttttccttttatgtagaaatagagattaataatccaacagataagtttatctttactgacagcaataagacaataaacatatccaatctaataacctaccatcttaaaagacctcgagagttctactgacatcattagactcagcacagactcaggaaaaatatggcctgaagatttaacgtttagccaatatattgcttataaatatgtaacttttttctctaaagaaagtattcctatgacagtttctactattcggctgctaaaggaccactttaaaaatgcagatatctttttggttttattagtgaaatatattcaacaaaatgaaaatcaatataagtgattgcaagcttggaagcacgtgctgtaaattattgggaaaataaaaattaagggctcctatcctgcactactgtttatcttgaaaagtaaaaaaaaaaattccattaatatctagacatttaatatagccatgtgagggatggaagtgataaagtataggcaaactgacatctaaaattatagtaaaggaatacaaaaaagaagttttctgcaccttttgtttaaaaactgcttgtctttaactcttaaaagagggaggggctaaagggaaaagaagagagaaaaaaggagagcaaaggacagaccaagagaggcaaagcaagattcttttgtgataacaaaagagctaagtatgaaattagatgctacattttctaatacacatgagtctatgtcaagggcaaaccactttaactggaaagcaaagtaaacagagaagtatattgaaaattctgagagacataactatcgagataaagagataccagagcaatcggttatatataacactttactgaaaaaaaaaatctctcctcttgaaaaatagaactactcagaaaataggcacttaagcatcagagaatgtacaatagagagaaggaagacgtaactgtgccaaccaataaggtagcaactggctacccgtccgttaagcacttgaaacgtggccagtttgagttgagatgttttgtatatataaagacacaccagatattggacagttcatacaaaaagaatgtaaagctatttccacattttaaaattttaattctaagatgaaacaatattttcaaatgacttttacctgttgatctgttaatgtggtttctagaacatttaaaattaaatatatggctcacattatttttctgttggatagtgcttagatagaagctggaaaaggcacccatgtaatccatttagggggagaaagagatgatatgttagtagtcttaatattgacagcatttaaaaacattagaagtcctgttgtgaatatgaaatcgagtccaatttgaattccccattattacctgtggggaaaaaaatgcactgcacatgtgtgaagaagctgaactaatgacatatacctacttcggcaaaatgctcaacttgagcctttaattccatgccaaccagatcccacctttttcctcattccccatgatcaatctaaagtcaaggagataatgcaatcagcaaaggctccaaactttattaaataacatagaccatgacaaaagtaagcatttctctaaaatgtgaacactgacaaaggtgtcaagaaatacaacaggacccatgcatgatatatgatgattaacatactaggaatggtccttcagataattacaagtgcaaggaagtctgagtataacttgaatttctaatgtcaatatataagttgtttccttagtttgaaatacaaggatctttgtgattgggaattcaatcaacattttagcccaatttcctatcaaaatcaatattctatcctccagtcaaaatatgccttttaattacttcacgcctttttgcttatgcaacttgctctgctgaaagtcgctgctgctcaggctccattctcacaaagggcacttggtgtggtctgacatgagtgaaatagatgggtttataggaattttatctaagatcaccatagaatttgttttataagtcataaaactccaatgaaccaactgaaattggggtcattttcataaatactgctctattattcacctcctggacaactgatttattttccaggtaagtctcatttttctgaccaactttgtgtaagtataaactaccacactacagaaatatttattagaatttaagagtttttttcttttgctgaattttccctttttctaaaagcagctctatccacttagcaatcctattttcaaaatatcatgttaaactatttcatatttaactaacaaataataattatgtgtatttatggggtatcatgtgatgttttgatctatgtatgcattgtaaaatattcactcaggttaattaacatattaatcacctcaccaacttatctttttttgtgatgcggatattaaaatctattcttttaccaattttgaaacatagatttttattaactgtgtccaccacgcagtactagagatcgctacaatttattcctccagtctaactgaaactttctatcatttgatcaacaccttccctttcccaaccttcctcttccccccagtctctggtaactacctttctattttctgtttctataatttgacttttttttggatttctcatataagtgagatcatacagtatttgtctttctttgcctggctcatttcagctagcctaatgtccgccagttctatctacatggtggcaaatgacagaaattccttccttttaaagactgtatagtattccattgcatatatatatcatatatagacactggaatatatttatcactatatatatatgtcactatatatatcagtatatatatctctatatatcagtatatataaatcactatatatatctaccactatgcatatatcactatatatatcacattttctttatccattcgtcctgtaatagacatttaggttgtttccgtatcttggctgttatgaataatgctcaaatggatatggcatgggcaacaaaagcaaaaatagacaaattagattgcatcaaactaaaaagctcctgcacaggaaaggaaactattaacagagtgaagaggcagctcacagatcaagagaaaatatttgcaaaccaaatatctggtaaggagttaatatccaaaatatatagaaacctcaaaaaactcaacagcaagaaaacaaataacctgatttaaaaatgggcaagggatatgaacagacatttctcgcaataagaggcaccaatggccaacagatatgtgaaaaaatgctcaacatctctaaacatcagaaaaatgtgaaaaccacaatgatgtgtcaccttacacatgttaaaattagaacggctactttcaaaatgatgaaagataaatgttggagaggctgtggagaaaagtacacttacacattgttggtgggaatgtaaattagtacagccattttggaaaatagtatgaggttcctgtcacataaattttataaatgtgtgtgtgtgtgtgtgtgtgtgtgtatatgtctacatgtgtatatacacagtatgtgtctatgtgtgtacatacacagtatgtgtctacgtgtgtacatacacagtatgtgtctacgtgtttatatacacagaatgtgtctacgtgtgtatatacacagtatgtgtctacgtgtgtatatacacaatatttgcctacgtgagtatttacacagtatgtgtctgtgtgtgtacatacacagtatgtgtatatatgtacatacgtatatgcacacacaacttgtgtacatatacgtatatgtacacacagcgtgtgtatatatatatgtatagctttaacttggcatttagcgagttttcccatgattcttgaggtcagggaacaattcttttatctcacaataagcacatagcttgcttaaataaacatgtctgctatgcttgctcttgatggtattgataaaaataacacaatttttaaaaggaacatttacaaacagtttacctagtttctggagtgaaggagcaatgcaacagattatgtgtctactggaacaaaacattcctttgcctagatgtattaaaaataaaattttaaaataaaaaatttaaaattttaataaagtaaattaggtcaatttcctgaactgcagctagaagagttacctcacatcaaactttgttttaattcccagtctcagcatcctaacagggaggggtagagactaaccatagagcttgaaattgtggccatggagagcatccttgctggctacccttaaaattttcttctactgtctctgtaagaggtaaaagttattttctttcaattctggcaagaatatcttctgtgctacacctccccagatcatcacctcttcaagggttgaaatgatttttctttatcttatcacaactgtagtttaaggttcaatggactctcctctgtgtggctattctttccacaagtcttcctgcttctcctcagacttgtattgcatttcttcttcacataccagctagagggtgagttttgaaaaaatacaactaagggtacttaatttcctcaattgaaattctttcggaaatgtctactgctcttaaaatccaaacctgttatagaagttctataagagcaattctaccctcatcttgtcctaatctttcattgatttgttacattccagcctttctggcctcccttatgtcttctggacatgccaagccctcattcttcacctttggcaatttgtgtttcttttcatttctcctaatgtcctttctccaacttatcatatagctggcacctgcacattctccaggtttggttctaacatcatctccccagaatcacggtttcagacgccaaagtaattataatctgcaataatattcagatattcaattttattatctttctttcaataagctccatgaagacatattgctcttgattttctccaccatgtatattacctagtgcccagcacttttacggcatataccaggtgttcaaaaatatttcttgaatttattagtgaaaaagtgagcaagactctgttctgaaagcaatctaatggtgtagaacagaagagaatcattttgaaactttagaacagtcaaaacactggctttgtcataactaataatgtcactttctccatttttgcaaaactaaaccaaaccaataaaatccctaataattattttaacatgatttccaaattgttaatgaaataaactcaaattatatgaccaatctttttccttctttacattaagaaataaggtttcatttttttctttgttgaaacaattatctacaacagactagatgctgtgtttctatattcatctagcatataacatgagtttactggttttcagtctctagaaaagtattttatcaactgtcatgggaaacaattccaccccctcatcctcccagacctaggcaaccactaatcttatttctgcctgtacagatttgcctattgtggccattttatatcaagagactcatataacatatgatcttttgtgactggcttctttcactcagcataatgtcttcaagggtactccatgctgtagcatgtatcagtactttctccctttttattgctcagtaacactgccttgtatggatgtgcccattttcttcatatagtcatcactggatggacatgtgggtttcttctacgttttggctattatgaataatgttgttatggacattcgtgtatacgatctagttcttacagcatcccatatccatgcttttagttattcaaaccccattagcttacttgtgatatagttgtaataacaaatactcaatgtgtttctctctgagggttaggtaaaatgatgtataaattagttatgcatagagtaaaaagtgctttgaaaatagaattttatctttttatattattttcttctatcacttatgtcaggtaacaactaccaattccttatgccattttccaacactgatagtatattttaaaagccaggtttttgtgtgaaaaagcaagtttaaaaaagtaaagaggaaataaaagtcagtatggatgcctaggcacttctgttagctcttatttcctgcatacttaatacgtccaaagtactgtggaggaatacaagaaatgagatttactccctggtgccagttcggatataatgcatacacatgtgcaattatttgaattaatttcaaattaacaaaatcaactgctatgtaatttcatatgctacatttttcattccatatatatatatatatatacaccatatttaattaaagggttatttattaatctagacaagcattccaaaagggtgaatagtaaaattaaagatgtgtagctacagtggaagtggggacaatttgtttacatataatagcagtgaaaaagttaggaagttttataaacaatcatcgtttgtaggtatgaaatttaaaaaagagaagaaagatgatagggatggatggatggatggagagctgtatgaatagagactatatattattacgtatttatattgtaacatcatagacaaatctcagttatcaaacattgctattctgaacatctttaaagtaaatgataaaaagttgaactttaatatgattaagaggtatatacagattaaagtaaatttccagtgaaatggctcctttgcacaacaattgctgcatagccactaaatgtatttaactttaagggggagttatgtatgtaatgacaagtgaaaatacattattgttaaatatgtcaatatttgaaaatctaggacatttaaaatattttcccaaattgattttgcagaggcacagtaacaagtatactgaaatccactagagggagctgatactatttataaagttttactacctgtacaggaaaataaaccccttagcaaaaacgactctgaagtacaaaaaaaaaaaaaaaaaaaaaaagtatttatcctttgctttatttagctcatttcatttttgtaaaaaatgaaaagctgggaaatgagaaaagcgttgtgtatcactacattaattctggaaatgatattatatggtgaattctttaaatatttacaaagaaaagcaataggataatatattttccaactaatttaagttttagtagtaaacaaacacatgttcctgtgcttctcatgacaaatttgggacagagattttttcagaaaaatacttttatcttaatgccttcaaacccgattttactcaataattccttttgtgtgcacatgaacacatatatgcatgtatatagtgaatcaaaaccccatttactatttcttaaaggtggtcattcatctgtctctgaaaagaatttttgtcttaaaactaagttgatgagtagagatattttggagcagatactatgtattaacatcatcttattaaagcaattcaggaagagacaaaagaaacatcttgaaaaatttgctagtcgcatggcatgaatttgcataattgctccacttttatcttttatcatcaaaggaaaaaataggatttatgtaattatagtgatccagtagtaaaatgtagcccaaagaataatttgtcctttgctgagtttcagttgccacatgtatgctaaagctataatactcttcagataaattgacagaaatattagaagatgcctagcaaatatccttgtatatacagcgagccagacttaattgaagtgtattcatatgacctcaactgctcttttattttcttctatattcaaaacatctgattttgaaatctacaatcccccaaggagaagctattcccatacaaaacatgttttgtttctcaaagtcacaaaattattatgaggacaaaaaaatctacagacagcttatctgttacaccagtatttcgttccttgttaatacaggttgtagggagaatggttccatttacagaaattattgtttcatgttagtaccttctggatttccccacaaataaccattttggaaaatgtcaagttagccattttaggctttttacttacttgtctgtagctctttctctctggcctgcacatcagaaaagacttgcttaaaatgatttgtaaaggccacaaagtctgcatccaggaacatgggtccttgtcctttctctttcagggctatgctttgaatttttaatcgttcaatttgaggttgaagatctgatagccggttgacttcatcctgtgccatagagtatggaaagtaagtaacacgtttactttgcatacattacattttgcaaaagaaggtattaaaaagcagtaaggcaagtttagcttaatacccttcacaaatatctgataagaaacatccatgacagtatagacaagcctctatcaccagccatacatttaaggataccttggctctttgttcaatatgtatcatcctatataatgatatttaaatttcaagatgacataatttagagcattaatgggtatgaatgcgtacagtggaaaaatactatgcatgaccttaaatcctttccataaatcaaatataggtgtttggctgcacccctcttatatcaaaatgatgtgcgcttgcttcaaattttaagctcactcaatgaacaatattttctctttcatttctgcaaaatataaattacatatatacctacatatatgtatatgtgtatactataattataaatatattttgatacaattatatagattatatacacacatataaaatctatataatacttatacatatgtatgtacacacccaaatataaaaatatatctataatcttctatgttttgtatggtctcattacttctcctgaccaaacaggcaaccactgcttttttttttttttttttttttttttgggacagagtctcgctcttgttgcccaggctggagtgcaatgacgcgatcttggccaaatgcaaccttcacattccaggttcaagcgattcttctgcctcagcctcctgagtagctgggattacaggtgcccgctaccgtgtccagcaaattttttttatttttagtagagatggagtttcactgttggccaggctggtctcaaactgctgacctcatgatccacccaccttggcctcccaaagtgctgggattacaggtgtgagccaccgcgcccagccaattgccactttttaaattacggtggctgtccaggtttcctcttgttgtcctggcataattattagtagcaccctgtttcactctcagtagtaccctggtttgtatgataaaatcacatgaacactgctgtactgtcactagctcatgtggcaactgggcacctgaaatgtggctggtccaaatttagatgcatgaaattaccaaaatatgtttaattctgaagattaagaaaagctaagaacataatctcaaagtttttaaatactgattacactttcaaataatatttttgatgaatcaggttaaataaaatgtactattgaaattcaattaccgtttctttttcctttcctaatatagtttctagaccattttaaattacatatgtggcttgaatttgtggctagcactgtatttcttttggacaatgactttcttcacagaattggaaaaaactactttaaagttcatatggaaccaaaaaagagcccgcatcgccaagtcaatcctaagccaacaggacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggattccctatttaataaatggtgctgggaaaactggctagccatatgtagaaagctgaaactggatcccttccttacaacttatacaaaaatcaattcaagatggattaaagatttaaacgttagacctaaaaccataaaaaccctagaagaaaacctaggcaataccattcagggcataggcatgggcaaggacttcatgtccaaaacaccaaaagcaatggcaacaaaagacaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaacgaactcaaaaaaatttacaagaaaaaaacaaacaaccccatcaaaaagtgggcgaagggcatgctattctctacataaatgttttcatgttcttgtttccagtgaagttggaattgtttcgtatttaatacatatataatttgaactcaaagttttcactgccctttttaaaagtgttattatcatggctgcttacttacaattcatatatatgctgtctttagaaaaaaatacttgagggttagttactatttaatatgtaacaacaggaaaattgaaatttaaaaattggaacatgagcccattagaagaaagagaaaatggaaagaattataccaattctgaacgaattgaaatctgagcttcctgaaaatcaaagtgaaaaggcaaaaaaaaagttaatatttatggaggcattcatactctttgggagagagtaacttttgtattaggagaggctgagaaatttatcacataaattctgtcatggttgcaagactaatgtacaatgccacttattctcattaaaaaaacataaatacagctttcagaggaatgtgtttatgtggttataatggtatgagctgattcaggtaaaataatctctgacgattcaatcgttttggtgggtgaagattaaagacgtttagcaaaatggaaggtgacctatatttctctttcaaatataaatcctctcaaaccagtgctagaaagttggtatatatccatggataagaaataagacaagaggtaaagggtaatattctgtatttatagtacagaaatatatacaaataatttgtatgctagatttacaaatggcagcattggcatctactgtgaaccattaagaacctgatttatatttggccagatggagggctgccatttttcccgttcagggggctatagaaagagccaacattatagccaagtgtgctctgaaaaacaaaggggactttgaaactaataaaacatttgggcaaatgttcagttgagaccttaatgttctgagaataaatcatagaagagatacttttcaactgaagtattctgtgtttaaaaagatgtgaacaattagccattatttccataaaaggatttggtttagttggtcctccagagtatggtatctcctttgagtctgtttattctttaaaattatatgcttatctcatggaagcttttgtatttttcacaggaaagggttcatgaattttttccaattctgataaggctctctaacccccacaatattaaaaaccagttctgccgatcattagaatatgagctaaatatgcgctctaatgttataaaacttctccaaataaaataaaacgctgagaaacatgttataatttatttacctatcactaatctcagcagaacagtatatatatttgcccttgtatgaataatattaagcttatcttgctaaatattttacctaaagtgattcttcaaattaatagacaccaatgggtctgagagaaagagtaaggggtgataaggaggtgacaacggaatttggatgcagtaagagaagtattttcccttaggatgacttcctcaacctccagacaatatttaatatataaaacctctggtgatctccatttgttcctcaaatcaagaccaagatactagcaggtcccagaagtcattggtttgtctcctatatacctgactgattcctgtttgtctctcctctcattcatctgcccctctatgttcagcatttacaatggtcttcattcaggtgcttggcctttattgctccctcttgccatgttccttctgcctggaatcttgcttaactgttctcttacctaattctaacttatcacaaaagtctcaactcaaatgttcctccctcaaggaagatgcccttggtggctgtatcaggttcgtttttccctgttactcattctcccaaagctttgcatcttagtttaaaccactgttcctagcaggaaatttaaaaatattgattccattgtttcatatctctcttctctgctttccgtaaatacaataaaagcagagtccatgaatgcccactctaatattcccaaaacttagtgctatgggctgaattgtgtcttccaaaattcacatgttgaagtcctaaccattggtgagactatttggtgataggacttttaagaggtaatgatgtttatatgacgtcatcagggttgggtaagggtggcggggtggggggctaatcccttagggattggtggctttataaaaggaggcagagataaagagagagagaaagaaaaatagccctcattctctctctctgcatgtatacacacagaggaaagccatgtgaggacagagtgagaagttggttatctgcaagccaggaagacagccttcaccagaagatgaagctgaaccctaccaaaccttgatcctggactttctctcacttctagaactctcagaaaataaacctgtgttgtttaagccaccgagtctgtggtatttattgtggcagactcagctgattaatacactcagtagcattcttaaacacattagagacacttaatgtatatattttatgcatgaatgtactgtgtaggtactattactaactactatatctgaatctcaagaatcggataaggtaacatcagatttttgtggcaagaaataatgtatttggattattcctctgattcacaggaaaagcggcattggttctattcttaaattacaaaatgcatctcaatgtagaaattccttagatgtgtgtatttgcctaacaagtcaagtgccttatccaaggtattctttatccaaaagtatactttctgagtttatttcctcagcaaactaacacaagaacagaaaacctaataatgctacaggtccgatatttgaagaaccattaagtccttcaattgtttttctcttcaaaatagctttgaatttctcatcactttttgggtccaataccttttctaaatcaaccttgtcacctttccatgtctattctacctttatttaagccattcttttttacagtatgcaaatgaatctccactccttgccttttgtattaaatgtaatcatctcgatctatcactaaacgttcatcctggaaacgttttagtccatcctctaatcagtttctcattccccgcgaaaagcacatagctcatagtaacaatgaaaacagtttaggctattttcattattatacagctcttgttttcttacacttgaaggcataatcctttcatctctttctcaggcccttttgtccacttacatcttgtttgcccctccagatccactgtccgctcttctcctgttacccaggagactgatatttacagatgacggttccttgtcctttgtcttacgattaagtttagtcagtgaggagccctgacaagattctggaggcagggaaaaaagtgaagtggggtgtttatttgtctgactccatttctatgaggattccttaagccggccatgctgcttttaccatgaggatctgactgtctccttctgagtttctataactgctctctcactgatcctttctggactaaaaggggtaagaactctgatgctgggttactacactatccggtgtggttcctctgtactccagctacattttaaaaatatctttttgtaaagaaaccttcctcaaattatcgtaatttgagaggtccatcagttttaaatattttccttatgtatctagttatactgcatccaagcttgttgttgacccgtgtttctaactatttccatggattccactttttcaaaatgactatgtttcactcgtcacaaagaaagagttccaaagtgagaggccattttttacaggatacatgtggtttccacactcctaaactgcctcatgcttacgcaaaccgacacaatcaattagcgctgtgtaactacgccaaatacaattttagaatccgggtatctacgtcttacatatttaaacagatttctgttgcttacattttgaactttattgcgcttagctaaatccttagaaggtgaacgtttcattactaaataatttgttactgtcttcttggaaattgccaagaaatacctattgattatgctccaaatggaaggagaagagattcttaccttacaaatttttaactgacttttaattgctgttggctctgatggggtggtgggttggattttcaaccagttttcagcagtagttgtcatctgctccaattgttgtagctgattatagaaagcgatgatgttgttctgatactccagccagttaagtctctcacttagcaactggcagaattcgatccaccggctgttcagttgttctgaggcttgtttgatgctatctgcattaacaccctctagaaagaaaaaaataattaaatatatcccctgaacccacagactgaaagaaatgatctgaaagccaacacatcctaattataaaagtattcaccacatgaatgatttcaaaccagatcaattattttctaagatataaatgtgtaaatatgatttcagattattcaatgtgaattatcagacttgcgtcacaacaatgaatatcaatgccatcaagtaataagacataagatgtagaaaattagaatatatgtaaataaaatattaaataaaaacttaaataaaaacaaaagtgctcaaagctctgatgggagctggaaggctgcatgaacaagtaacattttggatgttttcagatacattttacatatcatacatattactcaaatatacttccccaaactaacttacatttttaattttaaaaatgggcttggaaattagtttaaatagtattttcatagttttaaaaagaggaaaaaaaatccaagattattctttatttcatttacagaagattagaaataaacagattgtcggctgggcacggtggctcatgcctataattccaacactttgggaggccgaggtgggggatcacggcatcgggagatcaagaccatcctggctaacacggtgaaaccccgtctctactaaaaatacaaaaaattagccgggcgtggtggcgggcgcctggggttccagctactcgggaggctgaggcaggagaatggcgtgaacccgggaggcggagcttgcagtgagcggagatcgcgccactgcactccagcctgggtgacagagcgagactctgtctcatattgtccatggatgcgaggaagaaaaacaagtactaggaaaaataatctttctaatgtgaaacatttttaaatttataaatgtagaagttgatctcaaagttttaaaatcatctgtagtaataccaaacccagaaaactttatcaagggaaaaatggaaacacaagcatatcattatcaccattaccattctggagtacctactatgtaccatggaatatgctatgtcatttcatatatgacgaacgccagtccaagtacatattattccatacatagcatgaaagcatggcaacatcacgctgtgctatgggttaaaatattcaaactctctaaagttagtttacaaaatttagactttcttagatttattagcttatatagttttcttaatgacagaatataaaagagaaaatatattacatatgatatcatgcatttttaaacatagctacattagcactgataactttcttatactttggaaatactgaatatttaaatgttttatgttccctcatgtacctacagagatctcaaaagaacataaactcactgtaaggttctttctctaggttaaaatacctaaaagttcgaagagtagtttggtagaagagtaggttgcctaagataatctacttttataaatgttcattttacttaattttctggtaatataatttagttaaagggaagctaagttcttaaaaagtctgaagaacgtctctagaaacataaggcctgtggttttgctaacttgcacatgcctcccactttatcctttttaaagactaaaaaaaatatagatgtgaattcaacaactatattattttatcctctttcacttccctctgccctgatagtctaatgttctatttgtcataatgatattaatgctgccaaaccatgtccctcaattcatttgaaacacaactgtaacttcactaatttcaaagcataatgctactcaggatggcggtgaaggagacaaactttgcaaatattatcgtcaactattttcccctccttcttccctgatatatttttaatgagatacaatggaaataatagaatgtaaaaagaatatatacatggctccatatatctaagtataaaagaagtccgtggcctacaggagctacatattctaatatcctcctaatgcttaaggaagcaattgtgacatgctgtttttgatcgttagattttgaggagtgatcaaaaattgtaccaaaatatttgttaagcgatgcgattaagtaactgttgttataaaatgaccacatttggtataaagtgtaagagaagaatatgaaacttcaatcgtatgagcactccgtttgaaaaaagtattatgataaaacgttaacatttctggaaaataaaaagataattagaaaatatactggacagaatttttaaattatgttaataacaaaaaatgtggcatggatctaaatgatcagatatttaggagaaatattttcagcatatgttgaacttgaacaagcagttagaagtccatgaagggtgaaacgtcaacatgaaccaggtattaaacaggcaaaaaagaaatgctaaattaaagggaccgatagactgatgctggattgagtcttattcaacatttgtctaaatgagacgggaacacagagagaaatcactttgtgtccctgagaaaggtcaaccatacaaatcgtagcaaatgaaaaaatgaaactataagttgattttcaatatggatatgttaattttgttaaatgataaaactacagtgaagtaccaataggctctgcagtatccgttaaaatctagggacaggttttaatgagtcattgttgatcattacacaaaactctatgttttgccccccaaaaaatgttgcaatatatcactgtaaaagaaatttaaatggtgaagaaaagtcagctttgtacaaattcataacactgaaatttataatacgctctatttatttgcatattgatctttataactgaatgcaggcaatgaaaatgcagtgataggtaaaagaacgacatctataatagcaaaaagggggaggcaggcagaaaggcagagaaatgaccggtgagaattctggcgttaaagagaccggagttcaaatttgatgccccttactagatgtgtgaaatgggttcagttacttaatttcactggatcttgtttttctcatccatgaaatgaggattaaaaatagaatcgacctcataggatacttaccaaagttctgagttaacatatataacttacttataacaaatgctgacacatactaggcaacaaagacatattagacaatgccatatagaggaaatgaaaaagaatattcagaaaacaagggaccagctctcttgtgtgaaaattagggggagaggaagtcttcttaatgactgaaacaggacatgtataaaaagttaataatactattttaaaattagtcctaattttatataatatatgactaatatgggatatagaaggtgtatttatacattttttaaagaagttttatcaataaccagggatcctttgagaccaggagttcgaggctgcactgagctatgattgcatcactgtattctagcctgggcaacagagcaagagcctgtcaccaactaaaataaaaataaaaagagtttatttgggaatcctggaatattctgccacatttataatcatgtgagattgaagttataaagaaacgaaaacatttcaaaaaaaacgtggaaatttctagatgttactagaaaagacataatgttgggcacagaaaatcagaagtcttgctatgaaggatttgtatgcaaacattgtattaattcattgtgaatatgctgcctgctcaacaagggcataaactgtccttctaaactataaactcctataggaaatgtctccactggcagtatctaatagaattctcagcttggagtagaaagagtataactacactgtactcatgaactcattcaataccaaatcaatagtgtactctatatgaatataaaaattatgagaccaatgtacactgaagccaaaagccatacacaaacaagcacacaatctctcttgtatcaaatttgctttaaaatacttgggcaggggatggagaggatggtcacgttacttactgacactgtcacgttaataaccgacactgtcacattacttaatgtacctctcttcaattaaaatgagaaatgctattacttcaactttatgaattaattgaccatctaaatgccagaactactgttgattttctaagaaagtccattaaaacctttctagaatgaaaaagggttcaaagcgttatccaagtaaatatttgcatatggattttattattatatataattgttttatatgtattccatagaattatgctccttgactcaatggaaaattttaacttttctaagagtttgtaagtgtaaatatctgaaaagttttaagtatcaatcatctgagcatctgttttctaattttgtgttagctatttaagaatacaaatactaacacaccaggcattatgagcaatacttatggaaaccattttgttgtagcacattagaatctcagggataatggatcataatccattcacatctcatattctaaacaacccctgaaatagtctgtgaataaatatattgcacccagaggaaatggatcattacttgaagtgtatccattaattttattacttgtgtacagtgcataacagactgttagaataatgttaaatgtgcaccaccttccatgcaagtacttcagaactgccacttaaagtgaagtattcctcatcaagtatattcatcattagccatgaagccagggtagaataacacaaaacaagtgtttccagagctcttgaattaaaagaatatttggaatagaaacttaaaataaagctgctaataaacagtctcctatttttgctgaactttaagtgagggttattacaagtccatttagcattcaatgtaatagtctaaaatgtaatatagagatattcaaaacctgtgaagacaagttctgaggctaaattttagaggtttctgtgaccacactgacttaaagtaatagcttttaaaaattaatagtatatataaaagtaatacccctagtgagggcaatataaattttactaatatagcccttttgcgtttttattttcaaacatcataaaattaaaaaaagtcagatttttactcatatttgttttggccactcatttcccacaacaacagtgacaacaacagtctctttctttcacacacatggacacacacacgcacatgtctgcgcatgcgagttcacccgtgcatgcacgccgtgctcacacacacccacagaggctcttccttttggagattagacttaaacgaagaaaaatgtgcctgtcaattaaaaacatttattgaatgtgaactctgtgtagagcattatactaagtgtcatgtggagaaagaagaaatataaatcaaactgcccagtactgaggaaggaataagagaagaggaaatatatgcaactgtggaaggctactcattcatgatgaaggggctgggctactacaagtggtacagtctccatgccacatttgtatacagactatttgcaatatgtcttgccattaaaatatatgattagaagacttgctgctactgaaagtttttccagtgatcatgagagttttagctttgagatgagccagactgaccataatccctaccctcacccatctgacaaaatctggttgcccacctcaaataacataattcatgtgaaattatctaatgagctatgaaccaaaatacaagaaaaaaagatagttacttggttaatgttatggataagaagagctctcgtcagtgttatcattctgtgccatttaattacaacagttagcatacttattatcaggtatcaccttaaacactataatctagcactcagggaatgatagttttgagatgttctttagtctaatatactaataattactacttttatttaaacatgtccttgatgtgactgtccttagactcttaattaacacacagaaaactacaaatagaaattgaaaatgaatcacaatttaactaaccctattacataattatagtatctcctctagaaattatggtgaaaggatcttagagactaaagaacgagaacctgagctacgcctacatatgttttcaaataaatgttttgatatggtcatcttttggtaatttcagtattaatatggaaaaccagtttatctaaactaggcttttttgtgttatgcctgattgatgagactgtatgtactcatgcgagaacactgttttacaaaaaggattacgtctaatcctaaatagataaaaacagacatatgtttaggtataatcatatgtatattattttagccctaggttgtcctaaaactccacaatctcaataatacactgaaaggccttggtcatgaaaggcatcagtttaaagactgttcaaattaaaatcttagaaaaccattattagttagcaatattattaaagcattagaaagattacttactatatttaatggctaaatttttctaaatttctaaattatttataacattttgtatttaaattaagaaatgtaaaaataaaccttaaagttatatcacatctttcttaaaaagtaaaataaagaatttggaaactcccttttcaatatgcacagctacatgaatatataaatacatcactagatacctggtctagcctctcacttgccctcattaagttaacagtttcctgagaccagggttatgatccaaagcttacatattgacggtaagctgcatgaaaattacagctatccaaaaatgtctctagtaaaaagaggtactttgcaccatccaatattctgtcacatttatccaaccaattaatgctgacataagaacagtaaattaattttaatgttagttcaaacaaaaaatacagctaagatagagataaatcagttaaaaattataccaaaatttcatgccaaaatgccagaaacgtgatttttttttttagttaacactctccttttagtagcttctctttttagtctatgatcgtgaaagatcacttctactctgaccaaaagaactggaacatccataaggaaaacgtccatgtatagttttaaagcaggcaaggaatttggccaactcatttctttggttaaaaattccaaataaattagtaagaatctcttacggtcaataaactcttaatatacaaattattgctgtaaaattaatgatatggttaatattaactgttttaaaattctgcatacaactcttcacatttgataaaatacagtgaaaataaaaagtatcttccaattgatcataaaacttgtatgtgacactgaaaaactgtacatatgttactagacatactgtttctagaacgtacaactgatttttaacaatactttgcaccatcaaatgaggttcccttctacattgtaaccatggtaaattttgtactttcaacaaccttaacaccctatcctgtcttctcagcatatgtcttaaattccttcaacaaattgccttcaggacaaacagattttgttttctgcattacttaagtgatgttgaatcttcaatgcttcatagacatttagaaacggacagaaatcatttggaaatatgtctgatgtaccatttcaggtcaaaactgaagtaaaatttaagttatgagaaattattttttccatcttggaatttcattctaaaagcaaactgatgaattacaaaattattctaaatttttaaaaagtagtttaatcttagggcaaattattttaagtagaaaattcagtttgctatgcatataccagtatagatacatataaaatatagttcacagaattttttaaaatctataatagctatacttatgctattctacatatttttacactatgaatatatgttaaatattttcactgtggtaagcacacatcaaatttataaatatatacgcacatatttttattagtggcataataatatgagtggtttatacaagagtggttcatctttatcttaacttctgaggaaactatacgtggttaagaggaacagccatttacatgaggtcctaaatgaagcacactgattcagctctcattttcctttctatacaaaaagggcaagaatgtatgtgtcttacgtggttgtgagatttattatatctccatagcctaagcttgggaaggaagattctggacttataaatttaagagctttaatgcaataattgctggactcctagtttacagaaagcttcatttgtctttcagcttcatgagctacaccactcaactgtacttttgggctctatactaaaggagctattatgatttagggtagcagtccctctgaaatacacctgaaggggtacttcaggcacttaatatgtgtctagcttatctcacaatttgcacaatcacagaaaataaatattatgcaatttgttccttgaacgacaaaaacggaacaaatagataagttagaatatttgagcctttaagtaatttcataaattattttatttaatggggaaacagagctatggtcattttaagtagtcatcctagttatggcccaaacttgagcctaatgacgtatcagttcgaccatatctttactggtagaacaaaagggtagcataaaatttgattaacacagtcaaccaaacaggaatgtctcaaatcacacccctaccccccagtgttccctggtatctgccaaagttagcattttccttcagatggattattattttcacaccaaaattaccaacgttattacctcaacgactgccttaattttgcttttctaaacagaatctggtcaattaatatttactaagcacctactatgtgtcctgacttttctacatgcctccaaaaattagaactatgagggaaataatcaagaaaattaatattctcactagtcacacgatcatttaaatcctgcatgtagttttacttaccaaaaattaaaaatcattcccgtaatttctaaatgtttaaattatttctgattaattcagtgtaggtaagcttgatatataactatgacatgagaccatttaaagtatagctcttgcatcagcttattaaaatgaaaaagtgataatacagtttctagggggaacttacataacaactaggagaatatttttagatcacataattttatttaacatgaatatgctgttaagttgatcagttaaaattaccaagcaacatacatctaaataaaaatctactggtattttcattacctgttcttaaacttgttcactcaagtctcacctgttatatttgtttgttttcatttttaaccaaatacagtcagtcatgggactcattagaagaagaaaatgaattgattttctaggaagaccactgaacttttgaatgccaaatttgcaattaaggcaaaaaataacttatacacagaatttatgccccaaaatgcaggcagattctgaaaaaagctgacatgcacaacaaaaacatttgttgtatttatttatgatgttcttgtaaacgtcttctacaaaatgaaaaataatcttatttggaaatagcattatccctgattttcgtaaaattttatctggaaatatagtagtatagcaatgataatttgaaagaaggttgtttacatatcatgtcaatgacacatttggtacacataacttttgaggcactgagtattagaaaagattaattttaatttattcttgaaaaagaaagacaaaaacttggctagctttgtgcttttatctcactctaaaaaagttacttaaaagtaaaggttatcccgaagagacttcttttttaaatgagaggaagtgataaaaagtaacacagaaaatgtcatatatattattacaaaacaggaatgacggtaaaacattccatataattttagtgtttggaaaaacatattgcaaaaatgatttaaaatcagatgatgatcagttttacacatataacatgactgttaatgttttcaaatttctgttaaccttattttcttaaattatttggataaattctagcagatttgcattaaaatttatttctctgctacagactgataaaatattctaccacatcccattttcttccaatgaactcaaagttgaatttctcctaataatttccttagcattaaaaaaagaataataaaaaacatacaaacaccttttaatttaaatttgtatttaacaagtgcttgtctgatataattcagctgataaatatgaacctatgtgtttatcaaatccctaagaagattatctaaatcaactcgtgtaattaccattcaccatctgttccaccagggcctgagctgatctgctggcatcttgcagttttctgaacttctcagctttttctcgctctatggcctgcagcatgagagcaaagatgagtaattcaatacaaggactgtgaatctacacaataattataacttctacttgccctttcaagccttaagatgtttcactctgtcagcttatcacgtgaatctaaagactttttctcaacacttttgccatcaaaaacatcaaaatggcaataaaagcatgagccattttcatgacttgctacaacttttaattataagatttctactcagcttttttttacattatagtttctgatacatttcaacgcaagactgcaaaaagtaaaaaggcaattcataacaatgaaagataaagtgtcacataactaaaatgaaatttatcttttaaagatacaccattgaaattactaataagtatataggcggtattaaaaatcaaattgagaatccagtatgtatataagatggaaaaaataaactaccataaataatttagcagaaatatataatatatgtacatatatatttaaataccaggctgtaggctaatttttctttcaaaaataatcaaagtactcctatttccaaggaagacaagattgagtttcaaaaaactttctgaattcctttatttcccttaagagttacattttgaaccacaaatgcaaaattatttcagttaacaatagccagaatttcatactattgagtttagctaataatattcctatggagacataaattttaaactatgacagagtagaactacattactataatcatcaagaagtgttgactataacaatgtgtatgtcctaaaacataactattcaaataactataacgcaattaaaatatagtaagaacaacacacctgtgacttaacaatcatattataacaaagatttctcttgaatttgaggcagaaggttattctacatgagactattttttaagacttcatttacatccacaggcatttaaaaaaatatttccaggtaaaatactggagtacagatgggagggcaaataacagatacatggacagtctgcaccactgttgagtataaatttgtgcagggatggaaatgatctgtatctgtgtcatccaatatgatagccaataaccacatgtgggtattcagcacttgaaaggtggtcagcatgacttgaaaataaaagaatatttaatttaatctaattttatttattttaaataatttaaaatttaaaggttacatgtgaccagtgttaactgtgattgtacagcgcagatctaatacattcctttaaaagcaaatagttaagagataggcctgtaatccgagctactcagaaggcctgggcaggaagactgcttcagtccagggatttgagatcagcctaggcaaaatcgagagacctccatctctaaacaaacaattttaaaaaattagtcaggcgtggtgacaggagcctgtagtcccagctactcaggaatctgaggcagaaggactgcttgagcacagtagtctgagtaggctgcaacgaactatcattgcgccactgtactccagcctgggcgacagagggaaactctttcatataatatggcaatatcagaaatagttgcagagaaaaagtaatcatctagacaacactatttactaagcacattaaattatgtaaatgcttatacaataatccacatatttttatgtatctgaaaagactatctaatttaaagaaatagctacaaatgtaaagctttttgtttttgtttctctttgagacagagtctcactctgtcgcccaggctggagtgcagtggcatgatctcagctcactgcaacctctgcctcccgggttcaagcaactctcctgcttcagcctcccgagtagccgggattacaggcgtgcaccaccacgcccagctaatttttgtatttttagtagagacagggtttcaccatgttggccaggctggtctcaaactcctgacctcatcatccgcccagctcagtgctggggtggggcggggggattacaggtgtgagccaccgtgcctggcctgaataaaggttttcttaaaaatttattttaaagagtttcctaagtgggagacctgacgatatctgacttcaaggcttgatataaaactgcagtaatcaagacagagtaatattggcaaaagaacagacaggtaaatcaatggaacagaatagaaagctcagaaacagatccacataaatataatcaattgatttttggcaaaggaaccaaggcaatacagtggagaaaaagtctttaaacaaatggtcctgaacaacacaacatctacatgcaaaaaagtttatctaggcataaaccttacacccttcttttgttttaattacaattatttaattccaatttatttactttcatgttattcactggatcaacttcattggaagtttatacttttgatggtgaaatatctgacattattgtgaattttatcacaaattcactttaaaatttcaacattgaatatatctgtacaaatgataacatgggctgggtgcagtggctcacacctgtaatcccagcactttggggggccaacgcgggtggatcacctgaggtcgggagttcgagaccagcctggccaacatggtgaaaccctgtctctactaaaaatacaaacataattatctgggcatggtggcaggcacctataatcccagctactctggaggctgaggcaggaaaatcccttgaacccgggaggcagaggttgcagtgagccgagatcacaccattgcactccagcctgggtgacagagtaagactctgtctcaaaaataaataaataaaataaaataacatgaacatatatttttgtggaacacagcattatggttgaaaaccatgttttcttggatacacatggatataaagatgggaacaagaaacactgcggactactagagtggggagggagtgaggggaaaaggtccaaaatagtagctattggatactatgctcagcaccaaacctcagtgtcacacaatatacacacgtaacaaacctgcacatttactcttgaatccaaaagttgaaattataaaaaataaaataaaaatgaaaaataaacataccaaaaataaatacatttccactgaatttagaaatttgtgtaactgcttgaaagtaattgtggtgttcatataattcataaagttaattaataatgaatcaatcacagactctagagtaaaatgtaaaactataaaactcctagcagatagcagtggagaaaacagaggtgactttgagtttgttgatagttttttagatacaccaccaaagggatgatccatgaaagaaagaattaataagttgaatagtactaagttaaaaggttctgctctgtgaaagatgctgccaaaagaacgaaaagaaaagccacaggctcaaagaaaatatttacgaaagacatatctggtagagaattcttatccgaaatacacaaagaactcttaaaactcagtaacaaaaacaaacaaactaaaacatgggcaaaaatccttaacagacacctcaccaaaggaagtatacagatggcaaataagcaaatgaaaatatgtttcacatcatatgttaccagggaattacaaattaaacaatgagataccactacacacctattagaatggccaaaatccaagaacactgacaaaaccaaaagccgacagagaaatggggcaatgggaactctcattcatttctggtggcaatgcaaaatggcacagccactttggaagacagtttggaggtttcttacaaaagtaaacattctactatatgatccagcaatcatgcacttaggcatttacacaaaggagtcatatgtccactcaaattcctgcacatgaatgctgcagcagctttgtttgtatttgccaagacttggaaacaatcaagatgttcttcagtagatgaatggataaataaactgtgagacatccagacaatggaatattattcagtgcttaaaaatgagctatcaagccataaaaagacatggaagaacttaaatgcatgttactaagttaaagaagataatctgaaaaggctatatattttaccgcaggatttcaccctagattccaattccgaatatatgatagtctggaaaaggtaaaactatgtaaactacaaaacaatcagtggtttctagagattaggagagaagtgtagatgaacgggaaaagtattgaggatttttatggcagtgaaattacaccgcataacactctaaagataaatacatgtcattgtaaatttgtttaaactcacagaatgtgtggcaccaatagggaaagctaatgtataaactatgaactttgggagataatgatgtgtcaatgtaagttcatctgttgaaacaaatataccactctagtgggaaatgttgacagtggggcaggctatgtatctgtgggagccgggttatatgggaaatttttgtaccttctgttcaattgtgctgtgaacctataattactctaaaaatggagtctattaaaatcacaaaaaaaggtttcatgaattaggaatactggattcaatatcaagagtacaaaatgctaaaaaaaaaaaaaaaagccaatcattcacagaataaactccatcaggaatagctgtaatatataaaatactaattaaaactgagaataaattaagagtaaaatttaaaaaaaatctataaggtagtaattttgttttattttcttaaatacctatctcttagctgaaagatacacattttacatggtgctctgaagggcaacaaatgaaaactcagttttgtctaattagttaagaaactctgaaagtgacagacactttttaatatcttacattccacttgaaaatttcaaagcacccagtttgtggtattttgtgattttatgttcccaggatccctttccaattagcaggtaaaacttctgagttgtcttgaaattcagtttcacaaagacagtattgaattgtttccaggaacgtgcacaatcatggatggttctaatttgttggttgaactgaaaagtccatgaaaatagagtagctacaacatctagttaaaagtaagatcctagatgaagctccaatatttctattttctcaacttattagtttttgtgatctaagttatctgtccttagcagcttatggcatacttgtttttcactacttacatttattctccattaaaaggtaaatgttatatggaaagcaccctgagcatcttagaggagaaaaaataagcacatttaagtaaatatgtaatgtaaatatcaagaaagacaggaggatttggggtgtccagaatttgaactttatccagaaaacaatatacagatgaaagaaaaaatatataccacaatacaacacataaaggaacaatgacaacaagctgagtaaagtgatgttctttgagttacttttagagttatcttctcctatcagaggggtttctattttatctacattgagcttttgctttagtttttgtgaaatgatataaaaagtagaatgagaacactatgtggtctttataaatattgaaaataaattatcaatagccctctaaatgttatcatcataatctctttattctaagcttactagaatcaattaatattactaacagagaacaaaacttatatttgaatatctcaggaatcatatttgacctttaatatcttgttaaccacattgttccagttattctaatataaatagtctcagtaacaaccaccacaactacaacaaaaacaataatctataaagtaggtactattactttcccattttgacagaggagggaagtgaggcacagagaggtttgtgaaaattttgaaaacaatgcaatagccacattgaaaataagattccttatactaccaaattatagtttatgtacataatttccatatgtatgtcataataattgtaagaaagaagaaatcagcattgttgtataccattttatacaagagaaaactgagcatcagtaagattaaatcgtatatcaaaggtcatcatattaggaagttttagattcaatattagaaccctgctcttctacttataatttcagctttctttcagacatgctctgctgttgctaggggtatttcaatggatattattcaaaaaggtgtgagcgtatcagaatatatatcagagcaaacagagcttatagtttggatgtattagggatgttcaacatatttaactattaattcagcagggccaacaagatatcacaaggaatgccgggtcactcagaatggtctctgacagtctataggctgattaccaactctgtatacagctcaaataaactgaataactggtgcataaagagacacatagaccccagaaagaagcagtcaatggtatctgcatatttgtcaatgttcagacgatatctgggttctgttagggcacattactttcaagaggaacattgcaaaatgaagaggaatatgcatacaagtatgccttgaagagtgtgaatgagacagtgaagagcccagaaaacatttcatttcagacacagctgtagatagttgattaaaaataataaaatttagtataacaaagagatgttaaagaagatactacaacaaaagggcctgcagtcaccctttttgctctgctgttatcagttctgtctctactgcttactatctgtccctaataaagtacttcgacctttctgaacctcagtatttcctatgtaaaatagcaataaagatacctaccatgtgggacttctgaggggattaaaggaagctcgctatttatttcccaaaatgagatagtttttatagtaaaatggggagctaggaataattaagctgagaaaaatggtttgacataagctaagactatacccgacaaactgaaatatgtgctcattctacttaaaggtaacttcaataatcttaaaaagaaatttaggaaactttttttttttttctttttgagacggagtctcgctctgtcgcccaggctggagtgcagtggcgcaatcttggctcactgcaagctccgcctcccgggttcacgccattctccttcctcagcctcctgagtagctgggactacaggcgcccgcaaccatgcccggctaattttttgtatttttagtagagacgaggcttcatggtgtcaaccatgatggtcttgatctcctgacttcatgatccacccgcctcgacctcccaaagtgctgagattacaggcgtgagccaccgtgcctggccacggaaacatttttgacacaagagatgatgagagtaccttgttcgtggaaatgtccaaataaccacatataaaaagtgttaaaaaaaaaaaaaaaaaaaggttaagtaaataaacatcactgaaaatcgccatttctcctgggatctggccacccatacgttcgtcctcaaatgaaatatatgaacttctgttttcaggtaggttggatcagtagttcctaaaatttctaccgtctcccattaactcacagaaatatacattaaaaagcacagaaaagcacaaaaaccaaaaacaaagtctaaagagatatattttgctgaaaaaggaagataactgtcctcattttaagtgactgtgtatcaacaaagaggaacataggccttccacaggtctatcttgcaaagtaaaaactggttcaaaacaaaaacaaaaactggctctcacatctattctcttactcagtcccatcaaaactgctcttatcagtctcaccattggcccccaagctactgcattcaatgactgatgttcagttctcactttacctatcaccatgatttgattgagaggattcctttttcttcttagaagtatttgctaatttggcttcacgtactacttgaacacagttttcctccaacttcagaggtcacctttcctccatctcctttgcaggttcctaatcatgtccctgagctcgcactttggagtgtcctaggcctcaatctgtgttttcctttgtttaggccaaaaacagaatcctccactcccctctctctctcaagcctcacattcaatccatcacaaagtcctgttggctctaacctcaaaacatagccagaaagtgagttatcatggtgctcactactaccacattagacaaagtaccccatcatctctgaggggtatgaatgtttcaaaataggatactaaaggtctttatatttcaccctttgttctctgattatatattatcaacacagcagacagagacaacaggattcagctcaactcgctgacagctgaataaaagctcaagtccttaccatggtctgatcttaattaacttccttaacctttctgaattcttctgctgctaaacatcgtgatttttctgctgcagccacacgcttaccttttccctgatgctacaggcatgctgctgttacacggctgtgcatttatttttccccatgcctaaaaaggccctaaattacttacttggacattttcccccatcaaatgccactttttcagctaggccttttagtgccactctgtctacaagcacatgcataccctctcattttattctgctccttggaacttatcactaacattccacatgctttacatattagtcttgcttcatttccatctttcccactagaatgtaaactatataaggtcaggtatccttatctatatccttctctactctatcccaagtctccatgaaagtggctggtacattataggtacataataaggcgagctctattttagcgtaacgcgtccatatacaatattatggtctctccccttacccacaatgctctcttaaagtgcaaattcataacgaactctaatagctttatataaagtggccataaaaccagtacatggggacaggtgctgcaagctcagtaaaggaaggatggattaaatcaaagtattctagaaactgcatattagttagggagttgggcacatccatcttttcttcagctcaagtcctgatactggtaataaaccaatacctaagtagaaaagaaagagtaccatatacaatccatgagtcaaaacttggtagaatcttacctctctgtttttatttcatggctctgatcttccacctcctctctctatgtgtgtgtatgtacatatatgtacatacacatacatactgtatatatacccctttcccatgttttcaagaccaagggtatcatctgaatactcttcaaccacagtcttcattttcttttatatatttcatcttcaatgaaatttggactaatattaccatattagtccaaattccagtatttcaatattactccaaatacctacagtcagacttcagccttcactactgtacaaaaagttattttgtgaaagtcattaatttggccgggcgcaggggctcacgcctgtaatcccagcactttgggaggccaaggcaggtggatcacaaggtcaggagatggagaccatcctggccaacagttgaaaccccgtctctactaaaaatacaaaaaattagctggacgtggtggcacgtgcctgtagtcccagctactcgggaggctgaggcaggagaatcgcttgaacccgggagacagaagttgcagtgagccaagattgcgccactgcactccagcctgggtgacagagcgaggctccgtctcgggaaaaaaaaaaaaaaaaaaaaaaagaaaagaaagtcattaattttcttcttgttaggaaaaatgcttcttacaacattcagtactgataaaaactacaattacctcctcgaaattgccatgttcataaaaatacctctgcccttgacaatattatctttctcttaaatttcgtcctcatgaagtcatccagcttttctgtatgtgtgtttttctatagagctgtttatcatatatgtgtctacatgcatatacatttttaatcttgaaaggatctatatttcataacatacagtttttaaattatgctattaacatatagaatactaaatactttactcaatatatgcttaatatatgatcacatgtttagaagccactactcggattctaaattatttagtacacataatttcaagtaaagtatacagaagctaaaaaaggcatcagtaaatcaatgtatcagaaatgagtgattattgtgggctcatgaaaattcttagagatcatgaagaattataaatactaaaatgggtaacctaaatgcaaaataaaaggcaactaagttatataatattcaataaaaggaagaaaagtaaaataatttgaagcaaagaatacaacacagggaagttcacaaattcctcaataagttgattaaaacctctttcagacctctgttcctccttctttattagcacctcttaaaagcctcctctttctgtatcttctctaacattatgaaaataagttatggatctctatcagtcctactccgacattagaagtaattaagaatctactcatttaacattctataatgaagttttaccctttgactgaagagtaacttattcactcaaatgtttattcagaagttgttctatccttcatattggtaatagatcctatcttaaatgcaactgcagaactgaaaaaaatcacatatccatatagttaaacatttattggtttgtgtgttaggcatggggacaccaaaaacaaaacacacacacataaaaccaaagccacttcacgttcaagtcctgatttctagaaaccaacaatggaattgaaatgaaaatggctagaaattagtttgtgcaagtaaacaaaaattagatcattgtaggctttaagagggcaatatgaagacatggactttgtcaacactcttcagacaaagaccactggaacatatttgtaggttatcaaagttaacctgatttacacgctgcaacgagagagacagcgcatcacagggaactatggggctgtctctaagagtatgttagaaaaagcttattttaagatgtgggcttgtgttacatgatagggggcatcaaggaagtggggctttgttttgattggatgttgtaaggaagtagggtaattctatgttgagtgtcctaaaatttttatctagatggcaggaggaatgcagagaggctaaagctgtgtttagtaaagaagcataatgtgtcacattaatgaagatgagggatatttggtcattaggcgtggtttggacaatgctattcttttttactgtattaagatatgattacaaagtggtcttgcttttatcttgattcatcacaaccatagcgtgtccctgtatgatgctggcatccctagcaattatttatattcaaccagagaacatcagactggctgcaagtaccaaggcaacatctagcagttccaaagcctaactgaagtgccaagccagctcctggctatcagtagctgattttatctttctcaaatgattataaacacagacataacaagatcatactgaggttttaatatgttcgctttggcagaggtgatgtggaaacttctaaaggaatataacattagtagcagggaagaccagctacaggattgtcatcttaaatagaagtaagccatgatattagctttaatcagggttttggtgatgggaatagagagaactggacattttcaagagctgttaagggagcaggattaattgaacctgtcaaagattggacttgtgaatggtagaagaaaaatctaggtgacccagttcactttcaggtttctggattaggctgtttgcagggtgaaaggaaggagaaagaataaaggaggtctggggaaataatgagatttaagatatcaggcaaacatcaattaaaattgtctattaggcagtcagatatatcaccctgggttttaagaaagagatgagctaaagatacatatgggagaagggttcatttgaaaatagacactatttgaatgggaatgaatgaggatatccagagaagaaacacaaggactctgaagaatatcaatattaaagaaaaactgaattggaacaaatggccaagaatgtgaaagaattaatcaggagaaagcagtatcccataagccaagcgaggaaagaatttcatgagggaaaagaggttaataggttctagttctacagagggattgagtaagataaggcacgttaagtattcacatgcatgtttataggagaggacacgttctaaaagatgaaaacacaaccggtttaaaagctaatgataaagacctgggatgtagatttttgacaatctggatatacagctgaatggaaccaggtggcttaatacatagtcagtgatgctgctgagaacacacacccagagatgagcctcaaccaggtgaaggatagcctcttccactaaggcaggtggaaaaaaaaaaaaaaaaaagatactatgagcacaaatacccacaatttgagaaatattatttcgactaaagtaggagatgaaatcatttactgtgaatgatggggaaagtttaggtaccccacaaaagcttgaaataattgttgagagaaactaagttgaaaatatacttaggatgcacggaaagcttatgaagaactgctggttttgttaaaatatgttgttagtgccgggcgcggtggctcacgcctgtaatcccagcactttgggaggccgaggcgggcggatcacgaggtcaggagatcgagaccatcctggctaacacggtgaaaccccgtctctactaaaaatacaaaaacttagccgggtgtggtggcgggcgcctgtagtcccagctactcaggaggctgaggcaggagaacggcgtgaacccgggaggcagagcttgcagtgagccgagatcgcgccactgcactcccgcctgggacagagcgagactccgtctcaaaaaaataatcttattaaagaaatggagtaatgcctgacaatgacaacatctacatacatacaatcatgacagcaggtagctgaattgaggagatgagagaaacaacagcttttagtgatagcaggagagcccacagggatgctgaaataactaagaatgaaagaacaaattggttgaaaaaatctactaacctagtgccaaagtcttcaatgagaaaatatgataaaatggtagataagagatggccagaagtcattaactgcaaggaaagaggtatttttacatgaagagagcagtatctttggaattgtctctgttaggtgagggagtcagtcattctaaagtagtgggggtacaaaagagggatgagtcatagtgctgttttcgagggtaaaattggtttccacgtatgagtagaataagtatatagaaggcttgtcttgaaaaagtgtttgagcctgccgagtgagagtgtgggaaagcagaggaagtgaagcaaggaaaagaaagtgcaatagagcagagagagaaagatagaagaaaatatagactcgaggtacctatactctgggtagtaaacacagataacagagataggagaaattggaagcattaactggcttgatgatttccagcgggagttggtaaaaagttgattctgaaagagggtaatcaagtgcagatccgaggaagagcccaaagccagatgaccataacgacttgatagggagggtttcaagagaacctcacagaagctccagattttcagacaccttatcaaatccccttgtgatcaaaggaggctattttttttgtttgtttcattaccaatttgcgttaccatgtgctcacggaaaaaattcgagttgttagaatctgttaattcagctaaaaagtctgaactgcagtgatactaaaagaatgtgagaggtaactgctacgtaaagcccaagattgtgtcctagaatattgattctcgagcctttatgtgcataggaatcactcctggaaaatgttcaaaggcaaattttgatttactagttctgagattctatatttctgacaagctcccagataatgtcaatattggtggtccagggacattttgattagaaaggtcccccagaagtcagcttttaaataagtgcattttgttaattatatgaataaaacacatggtgaatatacaaggaaaaaattatgcttaggtttaaaagttgcattttttaaaatatgtgaaattgaactgataatggcctatgatatgctaactggctaaaagcatttgaaaggagtaaatgaagaaatcaagtgaaaaaaaaaagagttggtaatatttagccatttttaatgaaagcctaaaaatggattaataccactcaagttcatgacacgagcctgccatgagtttaaaataacctatataaaccgacaggtgatgtagtaagaaaattaatggatacctaaactgaatatccatcatcgtaattatgtatttctctcaaggatttttaatacatatacattgtatttagcctgagggaaacatcaaggtaaatcatttcatgtcccattttagtaggcaattaagaatgatgttgttatttcagaaaatgagagttcaggttgataaaggggactcacaaggtatcagaaaaccagttataaaacactgtacatttttgagcacttttagtctgtcatgctcccgctattgataaaatgcaaatcgttcataggtaaccacatgataacaggaacttttaaaatttatattcctgaaatactgaaactcaattttcctgcctgatcaaagctgtcttaagataaagaaacagagtatcagacagaaacctgtgagaatcagatcaataatcatttttaattagctaataaaatgctaaaggtgattcatactttcagtggtcaaatatgtaacatgatgtttgaaaattagagtttaatgttctctaattaattttctactactaagagaatttccctcaaaaatcacagcaaacaatttaccttcaaagaagtatacttgaaaaaagacatttagctaattttctacaattatatattatctttcagttttcatatttcccatttcttgaaacaatttagaatagtctattataatgctgacaacagcatgtcttataaagctaataagtaatttaaaatagctttccaatttataagtagttaactctaagaagaactggtgacaaaattgtcttccctttttcaagcagcctaaaaaatagattttttttccagaatatatatatatcttttgttgatctccaaaagttccaaccccaacagcaaacattagcttgtaactgaggtaatgtcgtatttgtaaaaatacaatggattttgaacttcatgatttgaatcctggagagaaaaagcagagctaatatacacatttagatgtgatcttcccatggataaaattacttttcattcataatcactgcttccttagcttgcccattttatttactctgcctgttagaaattattttacaaactgttgccaatcatatacaaagatgcatgttttataattgttgaagttgaaaaattaaagccttgacaatttccctaaagatgaaacactttatattaaattaataaaacttcctatttgtgaaggtcaaaattataccatctcagaagggaataacaacaacaaagcatctgctaccacatgtaaatactgagaaaggctggacaccttttagataaggtaatacacaaatatctgggaaatttaaatatcttataatatatgacagggattgatgactataaagaataactttttgataacagtgagaatatagacatagtcctaagtatggtatctattatattattctattctattttactctattctactctacacaattgtgcaagcttgctaaggcctagccttgaggtaactgaacaatatatgaaaggaatcaacatgaattaatgtcataaaattgttaatttatagttaaataatatgtaagttaaggcaagtttatgaaaggcatccctagtcagtcacagaagaatccagaaagatttctctaggctaaactttgattttgcttgctatctaaaatatatttttaagacatattaaacagcattttatcatatcgcattaatctatcaactagtagaatcacagataacaaagcacggagtttacaagcagcacaaaatgagtacagatataaaaattaatgcataacctacattgactttttcttttaagtctgagaagttgccttccttccgaaagattgcaaattcaggactctgcaacacagcttctgagcgagtaatccagctgtgaagttcagttatatcaacatccaacctaagacagcaaaaaataaaagtcattatttcttgattatctctttcttctatattaaaaaaagcaatttatccacatttatcattcttttctcaatctgagactcctgcctgacacctctattagtattaatagcagcactattttccctgttaggtagactcaaatttggagtcagctttgatctagagtcttatgatcacagaggtcattttattcacctcaatgtaaaaatcacttctacaatatatcctgtaagctattacccagcctctgcttgaatgtttccactatttgaaaaagtactacttcccacgataaccttttctttttggaaagtatttatgagaaaaaaaaaattcctgttggtggtcaccattgaaacacatgcttttctgtagtctccaatcatactgcctctgggtttggccacgtgactttctatcacaaatgggacaatagtaagagtactgcaagtaaggttttgagaagtgcttgcatgtcagagcttgactttttagagcacacattctgagaagacaacaattatataagaagtacaatgaccttgaggtgatcatgttttaaggaaacttgatctgtccatgtgaagaggccacatgaagaagcatggggcaccaggcatgcaaataaagccctctgtgacccatctcaatgccagctgaagacagacaaatgagtgctccagttgatgccacatagagaaaagaaatacccaaagggcactgcctacgttgaagaattaggagaaataataaataggtgctgttttaagccactacattttggtgtgagttgttatgctgccataaatatcagatcacctatcctgttattttcaaacctttttttttttttttttttttttttttggaagagatctttggagccaccagggataaattattcattctaatctggtgatttaggtatagaagagccaaaatatggaatcaacccaagtgtctaatggaatagtattaagcctttaagactatgaatagcctttcatttgcaacaacatgtatgaacccggaggaaattatgttaagtgaaataagccaggtgtagaaagacaaataccacatgatctcacttacaagtggaatctaaaaaaaaaaaaaaaaaaaaatcaaactaaaagaaacagaagacaatgttcatttccaggagctggtgggggtggagagtagttggaaagatattggcaaaaggatacaaaattataaatatttgaaatccgctctttaaatttatcagtagatacctgatcatcagcctaccctatgcttaattacttcaacggatattctatggcttgttgttatcttagtttccttaaattgggtacttaaagggaacatatcagcagtgtgtaaaataaacagggaagaataattatctttctggtttataatactttcattgatatagcccatgatttcaataaatattttcacttcaatattagactttcaactcacattgcaattcaattgacttaaaacttctaggaattttttcacataaactatcattaaaccagttatatcacaacctaattactatcacaaacatatgacctgatctattgaactccagttttgggactttgaatcatataaaccagttagaatttctcacatttgttgcaggctattgtttaaaaattaaacagatacagaaattaatggaacacaaagcccttagaaaaacatattcgcattttatattctcacaaaattctttggttaggtatcaccaattccagctgcccataggatgagatggagcttcagagaaattaagttaattgacctcaataccatgggtcagaaacttgacggttcatagcatacagattgagttgttatttatcgaggctatccaacttgaaattaagagactagggatcctgattcctctaaatcccatgtcactgaatgtcagtaagttatctgtgtatgcattacaaatgtttatggatttttattgtgtcatatatgatttttatctttcctacattttttatccacaagtttgactatcaggttcctgtttcttcattcataatgttgattaaaatatacagtacaattatatgctgtaaaaatctttcacactctcttcagcgatgttaactccttaaatactctcctactatggttatttgattacctacccaaaccagtgaattatatttcaatcatcttttatgcatatttatcatcataatgtcttaaaacatttttatttttgctttggcccaacataaaatttcctgtgtctctctatctgcaagcatctatttgccagtatattggacagagaaggagtgctggaatgttaatactttaggggtgtcccttaaccagtgagagcttggaattggtgaatttcccagctcccttgcccctcagttggacaatcctgaagtatgatacacagtgtctcaaggggttccctgcatgattgagccccagttccttccagcagtaacctgatccctatatttgtgccatactttattggctgctttatttttcttatttcacttccctactttgtttcctgggatcactttccaaataaactgcttgcacctaaatccttctcttcagatctactcttggggcaacccaaactaaggcaataatcaacagcctcaaatgaacctagcatcctgccatacttttttttttttttttttttcccaagttgggctctaagtctctacaggaactattaaaaccttttatcaaagctctggcccatcctctttctgcagctctctcagatgatcttgttccctaccttacagaaacaagtgcaattatcagagtagaacttctttcacttcctatttccaaacaccatcagacccgcatatgtagccaccgttctcattcccttcttttacatttgagtttcccttcttttaattaaagtcattcccactacctacattttgaactttattctcttacttttgctcaagcatctgagtccatccaatttctagtatttgtttattttgagacggagtctcactctgtcaccaggctggagtgcagtggtgcaatctggtctcaccacaacctctgcctcccgggttcaaggaattcccctgcctcagcctcccaagtagctaggactacagttaacactgttgaccatactatccgtttgtaatttttcttcctttggcttcatgatgccactctattctaatttgccttctatttctatgaccattggtaattttttctttgcaggtccatcctcctccaccctatcattatgtactagatgtcaagacctagttcattaccaatcatcttctactctactatctctcaccagaaaacacatcagtcatcatgccttgaattgcaatctatttatcaatgattctgatatgtatatctctaattcaggcacttgttctgaattccacagctatataaccatctgcctattggatgtctccacttgcatgctgcaaaatctccttaaacattatatgccaaggtttaaagtttgatcttctccctcaaactagtactctatcagtattccccagatcagtaattagcatcaccatccctcatatttgttatcttcatctccgctatggactgaattttgtgccccacaaaagttcgtatgttgaagcctaattcccaatgtgatgatattaaaagatggggcatttgggaggtaattaggtcaagagggtagagccctcatgaaatgagtccccttaaaatgatctgaagagatcagtgttcttttccaccgtgtgagggcacagtgagagagcaccaagtatgaaccaggaagcctgcccttaaaagacactaaatctgctagttacttgatattaaacttcccaaactccagaaatgggagacataaatttctgtggtttataagctacccagtttatggtattttgttacagcaaaccaactaaaaccctctctcttccttcccatgtttaatgtattgcaaagtctaatctgtcacacatacattctctgtctcctgaatatgtatgcttcttcctgtctccatagccagaacccaaatctgtgttgccattaaatgtgaccaaaaataccgcaatagcttttcacttggcctctgggcagtatttatggaactctctcttttatgtactactggaaaaattatcatttctatcttttttaattgacgcataatagatgtacttagattgggggtacatgtgataatttaacatatccgtataatttgtaaagatcgcatcagtgtacttgggatatccataatcttaaatatttgtctatgctagatacattcaaattattctcttctagctactttgaaatatacggtagtaaaaacatatctgattatgttaccttcattcgtaaaaccactcaaagactttctcatttttcttagaataaagaacaaaatttcaacatgatcctttataatctggccttcatagacctcttaactgtatattctactttgtcttttattcaagtacttgtagaaacaaatttcgcttcatattttctaaagtaattcagagctattctttattcttgttcctcctccaatggaataaaatccttcactgactcttccataaatattttgaaaactgggttgttaatataatgcatttgggccactttggtgaaatttatttgtctgactcaattatacatcaaataccctctgactcataaatatgagataggaatatccaccagtcactttcaaattcacgctttaaacttaatctctctagtctcaccctcatttgatttagactatctctaagaaagattgctcacttctacttagaggtccctgaaactcaaacgtgcctcaaggtactaggctggcatgacagctgaaagaaatctgctgaagcctatgttggagaaagatttctactaggcgttgaattgacattgctcttgtttgcacactgtaggggctcagaaaacgataccccaaagtatggcactttggcatgctgaaactttgaactaaagaacactggaaggcctcaaaagcagcctcaaaaccaaggtccctctgaccttctcctcccctcctgtctttaactccacattcttccctgaagtgagtcatagtaaccagaattcttcttcttcaaggtaggtcatagaaaccaaaaaccctctcctccaaagccaaccataaaagccagaattataactctgtattttgcccacctttctctctattagctagccataaaaaattctctgacatacttttgtttgatagtagatcataagaccctcattcaagtggggtcctaccccatgtgtaggaggaaggaattctacacagacaggcctggctggttgtccctagtctattactatcagatcattccctttttgtccaatcacattcctacatggctgtctactctttatcaactctaagcataaaaacagttttcctttgggtcattgggtcttcatttttgaaggctcccatgtcacctaaaacttttattagataaatatctcatgcttttctcttgttaacctatcttttgttataggaatgtctgctatgacctgtataaggaggaaggaaagggatcacagcctttctgctcctataacatgcatgttgatgtaactgttataccaccacctccaattcactgcagaaaaaagaaacaaagttgtttgtttttagtttgaaagtaaataattttcattccaaaagaaatcttttttttttttttttttgagacggagtcttgctctgtcacccagcctggagtgcagtggcgcgatctcggctcactgcaagctccgcctcccaggttcacgccattctcctgcctcagcctcccgagtagctgggaccacaggcgcccgccaccacgcccggctaattttttttgtatttttagtagagatgtggtttcaccgtgttagccaggatggtctcgatctcctgacctctagatccgcccgcctcggcctcccaaagtgctgggattacaggcgtgagccaccgcgcccggccccagaagaaatcttgtaacacttttagaggtgtattttcctgaaaaaggcaaaattgtatgtttccttttaaaacggtcaaatgtctcctttttttccccttcataaagcatatactaagtgcttactatgtgccagacatgctattaactccataaagaacagagacgagaatgcattagtccacattatcaagtaatttggtttagtgaagcatttgtttgacaagataaaaatggtttagacacagaactggggctcagctcacactggtctttttaagaggataatcaaaaaacaccttctctgtaaattaggattaaatcagcttctagcctagaggctctgccaagtatattggttatctccacacaaagaaggctttgtggagtcaacaccatggtaactgtctgtttgcttctctgtctgtgaagattttaagggaggcctggacaccagttggcacgtagttctgataattcaaatcaattcaaacaacaggatgtgaaattctacagaaaggtctttcctcattcaattttttgtctgactttataaatttggaaaggggtcacatacagtgcgtgaacttcccttttatacaaagatcgtatggagagtgattacgctcgttttttgatgtacagatttttaaaaaggcaatttcaaattttactagggcagtggtgaggagagcgttttgtctaaggaaaataacctattcataagcacagaggttaatgttatacttcttttctaaaatggaacaaagaaacatattaatgagtttggactcttctcacctgttggagttcttccctttcatttctatcattattgtgatatcttgatttcatgggaaacaggtggacactgaacccaattcttacacaattcaagctctgagctattcctaacctaatcttaatatttattttatgttgcttccatttggacttcttccttcaaacatctctgatttccttgctaaaactctttttgtccacacataatgtgcagtcagcctacactctaatacttaacatgtaccaccatctcttagagttctgggagttaactgtcagctactagcattgttttctctccaatattctgccagtggatagcctcatctctttatgccagcaatgaggatggaagggtgaagaggaagcagaggcagggtttcaaggcctcccatgtactctccctgagtgccaatggcctacatccaacgcttagttttaggttcagtgacattttcaatgcacaatgaactcagtctccttcccggatcctactcagaccctggcttccaagaagcaattgcacgtttattttattccttatcaatttagcaactatcgcttcatcactttttgtggtttgtcgtgtagttttcatgtatttcactgctactagatattcctcagatatctttgctgagatgcatggcaaatgaacagacacctctgatttaaatgtcttcatgctttaaattgggtgctatctactcttcccagtgctttgcagatggcattttctatcatactttgcactaagtgagcctgggtatttaattacgaacgaaatatatcattcagatgcaactcagttaccttctttaaaaccctcaaggaaaacactgaagacttattttcaatgccatattcaacgttggattctgtacatgtatttttgcttcttcataaaattactcgtttctaataattcttttttccccactttaacaactcacataaaaccattgctaatgaacttatgtatcataagttgctcataatgtgtccctacacctttggaatcagtccactaatatattccttagtgcttaacttactttcctcatatacttaactctgtacttaacgtacttccgaatgttatcagactctatcccttaaatgcagtctaactttacctagcttaaaatctcctttagctaataaaaaaataacttctcattctctgttcacaaaatgattatttctataattattgatgaatattctgtcctctattcttcaagtatatcttaaaacctcaatttgttattatttatggttagcagtgaagcgacaatttttttctcctttacaaatatactcatcagaaacccctgaaattaaaacttgtaaagtcccatcatacagggcaagtaagtctttgatttttttttttcttggcaaaagtgtattactacaccaagacaatttttcaaaaagaccttccattttttggaagtttcaaaatatcaaaagcctggggcatatataccaaatattcagagagtgacaatttttctcagtattatattgtacaaacagactcagcctcatccagttgaatttcccataaaaatgatgtaaattaggttaattacatcccatatggtaaatactgagagatacctgtgtatataaatgtttaaaataaattcaaaggcaaaaacacatacaaacatctcaaagaactagagaaatgtttgccatttaagaagttgtcaattttgaattgtcaatagtaaaacattacatgaattagtgctatataactgtgctaattatgtcagaagagcctcctgatgggcactgtgttctgttaattttctttacagtgactgccacataacctattaaactaagatgacacatttacataaattttaattcagtcactttcaatatacaagttgcaactcatcattcccaaatgtgtaaactttgagagtggaagtcctccaagctcccagacttaactaatttgattagtgaactaggtttatgaatggccattttacatatttaaacatcttagcatgtagaatttcataaaaacttataagcctcatccttagaaacctgaaaggaaaatgctgatgcctgtgaaatacgttaaccattgcagggtcccagggctctaggcctagaccagataatttatgaaaccaattcttaatgaacattttaattagctaggaagcaagttttaacattaataggaacaaaactataattattctttgttggtattaaagaagaaataattttggaggtaagattttccaactttgctgtatttttaaaaatcacctttcttcttcagagttttccgaagtgagaagacattttaattccatattactatacaggcactttcctgaccctaaatccccaaccatttgaagatgacctactattcatcttccaaggctcagttcaagatgcacatcatctgtgaaggttttcttgatcaacctctctctactcttcccctttcaactttccttctgggaaaacttgtccctctctgcttgtttccacatggcatttgctttaaaaaaaaatcgagtaatagaatacaaattcaatttgcatcaaatagatcttataaaaatatcaaatgaaattcagtataaatcctattagttctaaaaatatttttaggactttgagatgcattgactacatggcaattattatatttttggaattacagaatattattaaaggggaaatcctatttaaccaaaagaaaacaagctaatatttagataaatagttccctctccaaatcaagatagtttgtatacacacacacaacacatacacgtttgtatagtgtaagtgtgtctccctctgtggaaggggggaagatagggccacatgattgtcttgtattttgtaatatgtgtgatacgtgtgtgtttgtgtgtatgtttaagttgctttaaatgtaaagtaaatgtgcatttaaaaatatactgagctgagggccaggcgtggcggctcatgcctgtaattccagcactttgagaggccgaggcgggcagttcacttgaggtcaggagttcaggaccaacctggccaccatgacgaaaccccgtctctactaaaaatacaaaaattagccagctgtggtggtgggcacctgtaatcccagctactcgggaggctgaggcaggagaattgcttgaaccagggaggcagaagttgcagtgagccaagattgtgccactacattccagcctgggcaacagaacgagactcagtctcaaaaaagaaaaaaaaataacatagctatatatgtgtgtgtaaatcaggcaccacaggttttaatccctaatttttatctttctggtattttcttgggtaaattaatttcttcgatcttcagcgacttcttgctttaaattgtaaaaatttaaaagctgttatcaaactggtcctgaagtaaaaacatactgtaaaccaaaaataaaaggctaactccccctccaaagggacttcctcctcagccagggctcttaaaatttaacctgaaagactggttcaggccaagaagggaagtgggggtcagacatgcctcattatacctctctgacacttacatcaacacagactttaagtctgataagaagcactctacagcctcttctctctgaagcctgctagctaaaagcttcatctacatgataaaactttggtatccacaatgtcttatctcaacccaaacattcctttctattgatcccaggtctttagacaaactcaaccaattgtcaaccagaaaatgtttaaatttacctacagcctggaagcccccacccccacccagttgtcctgcctttctggaccaaaccaatgtatttcttttttttttttttttttttaattttatttttttcagacggagtctcgctctgttgcccaagctggagtgcagtgacacaatcttggctcactgcaacctccgcctcccaggttcacaccattctcctgcctcagcctcccgagtagctgggactacaggcgcctgccgccacgtctggctaattttttttccctatttttcatagagacggggtttcactgtttcagccaggatggtctcgatctcctgaccttgtgatccgcccgactcagcctcccaaagtgctgggattacaggtgtgagccaccgcgccaggtcaaaccaatgtatttcttaaatgtacttgattgatgtctcatgcctccctaaaatgtgtaaaaccaagctgcaccccaaccaccttgggcacatgtcgtcaggacttcctgaggctgtgtcacaggcgcgcgaattccaccttggcaaaaatcaactttttttttttttttttttttttttttttttttttttgagacaaagtctcattctatcacccaggctggagtgcagtggcacaatctcactgcaacccccgcctcctggggacaagcaattctcgtgcctcagcctcccgagtacctaggattaggcaaaatcaactttctaaattaactgagacctgtctcagattttctgggtctacaatacaaatgctttttaaaaattacttgtaaatatgtttacttacctctctaattaaagaggttttgacccaagatacaaaaactgagatcagctttgcttatattgtggctttcatattccaattacattagtctattcatctagcaatcaaattaaataaaatctaaagatgttataattcccagttataataaaaagcctataaactcttcagtggtttacacagcacctggaacaatgtgacagatgacagaggactctgtcttcagttagtggaaactgctatattaacattcctatcaaaaatctatttttccttatatttgcatggtctcaaatgtatttctagttttatatgtgtaattttaagcacatcactcataaaataatatgtttcagtacagtaaaatttaatgatttcagattgcactgaaaggcatctttaaaagatactaaaaaatcaatttctgtggcgtttaccttgtcctaaaatatgcctatttaacatgtgcctcaaaagctgaattctagtccaagcacaaaatattgtccttaaaattgtacatcttctttattatcaattatggcataccgaattatatacttagtatgtttaaaaattctgctttttaaaatacatgcccttgcatacaaattgaatgatttaatgttttaagctattaatgccaaaaatgtctgagttatttggtattgatattcatcttggcacccatagaatcgttgattgcagtgaagagaataaaactgctgtaaaatattgcttctctgcacaaagtaaaacttacctaaaatattttgacgtctggtaggtagaaatgatgttaaaataatcttcctaccttaatttggtattaaatcttaatcatttcaaaattcattggtaatatttatttctaaagtgtgacatgattgaacagatgtcacatttataagttttgtttaaatatctttgagagaaacaaccttaaaaattaaaaggtaagaaacccccacaaattctaaaatgtcagatactgctacattagaggaattagttataaagccaaggagtgtgaaaacacgtgggcaaaaactgcatgacccagaggatgggaaataaaatgctgctaagccacagatgcctaaagcctatttttcattttcaataaattgaaagtccctttgaaacacacttctgtgcaagaaaatcaccttaacacaggttaatagaaatattctcttaaatgatagatgaaatcctgtcagagtaataaatctatgatcatacaatataatatactcaagttgaaaatcctgagtcatatattttaaaatcaaatgtaaagtttatttaaaatgatgaaacccaaaagctgcctatgtccttatgataaataaatgtgggtcactagagggcgcacattccctttcagagcttgtcttcaatttggcttctttcgttttcttatctgcataacgaaaatatggtgacaaatgaaattttcatggaagttttacttacacagaaatataaaatgtccaaagatatagataaaatagtgtacaaataatatgtaagtaagacactctcagatgcactgttaaaatgccttcagccattttgaggtacacacaaaagtaccttgaagccataatacatagaatcccttgagaaaatatgtccacagtttggagagtcatgcttagttcaaataatttagtaaaattttctggattatgtagcaagtagttttccttcccaagttcattgattttaactaatttttgaatgtttagttaaatatgtggacactcgtactctaaaaatctgcttaaaattatactcctaaatcacctaaagttttttaaaatgccaaactttcattcaaatttaaagaacagaaaagagacatatatatcattttaagcatcttaatcaggtcacaggctttcaaaaagaaaacttaatcgctcaagaaaccttgtatgttatctgtaatagcttttatttttgcagattgatcatgaatagaaaagttgaagatcttcatttagtttcaatacacagtgaagcactgagtcaagactcaagaacaggtctgtctgaatccaaagatttctacaacactacatttttcttttgttccaaataaacgagaaacccatcttaaaaaaaaaataaggataagtcaatatagaattactgttcattgctacacagtacagtaatttagtggttttgactacgctatcttggattatatgagaatttgattgaagtctctaatatcaggatattaattctgaaatttttcattaaaatatgatccttagttgtatactttgtaccctaatggcaatataaaataatttatttcccaatttattattaccttggaatttcccttaatttcctaaaatcctcaactttctaatctgatgatacaatttctcacatcagagaaaatattaagcatagatgaaaaaagttactacttattatataatgtggttaagaccatggtgagctccaaaagtcttgcacttggaaaaaaaagttcaattatatggaaattccacttatttttgatgctgaaaaagacatctaaattttaaagaaatcttttcagtgaaaaaggtctctgtatttaaagataatcaagtgttgccatgggacactagagtcaatgatacttcagaatgtagaacagacataatctagaataagtgcagcttccatagactttggcaaattcttaaggagtcccagtcaagcattttatttcagctaaataatttgatgaaatcacctttaacttattacaacatagcaaggcgaggaatttccgaaggcaacaccctaagctaggctgtctgggttcaaatcctagctgcgatgcttcctgtaaactatgtgaccatgagcaagtcacttgaaatttctatgacacattgttatcattggcaaagagtgacaataataaaacttacttcgtaatgctattttaagtgtgaaatacattaatatgtagcaaatacttggtagaagccatatacatattagctattgttattaatatcttccatgatccttttttaactggctttaagccctatgccatttctcactttctcacgtgtgagagtagtcatatttgttttagtgtcttcttaatgactgataaagtaaaagccacaattggaataacaagaataaaaactgcaaacacagctataacaaagacaatgaaacatataaacaaaaatcaacagcaaaatagtctcattttacccattagtgccggaatccccaaagtatgttctatgggacaaatatggtctgccatctaatttggtaaataaaattttactggaactcagtcatgctcattcatttatacattgtttatggctgctttctagctatagcagcagagttgagtagttttaaaataaattttatgatacacaaaacctaaaatatttactctctggccctttagagaaaacttttctttcccccttcccagtctatgaaaccaaggtaagatggcctctctctcccaactctcaagtgagatcaaaatgatatggttcacagtagccatatcatatttctctctctcaaaaatatgcaatggctccccatgaccagaaggtttaagtctacatgccttaatcttttattgaatacctttagttattatgaactcaacctaccttttcaacctcattccttacttctaaacttcctttacttcatacttctgctggaggcaaacaagaatacttaatcccatgtaagttttgttcgcatacaggctttcccctgcaatgaattgtcactttcctcatcttgagcccaatgcttccctactctttaattatccagtcagatgctaattttcccataagtcttccatgcctctcaagcaggaagtgaacttttcttccttaaaacttttctaacattttattagtacttcttcatgacagtttatgctgggtgcaagcttcctgagggaaagcttagatttacagttaaagtaactggagtgttttacataccatagcaatccattagatattagttgagtgaataggaaaattagcatgaaaactaatgttgctgtctcttctttcttgaaatgatgtggactcataatgactacagaagtgttcaaagaaacccaccatgcattggatgatgacttggaccctgtgggaggcaatttaaactttaaactctctcagtgtgaaaggtccttgagtttaagagaagtcaacatgcttgtgggtctttcaagtttaaataacttccaacccgggttccaaaaggatctagtgcaatgtggaaagccatttcaatctgacgtgtacttaatgccccactgccagcatcatgacctgtttcaatccatctactgtgttagtaagcatcactatgaactttagtcaaaacagaagtaatactcattgcttaacaaagccggtttttagtcagctagcacttacataacaaaataccatagactgggtggcttaaccaacagccacttatttctcgcagttctataggctacaattccaaaattaaggtaccagcaggatcagttcctggtgacagccttcttcctggcttgtagacagcctctggtatagtttggatattcgtcccttcccaaatcttatgctgaattgtaaactccagtgctggaaatggggcctggtggcaggtgtttggatcatgggagcggatccctcacggcttagtgctgtctttgcgatagtgagttctcctgagagaactcacttacaaatgtgtgccacctccccctgcactgtctcactctccttgtcccattcttccatgtgatgtgactgtttcccctttgccttccatcatgattgaaagcttcctgagacctccccagaagcagacgccaccatgcttcctctacagcttgcagaaccgtgagccagttaaatcaattttcatgtaagtcactcagttgcaggtatttctttataacagtgcaagaacagcctaagacaacctccttcttgctgtgtcctcccaaggcagggagaaagagccagcaagctctttgttgtgtcttcttataagggccctaatctcctcagaagagccctatcttcatgacctcatctaaatcaaattatcttccaaagtctccatttccaaattccatcacattggagattagagcttcaatataagaatttagggaggacacaattcaggccatcccagcctggcatcatttttatatctctgtggtagcataatatgtgttcatttgtaaagagacaggtttctgaccagggaagactttactaagaatactctcagaagatgtcagaataagaataatatataaatgtggtcatgggaagataccatccctgaattaataattggaaactcaactttctcctggggaaaggagacattgttttttaaatgtaaacgttcttcaagacaaacacatgtaatataatttccacagtgtgagggcaaacagggaaggccatatacattccatttcaggggtgacgaaatagattcttggggagattaagtggcttaagtcacatagtttatgagcagaagatgcacggccagaacccatctgtgcagtaatatgcccatctgctctcagatctattccccacatttcttctgtactttctgtattagagggatatacatttcccaacaccacttgccctcctaattgttcatttggaggcaatggcagaatattggaaggtgggaggaagagaaaagccaaggtcttttttcttctccaactaccttgggtggcatttctagagcagatgtatctctgctgtggcttctgttttctctggatagctagctccctcttcaacaatccaattttctgcctggcagtcctaactttagtttaatctctgttagaaagccccagcttctgagctctggtaatatcactttttctgtattgtttctccagctctagggatattagcagcttccttacgttactagtgctttgagttgcctctccatcccctgcgctgcgtctcagttttctactacctgcttagccaattccttatattacgtttcctctctttaaatcacagtgattttgtttttctgacaagactcgcacaaaacctggaaaatccctcatcaacatccaataaatatttattcaatacctactatgagctgacttctgctttatgcattataggtgtacagatgacaagaaatgatttcttccctcaaggcgtttactggagatacaggcatgcaaaaataaagtcattaccatacaatttggcaagtgttttaatagaagtgttaaaaaggctgagaagtggcctggcactgtggctcatgcctctaatcccagtactttgggaggccttagcagtcggatcatgaggtcaacagatcaagcccatcctagccaacacggtgaaaccccatctctactaaaaatacaaaaattagctgggcatggtggcccttgcctgtagtgccagctacttgggaggctgaggcaggacaatcgcttgaacccacggggcagaggatgcagtaagctgagatcgcgccactgcactccagactggcaacagagtgagactccgtctccaaaaaaaaaaaaaaaaaaaaaaaacacacaaatggctgagaactgcctctgcaaggttagataaccagaaagacaaggtggttagtagcacggtggcaggtaacatgggaatgggaaaaagaaaggtatctaaagagaatcttaggcagagaaaacagtaggtacaaagaaacagaagcttaagaaagcacagagcatttggagatcaaagagtggttaatttaagctaaagcatagggcagtgcggaacaaagttcagactttagcagacagtgaactgtttgctattagtctgtaagaagaaaagagttttcaccagagtataaatcaactgagtcactgaacaaacgatttgatcttattttgcttttaattgccgaactttcttgacaaaggaaggagtacattgatttatattctggctcaagcttcttatctcaattgtggactggtactaaaaagtttgcagattatttggagtagcactggtattttttttaaaaaaggagcagaggagaagggagtgaagctggagaggtaggcagctaaagatcacaaaagaatttctacgccatgcatttcaagatttatgggcaggggaataatctaattaaaactgcattttaagatatccctcgggaggctgtaaaaagcatggataagagaggtgagatcagaggcagagaaatcagttaaaaatttcatacagaaaaatttcagttttaactagagtgaaggcagcaaggatgtagaaaaaaataacaaactaaagagaatttaacaggtacatttggagggatttagtgatgtggcagatatcaagaccactgtgaatggctgcacaggttgctcactgcacaagttcaggatgtaccattcttagagactatgatgtgaatgaccctctctagagttatacgatctaaactccaaaactatattttagattccagtcagaaatccaggaatacatagcctataagcatttgaattatacagggatgaacatcaggagagagggagaggtagaaatatcaatttgtgaatcaaaaatataggtgatgataaagattataaatgatatttccccaaaaaataaagcatcataagaagaaaataaaatcacaatttgagtcttatgtagactgacattaaagggcaggaatagaagacagggaagatatactctgaaagaaaacaggagagaacaatgtcccagaaactgcaggagagaaaaatttcaagaagggactaatcatttctgtcaagcacaagacaaaggtcaaaaagggaaaagaactgaagagtgacctttggagctggcaattaaggagctctctggcgaccttgctgagagcagtttcagtgctcgatgtagagtatgagagggtaaaggaaagaatcaggagtccgtaagggaatacagatagttcaggtcttctgattaaaaactgacttttatttgcactcaactatgcttctccttttagatgaataagtatgagtaccattttcttcactcaaaaaacgaacaaaattatatgtaacagctctgggaatgtgatcctgtcttctttcgtgttgatattcttttacgccttgcattctggaagaatacattttcacatagctactgtagccagacatccaaagatatagtatctcataggaccagttctcaatatagtgcatttctattcacagcttgaattgagcatctactacacagaagacatcacacaggtaacgaacaagaaatggatcctggcccagggaagctttaattctagtggatgaaacaagcatatggatagatcatttcatcataaagcagtaaggtgtcacaagatgcaacagtagcatcccttaacctgcccaggaatagatggcccctgtcaggcctctgagcccaagctaagccatcctttcccctatgacctgcacctttacgtccagatggcctgaagcaactgaagaatcacaaaagaagtgaaaatgcccggttgctgccttaactgatgacattccaccattgtgatttgtttttgccccaccttaaccgagcgattaaccttgtgaaattccttctcctggctcaaaacctcccccactgagcaccttgtgacccccgcccctgcccacaagagaaaaatcccctttgactgtaattttccactacccacccaaatcctataaaacggccccacccctatctcccttccgtgactctcttttcagactcagcctgcctgcacccaggtgaaatagacagccttgttgctcacacaaagcctgtttggtggtctcttcacacggacatacgtgaaagcccctttatgggggctgtcataaggaaagagaatcaggggtcagactgtaaatgacaagacactccagtgaactgatttccaaagtgtgggccctaaatcagtagcagcagaatcacgtgggaccttgttagaaattaaaattcttgggcaccactccacgcctattagaattagaaactctggtgactccgacgcatgctgaagcatgagaaccactgttgtcatgccagtgcgagggttctcaaattttatggtgtataagtatcaccgagagtgcttgtaaaatatttttgggcccaccagcagtgtttctgattcagcaggtttgggaagggccctccaaatctgcatttcaaagaaggtcccaggtgatgatactgtttcatgcactgcagtttgaatattactgttctaagtattctctgatcccatagcattctctagaattcacattactatattcttcaaaacactgctattgatttattcttgatgcataagacaacataatctcaagaacatttaatagatggttatctttttgaggatgtgaagatggtatgcaagatttctatttcttttttttttttttttaacaaaaaatagtgtctaaagcgaaatttgaatttatgaccaaggtcattttcctttaatacataaaaagtaacatgacattgcaactataacactagaatggatttaggagagtcagcaccagtccttattttgcaactgaaagcaagttatttaacctttctggacctcaattaacctgtaaacatgcataagtctagtctccttaggaaaaaaagaagcaaatcatctaaaatgttttgtttctatgggctgtgccaataggcaaaagtgtcattactgagtttaacatcccagatattttaggatcaatttatcatatagaacattaaaaaaaaaaagttcacggacacattaattatctaattaggtccttcaaataacttggtatattttgccatacaactttcagattttagtttagaaactgaagttataatcaatatctaaaacaaaaatgttttaggcatgagtctcacaaaactgcagagcggtcttatctgttatctattttctttccagagatgtgacacaatttaacttcatctggacagcagccataaaaagaaaatcaaacaaacaaaaaacagaaacaaactgaaaagtagaatatataataataattcaggtatgtagatcagtcaatttatcctcctatgtagttaggatgcaggaaatagccgagaaagcaagcttacattctgtctgcttaccctggagggaaaaaacagaccaggtgaactgaggcatttcaaaatgcctctacattatccttgaggacaaagatattcatttatgaacgctttacttgggggaaattatctttattaagatggcattcacttaaaaacaatttgccattcattctgcctggttgctacaaaagtataaattaaagctttttttaaaaatcccttaaaataactgctacatgattaggaagtaatctcctggataaataccaattaactagataatagatctagttttaccctaggctgagttccttactctgataattacctacgtgtacaataatatcactgaattgcaggaataatttgctattagaaataattatcttgtgacccaagatcatcagacacttttgcaaatctcagtgtaaagagaaaaatttatgcaataaatacaacatatgtagaaactgtataattatttaggaatcgactaaatgtaccttagatagttaagaaactatgtggtagaaagctgaattttaaatcccttaattgttttgggtaaataaggataccctaatgggtaaaattggaattattaaagatcatcaggatggtcacgtttattattaagaacaattccaggaagagctaggtagaatttttaaatgatattgaaatgtcaaattttagttactgcaattatttgaattatataccattcactctctcaacaaacatttattggttacttattgtatccacggtatttgctacaatggaatctaagtaaaacataaagaagtgtaataataggcttcctttgttttgacgggcaatgagaaattttatgtgagtggcatgaaggcatacaacaaaacgaatgtaatgtaatttactggctgaagtggaataatgattattgggaaggtagacataaaattagtggagaatgagaataatactgaatgccataggaagcacttgggttttattttggaggtatctggatttatgggaattcgcatgtctggagagacatcaaaaagcatcattttagatatattcattttagtaaatcaattagaaaggagggcagttctctccacagtgaggtatatggctcaggttatggacttggcaattcgaatgaacatgaaatgacggaaatgatggcacttgcccaataatacaatctaattataataaataaggaaaagaaagtagaagaaaaattcacagaactagagatgtcaggtggtaaattctgttttgaagaggaaaacaggaaggtaattttacatttcttaggtttgagataatgtttattatggaatttttccctgtcgataatagatgactaccatctccatcactacctccaccaccatcatcatcatctctactatcgttacctctcccaccatcacttctactcctcctacccaccacaatcttcctccatcttcatcatctctatggtctccaccaccaaataagaatcgaaccactgcatttattgaatgtttaccaccttaaaggcaatgtattaaatgcttatttaatcctcatgacagttgttttataaagtgagaatactggaatctgaggcacagataacaagtaatttgcctgcgctcataagctagtaattaaaacaggcaggtttcacaaataccacaggttcttacctataagtgagagataaacactgagtacacatggacacaaagaagggaataatagacactggggcctatttgagagtggaaggtgggaggcaggtgaggatgggaaaactacctatcagatattatgctgattacctgagagacaaaattatctgtacaccaaacagccacaacacgcaatttacccatgtaacaaacctacacgttaaccccttgaacctaaactaaaagttgggaaaaaaaaaaagggcagcattcaaacctcagtaattctgattccaaaagcaatgattttttccatatttgctacttctctagacacacaggcaatgaattataactaaaatatgtgtgcaatgtataagtaggtatggttaattggaaggaacaaatgtttgcatttgatgaacattgaggcagttgctggatgcacaagcggaaatagctttagagatataaagctttaatttgagggagagtgtcacatctggagctacatgatttgggagtcagtcacttagagccaggctcgaatcaatgagaggagataatccagataaagaagtcaaaaggccgggcatggtggctcatgcctgtaatcccagcactttgggaggctgaagtgggtggatcacgaggtcaggagctcaagaccagcctggccaagatggtgaaaccctgtctctactaaaaaatacaaaaaaaattagccggatgtggtggagggtgcctgtaattccagctactcgggaggttgaggcagagaattgcttgaaaccaggaggcggaggttgcagtaagctgagatcccgccactgcactccagcctgggtgacagagcaagacactgtctcaaaataaaagaagtcagaaaggcaaagagatggatctgtgtgatactcccataggaataaggcagaaggaataaaacaagtcaggtaaagagtcgtgggtgacaactggtagtgtgtcacagaagctggaagaggacatcatttaaataaaacactattcaacagatggtcaagacctcaatattcagtgaaatattagtgggcttcagatgatacaaaaacggggcactagctaatataaagcttatggttatatttgcatgatgcctctttaatcattacaatactttaacaagattccaccctgtagacaattatcaattaatgaatttgttcctaaatgtttgcctttttgctatcttcgttcagtctaaatttatcaatcaagtgtcgtatatagcgtgttcagataattttgccgtccaaatcaggacacacttgagagtgaaagttgatgctatatataattatgctgggacaacaggtgtaactgggatggcttcaggtaaatcaataggattaccttagtcatatatctatgaaaaagacattttactatacagcccaggttttgtagctacctcagttcaaatcctgtctgaggtacactgtagctgtgtataattttataaagtaattatagccatacctattttgggaggttactgggaaaaatacatgcgatgccaataaagcactgaatctactactgagcacataataaatcctcaatttatgttagcttttatttgaagaatctttctgtatgtgcccaatgggacttctcatttaggcacatacaaaaattgccgaaaacttatgatacaaacaaattttggagagaaggtatttcaccactagccactctttcctgaaaacaaaaagaagtcagaacacactttttttttttttccaacacaatccattctccaaacaggagccaataataagcttttgaagacagagattgacatgaatcagcttgctctgttaatttctgtattaggcaagtcctgaagacattaaaagtgttaggcaactaggtgtccctattactctgtttggagaactgttggagggttgttggaatgttgcaaagtatccataaatctgtatgtccactaagcgttgtctataaacacatgtttaatgtgacaacaaacaagttaatgtacatcttactaggaataataaaagaaattcatcaaaagcttcacggatttgtgccattatgcttttcactccatcaatttttgttagattttctattaccatcgtgagtagagtgcttggaagttcctgaaagttgttgccacaaaaagaatgctaatattcatagagtttgagagccatttgactggagcaagggtcgccaaactttttctgtgataggataggtaataaatattttaggctttgtggactatacagtttgtgttacaactattcaaactctgccgttgtaatgcgaaagtaatcataagtgataaataaatgagtttggctgtgttccactaaaacattatttataacactgaaatttgaattttatgtaattttgacatgtcataaaatattatttttcttttgattattttcaaccatttgaaaacgtaaaaacacttcttggctgatgagccataccaaactggcagcatgctaaatttggttagcaggtcttagtttggtgacccctggactagtggatttgcttagccaagctgacacaaccagggagaaaaggcccagtgatttactttggaattatcaaagtaggtcataagtcattagttaatagagaagtactaaacatcccaaataatatatttgaataacttctctagatttattttttttcttagaacatctgacatggtatttttagatgtgtgttcttttcaaacttctctaccctggtatacacaaattctaatgtcaagtgttccatgagtttctaaacatatgctgcttaaaaacatacggcagattttaacgttctttcttaatcttagaattacaataactggaatgaaagggaaattgtaccttttaaaataatttttatgccagctttgcactcataaaattttattgccatcattttaatatatccactgatttacataatacctaacttatctaaaatgcataattctgaatagtcacaaaaagatcagttaaaaattctaacaccttcaagataagactttataaatatcaaagaacaggaaatgtgttctgtaattactcctgatttaggatgcgcagactgagacatcatgttctcgtaaactaccaggatggatcccatctattataggtgtacttcttcatgaaaatgcactttccgttactggaaaaaaaagacatttaatgcaaaactagggactcaacaagcaggccctttataaggaagaaaaaaaaaaaagaaagaaagaaacttttaggattaaaatgctaccacagtagtttatcacctatagtttctatagtttcttctttcaccccagaaaacaccatttccattaagcatttactttctgttgcgatagtgatttcttgtgaaagttttaaaatgtacttcataatttttctcactacattaactgacattacaggtacccgaggattctggaaatattgctgaagtgaaaacaccaccaacaaaactgctgtaaatgagttttctccacttcatttgcagataaaagcttaagatgctctcaccttttcctaatttcagaatccacagtaatctgcctcttcttttggggaggtggtggtggaagttcctcttgagcatgctttaccaggatctgttcccttgtggtcaccgtagttactgtttccattacagttgtctgtgttagtgatggctgagtggtggtgacagcctgtgaaatctgtgagaagtattgaaacagaggtcagacattgctagaaagacttcagtaaagactgcttggagtggcaaaggaaaataatgagaaactgttcttgcttgttggtagattgaccttcagatcaaaatagcaccatattgaagccaaataaaattgttttatctgacttaagtttggttcactgaaatagcaagggaaagtaatctcaacatcgaaagtcaatttagcgccccttcaatatattggtcaaactgtaggaaataaggggtgggggcagaggagaaaaatgtagagtataattcattctgatagttaattctacatgctgtttaaaatgtttacattaatatgaatgttactaacgtacatcagtaccaattccattgcctagaacattttaaatgcttattaatagtttgtagaatgcatttttggttatcatacacattgattattttatgttatacatttttaaataaaattatttcaacttggtaatgaacgactctttaatcaaataagtgaaacagcttttaaaattacaataaaaggttaacataaagtatgtattagtccatatatatctttatgttgaatgttattcaaatgctaaaaaacacactactcttgtttgatttaaattagtgattatgttcaaatatttgagttcccatattcatcactggagacacttcttggtttagaatctcaattacctcctgttcatacttttggcagcgggccgggggcaacagttcatccatctttggaataatacattttgtgagccaagacatgagaggccatcacctcaatacatgggcattacgagatagacaagtcatataatggtgagacaatcattccttatcatattctccgtctcacagagctcctctcatgacgattgtaacgttacctcttgggatggtaatcattatccttctggcaatccaacttatatgcaaggtctgtttccaaggaagtcacaagaggcctgcattgaaactgcctctggttacaagcaaaggagcagggatctggctgggtcaagattcattttagcaattttcctgaatttgccaagaggtaagggaagggtttgtagtaatctccctgcctcatacacgaggactgattcctttcatgtgaggaaatgggaaaagcctcaggatcttcttatttcagcttccaaattggcaatgaacagtgaaggaataaaatcttttccatgatgtcttaagtaaaaattgctttgacatacatagcttaaaaaggctaccttttgttaaagacatatctttacctatgtgagggactgaaggatttccattttggtaggctaaaaggatactaagaattacagtttctacatttgccaagcacaggttttatcttctctaggatctccatagattcattatttagaatgaatcactgaacctcaaacaactttaattataagtctgttgacaagttatgtcaagatgaaagcagaaagcaacatagctctaaaaaaagcttaaaatataaactcaaacattgcacccaacacaaaatgaccattacgtgataaaattagttttatttctagtcaaaaagaaaatgtagtttttagtaggattccaagagcatttactttgtaatttgaatattttttaaccatgagaaaacttgctttgcaaagaaaatgcagtttttagtaggatcccaagataatttatttttttatttgaatatttttttaaccatgagcacactttctttgcatacagtggaggctagaagataatattttgcagattaagaaaatacctaattttaaacatacagaccagaatgcagagattctgaaaataccaagctaattcatgcagttatatccaatctcatagaacatttgtgctactaaaaatttgactcttaaattaatttctgtaatattaatattttcgtggtatctacttataaaattggatacatgtgcccatggagggtaaagggaaatgacaacatgatatactgtgaagcggcatttaaaaatatactcaaccttttaagaaagaaaaatgaatcatttttaataaaagagtagtaagacatgagtctgtaattgttctatataataatcactactacactgtaattgaaaaatactacttcatttccttcgggatggagaaataagaaaactgtgcattcaccctgtaaatatagggtagaactcattacatataacaaattaataatcactctcaaaacctacttcatacaatcagaataaaaaacaatcagtcatgtactaaatttccttatggcttatagttattgactataactattattgacacttaattatgtgttagaatcattaggaaatatagacaggagagggactacgaaggccatttaacatgacctcctgattattacagagctcactactccctgaaacagaaagctcctttcttagcatgcaagcaaactttccccattgggaaagatgttcttaacaaccagaggaatcctgcctgattaagacttcctcttgttaaaacttgttttgagttctgaatgaaagcagagtaaattgaatatcatttctacctgatattctaagatttgaaatctaataatcatgaccctgataaatatcattttcaaactctataatgccagttatttgctagaagtagatataacttgattcgtcatccaaaaccaatgtttcttggctttggacaccatagtcaatcaaagaattctaaaactgtgtaagttattcagcagctgaaccacaaggtttctataaaattctaatgtttattgaatatatattcactataggacattcagaaatgagtaaaatagaaactccatatttaggaaccttacggcaaaatagggacgatgataatcacacaaataattgtgaagatgaatgccacgtgaaaaataccagtatgcaaaataattacatacaccaaacatacagtaatcaagtaattttctctttaaatgttatgaaaacagatttctctcagctagcattttaacatttagatttaatttgatgctgaaggctagatataatatttatccttgtttatagggtctttctaacagtaacttttggaaacaacctcatgtcatagatgatggtttaagtacattatggtatatgaatgtggatggagtattatatttcaaatattttaatgtcattggaaaacgtttgctttacactattgagtaaacaatgctagacataaacattggttgatttttgacagagaaagtagagaaaatttctgttgcacagtgtatatttctgtattcctttagtttccaaagttcttctataagatattatctgcaaaatgttgcatttgtaagcaaagaaaaattttgaaagttttgccaaactgtttgttttaaatctatcatttctatttatatattaagatctatggaatcatactcctgtcactcaatgcattagaatgaggaaaacttcaagcatgataagaataacgtagtgccttcactaaaatgtttaatatggcagagtcaaaactagaatagaatatagtttgacctatattcaacaatctttgtatctagctaactatacttttacccagtcacctttcttcattttgattatgagtctatttaagactctaaaatgatatcatgaaaagaaaatacatttctttttaaaatactattcattttaactgcaagttaatttccctagtaaaaatgggaaatagtttagaaatacttgtctttacatttgggagctgattcctcttagagtggttataagtagaggcattggagccagtctccacaattattaaacaccagatccatagtttatacactgtgacatttggggctggttggttcttatctcaaatctatgcattattttcttcatctttaaagtaagagtaacacatttcttcacaggtgtgttacaagcaaggacagcttcatgggctggtaatttatgcagttgcccagggcccctgctcaggaggcttccatgcttgttttcaagctctgcttccactgtcttgaaattcttaggtcttgaacaggaagcccttgttttcagtttgcactgggcccacaaattatgtagccagtcctggttttgagaattaaatgatataatatctgaataaaataagtgctctataatggtaaatatcagcagtaaccactatcttttctaaacgctcagggaaatttgaagaatttttctatactcaaccttcttactcataagattacatatgttaaaaagatttaaactttaaaatttacattttctcattctgagaaaaattggaagagcatttgccagcatcctgatattattccagggtgtgcctcttcttgcagtaagattgtgttattttgataggcctgggaaaaacaaactatgctcaagaaatgaagttctttctttccatcttctcttccacttgtttaaaaaatgcacatttaaaaaaagaaacataagtacatcaaagcaaatttaaagaatacaaaaggacatacaataaaataaaatactttttttctaccactgtctccagtttattaggaatcactacaagtcatgtataacttaacaactgggacacattctgagaaattcatccttagacaattttgtccttgtacgaacgccgtggagtgtacttacacaaacctagatggtacagactactatacggccaacctatgtggtacagcttattgctcctagctacaaacctgtacagcatgtgactatactgaatagtgtaggcacaatggtaagtatttgtgtatccaaacatatcgaaaggtacaataaaaatatgatatagagagttgggcataaaacaatctttagaaaatttttttaaaacccacaaaattataccaacaacactcttggaccacagtgcaataaaaatagaaatcaatgttaagcaaattgctcaaaaccatacattaaaatggaaatcaaacaaactgctcctgaatgacctctgggtaaacaataaaattaaggcagaaatcaagaaattatttgaaactaatgaaaatttaaaaagatgtaacataccagaatctctgggacacacacaaagcagcgttaagaggcaagcttatggcacgaaacacccatatcaaaaagttagaaggatctctaattacaaaacgaacatcacaaggaacgagaaacaatagcaaactaaccccaaagctagaagacaggaaataaccaaaatcggagctgaactgaaggaaaatgagatgcaaaaaagcacagaaaaggtcaatgaatctaggagctgtttctttgaaataattaataataaagatagaccactacctagaataataaagaaaaaaagagagaagactcaaataaacacaataaaaaatgacaaaggggatgttaccattgaccccacagaaatagagaaaacccttagagactattcataatgaacacccctatgcacacaagctagaaaacctagaagcaatggataaattgctagaaacttacaactttccaagtttgaaccaggaagaaatggaatcattgaacagaccaataatgagttccgaaattaaattaggaacaaaaagcccaccaaccagaaaaagcccaggaccagacagattcacacctgaatactaacagatatagaaggaaaagctggtatcattcctatgaaaccactcccaaaaattgaggagcggctccttcctaactcattctatgagggaagcattgtcctgataccaaaacctggcagacacacaacaaccaaaaaagaaaacttcaggccaatgtccctaatgaacatagatgcaaaaatagtcaacagaataccagcaaacccaatccagcagcacatcaaaaagctaatccaccatgatcaaggagcttctatcccagggttgcgaggttgattcaacatacacaagtcaataaatgtgattcaccacataaacagaacaaaaaatcaaaaaccacatgatcatttcagtagatatagaaaaggcatcctataaaattcaacaccctttcatgttaaaaatcctcgacaaactaggcactgaaggaacatatttcaaagtaattagaaccatctttaaaaagtccacagccaacattatactgaatgtgcaaaagccagaagcattgtgcttgaaaactggcataagacaagggggccctctcttacaaatctcattgaacatagtactagaaatcctagccaaagcaatcaggaaagagaaataaaggcaatccaaataggaagagaggaagtcaaattatccctgtttgcagacgatgaggttctatactttggccatagtctctgcccaaaagctcattgatctgatacacaacctcagcaaagtttcagcatccaaaatcaatgtataaatatcactagtgttcctacacaccaacaacatttaagctaaggccaaatgaagaacacagtcccattcataattgtcaaaaagaaataagatacctaggaatacagctaagcaaggaggtgaaacactgctaaactgagaattacaaaatattgctcaagtaactcagagataacacacaaaaaatggaaaaatattctatgctcatggaagaatcaatattgacagaatggccataatgcctaaagcactttttaattcaatgctattcccaaaaaactaccaataacattcttcactgaataagaaaaagactatttaaaaattcagttggagccactaaaagagccagaatagccaaggtaatcctaagcaaaaagaaaaaagctggaaccatcccattgcctgactgcaaactatactacaaggatatagtaaccaaaacagcatggtacaaaaaacagacacataaaccaatggaaaagaatagagagtcgagaaataaggctgcacacctacaaccatctgttcttcaatgaaatcaacaaaaacaagcaatgggaaaaggactgcctattcattggaccccttccttacaccatatacaaaaattaacccgaggtggattaaagacttaaatctaaaaccaacaactataaaaacctaagaagataacccaggtaatgccactctggacattgaaactgcaaagacttcataacaaagacaccaaaaacaattgaaacaaaaacaaaaattgaaaactgggacctaattaaactaaagaacttctacacaacaaaagaaactatcaacagagtaaacagacaacctgcagaatgggagaaaaattttgcaaactttccatctgacaagggtctaatatctggaatctacaaggaacttaaatttacaagcaaaaaccaaacatcaccattaaaaagtgggcaaaggacatgaaccctttccagaaaaagacatacatacagaaaacattcatatgaaaaaatgctgaacatcaataatcattagagaagtgcagatcaaaaccacaataagataccatttgacaccagtgagaatggctattattaagaagtcaaaaaatcacagatgctggcaaggttgcacagaaaagggaacgtttattgcactgctgatattagtgtaaattagttcagccaccgtggaaagcagtttggtgatttcccaaacaacgaaaaccagaattaccattcgacccagcaataacaattattgggtataccaagaagaatataaatccctcaaccctaaagacacatgcacatgtatgttttattgaagcattattcacaatagcaaacacatggaatcagcctaaatgcccatcagtggtagactggataaggaaaatgtggtacatatacactgtggaattctatgcagccatgaaaaaagagattgtgttctttgcagcaaacatggatggagctggaggccattatcctaagcaaactaacacaataacacaaaatatcacattttctcacttctaagtgggagataaacattgagaacacacggactcaaagaaggggacaacagacacggtggtctatgtgaggctggagggtaagaggagggtgaggattaaaaaaactacttattgggtactatgcttattacctgggtgatgaaataatctgtacaacaaacccctgtgacatgcaatttatctatatgacaaaccaccacatgtacctctgaagcaaaaataaaagtaaaaaataatatagtataataatattatgagaccactgtcatatatgtggttcattgttgactgaaatgttgttatgcagcatatgactgtagttgcaattacgaactattcagctattctttaattttaaattcattttgtttatgctgttattttatgatatggtttggctctctgtccccacccaaatcctcatgttgaattctgtcttcagtgttggaggaagggcctggtgggaggggactgaatcatgggtgtggacctcccccttgctgctctcctgataagagttctcatgagatttgtttgtttgaaagtgtgtggcaacccttgccagatcgtggccagtctgcttctttaagtgggaccctgatccatcctcctcactgggtgggacctccctgagggggcttcagccattccacccaggattcaatggatagagctctgatctctccctgggacagagcttctgggaggaagaccagctgccacctctgcagttctttgaaactaatgagaacaaagagacaatttatcagaatctctgggacgcagctaaagcagtgttaagagggaaatttatagcactaaatgctcacatcaaatagctagaaagatcttaacagcctaacatctcaaataaaaaaactagcaaaccaagagcaaacaaacaagaaataaccaagatcagagctgaactgaaggagataaagacatgaaaaaccctccaaaaaactaaatgaatccaggagctggtttttggaaaaaaataaaaataaaaaaggtagacttctagttagactaataaggaagaaaagagagaagaatcaaataaacacaatgaaaaatttgaagaggaatatcaccaataattctacagaaatacaaacaaccatcagggaatactataaacacctctatgcacataaactagaaaacctagaggaaatggataaattattgaacacatttctcccctctaagactgaaccataaaggaaatgaattgctgaatagatcaataatgcgttctgaaattgaggcaataataaatatcccaccaaccaacaaaagcccaggtccagatggaatcatagctgaattctactagcggtacaaagaagagctggtatcatttccactgaaactattccaaaaaaattgaaaagaagggatttctcccaaacttatattatgaggtcagcatcaccctgatgccaaaacctgggagggagggagggagggagggagggggagggagagagagagagagagagagagagagagagagagagagaaggaaagaagaaagaaagaaagaaagaaagaaagaaagaaagaaagaaagaaagaaagaaagaaagaaagagagagagagggagagagaaagaaagagagagagagagagagaaagaaagagagaaagaaagaaaagcaaacttcaggctaatatcattgatgaacactgatgcaacaattctcaataccagcaaaccaaatccagtagcatatcaaaaagcttatccaccacaatcaagtttgcttcatccctagcatgcaaggttagtttaacacatgcaaatcaatacatgtgattcatcacataaacagaactaaagacaaaaaccacatgactatctcaatagacaaccaaaaggtatttaataaaattcaacatcccttcatgttaaaaattctcaataaactaggtatcgaaggaacatacctcaaaataataagagccataaattataaacccacatccaaatgggcaaaagctagaagcattccccctgaaaactggcccaagataaggatgccatctctcaccactccttttcaacatagtattggaagttctgaccagggcaatcagggaagagaaagaaataaagggtattcacataggaagagaggaagtcaaattatttttgtattcagatgacatgaacctatatccagaaaacccccattgtctcagcccaaaagctaagacttcaaactatactacaaggttacagtcaccagaaaagcagggtactggtacaagaacagacacatagaccaatgaaacagaatagagaactcagaaataagaccacgcacctacaaccatctgatcttcgacaaacctgaaaaaacaagcaatggggaaaggactgcctatttaatacatagtgctgggatagtcctatgcagaaaattgaaagtggacttcttccttacaatctatacaaaaattaactcaagatggattaaagacttaaatgcaaaaccccaaacaataaaaaccttagaagaaaacctaggtaataagattcaggacataggcatgggcaaaggtttcatgaggaaaatggcaaaagcaactgcaacaaaagcaaaaactgacaaaggggatctaattaaactaaagaacttctgcacagcaaaataaactaccgtcagagtaaataaacagcctacagaatgggagaaaagttttgccatctatccatctgacaatggtccagagtctacaaggaacttaaacaaatttacaagaaaaaaacaaataacctcattaaaaagtgggcaaagcacataaacaaacacttctcaaaagaagacatacatgtgacctaaaacgatatgaaagaaaactcaacatcattgatcatgagagaaatgcacatcaaaaccacaatgagataacatctcacgccagtcagaatggttactattaaaaagtcaaagaacaatagatgctggtgaggttgtggagaaaagggaacacttttacactcttggtgggagtgtaaattagttcaacccttgtggaagacaatgcggagatttctcaaagacttagaggcagaaaaaccatttaagccagcaatcccattactgggtatatacccaaatataaatcattctattataaagatacatgcatgtgtatcattgcaacactatacacaatagcaaagacatggaatcaaccttaatgctcatcaatgatagacaagataaagaaaatgtggtacatttacaccaaggaatactataatgccacaaacacgaacgagtcaaacttcttttcttcataaatcactcagtttcaggtatgtctttatagcagtgtaagaacaggctaataaattttccttttatttttgactgatattcttaattgaaacttttaactttccatttaattatttacatattattgcctttgtaacttttttgttatgctgggataagagatttcaacttcttgccttttgagatattctagtatttgaatatttagatacttactagaaagattcaagctataaagtattagttactaatttagcataaaatctttattttgcaaatactaatacttgcaataacaggtaccagttatgaagctttctgcatgatccaggcattacaataagtgttttgaattgattatcttattcaaaagatctagaaaaactcccttgctatgttgtaaagctttaataaatggtagctattatgacctcacaatggccctaagagtaagtactaatattattcctattttatagatgaaagtgaccttgttgaggcagataaaactttttagtagcaaagcatagatataaatccaagtctgaatgttcattcatccaactcttatcagctatgctcacttgctcctacacttgtacacttttttgaatggtggtttccttttaaggggtgtgtatttgtatgcatacacacacatatataaattcagaatactgaaattgtaaacaatggcacatcataactattatataggaagaattactcaatgttaaatatgtttggctcttgacatgctatattgaaatctgtgcaaaattagtcaaaatacactacacacacacaatcaggttgacaactgtggatcaaggcttttcattgcgttgtctgtctatgtatatgtaaccctttggagtgatcaataagttttaatgggcatggaggaattgcacttctgcagtttaaaacatactgcataatcatagcaacagctttagataataattgatagccatgcttaaaaaccaactccacaggcatggtagcacaaggcacaaaaatctggtaaagatttgcatctctaagcaaaagaaaatatttatatgttgaactttgggagaatccttgggcaaaagatcagatggtcacaaaggaagctgagttactaatcacaaggatgtaaaatgctttatcttatgaagtatagaggacttcccatagctgaatgtagcatacaatgagtgccaaagttcaggacagtagcctggtaactaaaatttactattaattactgtaattaatttattattacaataatttaataataatttaatttatattaataattaatttattactgtaaggtaataaaatttcttgaataagtactgacattgaaatcatgagcaaaattattgtcaaatacttagaaggcatcataagtcatttgtttcttcgaaataaatattatatgataattaagaaggtttattctgtaaaactgtctgtccaatttaatgtattttgttcctcattttaaattgtctttagtacaaattgtatcagaaagaagagatgtatgttgtcttctggattcatattaaatacggaatttgagcaactgtgtgaattaactgcacctgcaaaaattgcaaagcaatgagatttaatttttctgatccatctggccttcctctacataccatctaacactgaagtaatgaaacacattctataattagggatggatattatcaagtataggcttaggaaaaagacttgtatttgtctttatgtgttatttcatttttttgtcaggagataataggcgtatcatacagatgctgagcattttgtctgtatggtattttaatgacatactcagtgaatacagtgtaataatttcataattaagtctcctttgaatagggataggatgttattatcattattttttagctgcctttccagtggcaaaagtaggaatcttcttcactaagtactccagagtttcacataaaagcaaagagaaacatatcaaagacatttagaactcgatggccactatagaaatctgcctagcttacctttcctttaaatttataaataaagaatgagagattccaagagttaactcagactgaatgtattaaattttttagtgcttacattttatattgttacagacaatgcatttacaaggtaaaacctattgcactgatatacaaggcccattctcaaatacctattatagttggagatagcaaaatgatacagttaatttccaaagttatttgagatgtaacttcaaattttcttttttttttttttttttttttttttttttgagacgaagtctcgctctgtcatcccggctggagtgcagtggcatgatctcggctcactgcaacctccacctcccgggttcaagcaattctcctgcctcagcctcccaagtagctgcaattacaagcgcctgccaccatgcctggctactttttttgtatttttagtaaagatggggtttcaccatgttgaccaggctggtttcaaactcctgacctcagatgatttgcctgccttgtcctcccaaagtactgggattacaagtgtgagccaccacactcggtcaacttcaaatttttctaataaaactttaacctgaggaattacccaaaacatgttctcaaatttaagggagttaattctatgaccttaagtaagaaggaaacacaaaataagtaaggtatttttattttaattccagattttaaaaaattattttcttttttaattggcatcaggcttactagtcgtggagagctttcaggaagcaatgaaaaggtcttttaaataaaaagccttagagtatttttaattaaacttactggccaaaaaagaagagaggcaaaccatttgcaactatatcccccttgtacaaagaggtctacaaaatgatgctctgagaatgggtacagccagaacgtgaacataaaatattttatgaagggttaaaatagaggatctttaaagaatgagaattaactcagaaaagaagaacatgtaaagaaattttcatcttggtacattggcatatttctatttgcattttgggtataataaaaagcactggcttatcatttacagctatgttttatattactatttgataggagttttaaatctcccatcaggtgcttgcttcggcagcacacataataaatctctcatcaggatatagatgatatagaaggtacacataattatataataatcattttctctttttgggcatccttgaatgtaggcacaaacatatacagcataaacatgaactgccatgtacaagaagaggcaaattctgagcatatgtattttatcttaaagaggtgctcacagttgagaatgttgcaaaaattgttgttagcaatatagcaaaatattcacaaaatgggaatgagatatttgaaccttaataagtcatacaactttccttattcctgagaaagaagacaatttattctactaaaaatccacaaaactacaaaacctttagactcgcttgaaaaaaaaaatatatatatatatgcttacaccaaagcacctggtatatactacttaatataaattacatattaaatacagtaattacaatttatggcgtaatatgataattacaattagcataccaaattgtaaagcatatgactaatataccctttcaacagcacatgtgatttcagtcaaatgaggaaagtaatgcttcaaatcacatacattatattttaaaatattaattataataaatttcttactatcacatttatttttttaagttccagggtacacgtattggatgtgtaggtttgttatggaggtaaatgtgtgccacggtggtatggtgcacctacagacccattaggtagatattgagcccagcatccgttagctatttttcctgatgctctcctcctctcccagcaacaggccccagtgtgtgttgttctcttccctgtgcccatgtgttcccattgttcagctcctacttataagtgagaacatgcagtgtttggttttctgttcccgcattagtttgctgagaataacagcttccagctacatccatgtctctgcaaaggacatactctcattcctttttatggctgcatactattccatggtgtatatgtatcacattttctttatccagtctatcattgatgggcatttgggttgattctatgtctttgctattgtgaatagtgctgcaattaacatacaaatgcatgtatctttataataggatgatttatattcctttgggtatatatccagtaacggccttgctgggtatttctggttctagttctttgaggaaccaccacactgtcttccacaatggataaactaatttacattcccaccaacagtgtaaaagcattcccatttctctgaaaccatgccagcgtctgttgtatcttgactttttaaaaatcaccattctgtctggcgtgagatggtgtgctgaggctaatatggatgaattgagagaagtaggcttcaaaggtggataataacaaacttccctgagctagaggagaatgttctaacccaatgcaaacaagctaacaaccacgataaaacgtaacaggagcggataaccagaataaccagtttacagaggaacatgaatgacctgatagagctgagaaacgcaatacgacaactccacaatgaaatcacattgtcaatacctgaatagaccaagcagaggaaagaatctcagagcttgaagactatcttgctgaaataagacaggcagaaaagattagagaaaaagaaaagaataaaaatgaatgtacaaaacgtctgacaaatgtgggattatgtaaattctgaagcaaagactgtttggggaacctgaaagagacggggagaacggaaccaagttggaaatcacacttcaggatatcatccaggagaacttctccaatctagaaagccagccaaacattcaaattcaggaaatacaagatactcactgagcagaagccagcccaacattcaaattcagggaatgcaagatactgagcagaccaaccccaacatacgtaatcatacaattctccaggtttaaatgaaagaaaaaatgttaaggacagccagagagaaaggccaggttacctacaaagggaagcccatcagggtaacagcagatctctcagcagaaaccctataagccagtagagattgggggctaatattcaacaccgtgaaagaaaagaatttccaaggcagaatttcatatccagacaaagtaagcttcataagtgaaggaagaataaaatcttttccagacaagcaaatgttgatggaattcgtcactatcgtatttcataattatgatcaagataaaatatatatcgatcagggccaaggcaattagaaaaaactgcacaaattacaagtatgtttataaaaaattacagggaatcatgatcatttgagtttttaaagaagtcaatccagggtatatttgccctcttttctcattgtaagcctccagatagcaagagttattatctctccaacatttagaaaaaaagtattttctatcttcttaggctaccttctaatcaacttaaataccctcagcttgtgtccaggtattattcaagtcaaatctgagtttgaaatgcaagagagcagtcctcctagctgattattttttcacgttttgatctcttgccatgcaactgcttcaaaaggtcaaaaatgcctcaaagctctgacctgaacagcaatcatacgcgcaagcagtgttctttatatgagtacaactgggtgccttgtcatctcaatcacgatttccacaccctgcctcacaataggttttaaccattatgagaactttgctcattctttatactaattatttaaaagaatttttgaaacaattgagtatatcatgtgagtagtcattaatgaaactcatttttctcccacaatcattatagaaaatgtacatacaagtgagctttgttcttcaaagtcacaaccttacagctcatattcttggaattctccttatgtaattttaatcaaggtcaatttaacatggataaaagaaaatcagttgctcttatatgatactatttcgctgttgtctctgtttacctccttttaatttctcttttcctgagtagctccatttctaccttcctgtgagctcaaaaacagccagcaaagatttggatcaatcccatgacagcataatttttggaaaggcaatgagagaaaactgaaacataagcttaagaaaaactcaagcttagtgttctggaaaacaacttacatgatgttaagtccttttatttatttctagcccacaataggagcgtgtaactgtttgaaaataaaattaaaaggagatagtgggccgggcgcggtgacttatgtctgtaatctcagcactttgggaggccgaagtgggaggatcacaaggtcaggagatcgagaccaccctggccaacatggtgaaaccccatctctactaaaattacaaaaaattagtggggtgtcatggtaggcacctgtagtcccagctgctacttgggaggctgaggcaggagaacggtgtgaacccaggaggcagagcttgcagtgagctgagattgtgccactgcactccagcctgggtgacacagtgagactccatctcaaaaaaaaaaaaaaaaaaaaaagcagatagagaaccacaaaaagccctccagacacactgaactacatgacttacatatcaaactcaacctttttcccctcaaatgctttcttgtctatgcctccattttatcttcattgtatccctatgagcaagtgaagagatacatgctgtaatgcatgttggactttatttcataaagaaccatgcaaatcaaaaccagtattcttttattatagaattatacaagttggaagacatcacgtcaattgcctaggtggtggtctcataatttctagggaattaaaaataaggcttcaaatgcttttctaccaattggaataatcaaatcagtaatatttcgatgacatgtacaaacttcatcaaaaagtagtcccattccaagggaatgagcatatttatatagtgtattcccaagaagctctcccttttcacatttcagggagcattgtggaaaaccagaatgttgggattcacacacatatcactgtctattttctttaaacatttattttaggctcaggagtacatatgaaggtttgttacataggtaaatgtgtgtcacaggggtttgcttaccaattatttcatcacccaggtattaagcccagtatccaatagtcttatttactgctcatctacttcctcccaccctcccacctcaagtagatcccagtgtatgttgatcccctctatggtctgcagattgtatcaaaggcttagtaaagatgtagatttttaggtccttatcacagcttatggatgagattttctgagcaaaatgtttaggaatatgcattttaattagctcctcaggtggctactatgcagactcaagtttgagaaccactccatgcaatgcaaatgaactagaagatgacctacagttaactgttacagctccctaaacatgtcccttaaaagggatgcacgtcaaaataactttctttatcaaataatggcaatctttcttaacacggcaactgaccattttatggcagcaataatctgtggaagcaatgggtacatatgggaatactctcagtgttgggttaaaaagtatcaaattgactaatgtctcatgtatttattacataaataccaatgtattgcaaagaagccatgggcagatcacataaaacaggaggaatcataatatagtactaaaactactattaggtcaattaattgctaaagtatgtttaatggaaaacaaatggagtttttattatgtaatgattgtgtgggaaattattacaatttatattcatatttcttcaaattataattttttaacgtaaaattggattaaaagtaacattgaactgtgattgaaaatcatataggctggtttattacgctgtcttaaattgtattcctggaggcaatactacaaacttcatgtctccaaaaggcatttcctaagtgctacttatcagatgtcaggtctcaagaaaacaaattccatgtacttgtctcaatatagaggaaatatttgcctaaaatctattgaatatggaagtgtatgcctgtgcattgagctatgaattttgagtaaagttattccttataatgccaggctatgtggcagaatatgttaaatactattatatataatgtttatatcttgaatgactactcattattctaccatccaactacataagacaaaaagaggttcaacttttaacgataccccattttagtgactaaatctttaaaaattattataataaaaccacataccccaaatgtagctgagatgttttcataatctacagcccgtatgtgttagtataactaagccacattcataattttatgaaatcagcagtctatggcagaaaaggtacaatagtcagataattaactacactaataaaaaactttccaagaaatcaaaagacctgaaccctagttctcctaccactaacttctcttgaaaaatttacttttcttccctaagtttcatttttctcaagagtaaaacggagttggctaatgttcctcgtggttctagcaatctctgatttggggttagactgtgattatacagttcccagcattttgttcgcctgctctaagtcactcagttccccgttactattgggctggaagaaattcactctagggcagtaacaagttcagttaattagcactctacctcaccaccattctccaacaacaagacaggcaaaagaatcatgtttttatttaactaaacacagggcaaaaactaatctggttgcttcttttgtagggttataatgtcactctcttaatgcaggtttaaaaaatctctgagatagtctgtagcatgataattggtatcactaacctgtgctgtactcttttcaagtttttggactaaattatcccaacaccgggcaaagttatccagccatgcttccgtcttctgggtcactgacttattcttcagtgttgaaagaagatcttgtttgagtgaatacagtttgcccatggattgctttttcttttctagatccgcttttaaaacctgttaaaacaagaaagatcacagaataagcctgggttgcattccatacaccactatagttcaatctgcttttgcgtgtatttgctcatttgcatagataagaaaatatttcaatcgtgcccgcaaaggatcaaaagttcagaaaaatagaggtagaaagttataatctatctaattatcccaagaagtttgaagagaaaagaagagaaaagaaactcaaacgtagaataaagacctactagaggtaattaagagctaccttgaaatatttgaagaaaatccaagtgaaaaggtaatattgcttcaaaaggcaaaacagagatcaacatgtggaaattagaaggcacggatcttggatttccccttaattcctgacggaattcaaacgaaaactgacaatcaggtaccaggagtactgaagaaaagctagtgagctgagaaaatgagaatggctaaggaaacttgccattctgaaatgctgtgattatttggataaaattacaatattattgtttccacagttttaacattcggttcattatttggagataaaatctcattatgtgatttactgaccataaaatttttgtagcatccattaatcaattaacatctggttatttgagtaattattttttaaaactaattgtagagcccattaagtaaaagaactaagtcgctgggcatgacataaatgcttcagcatctcttttcagagtttataaatacttatgtgtcttatgaagcaatttttataccatttatatttccaaagttcctgtgagctgtggagggttacaaactccctttggttgatttgaaaggaataagtggtttatgtgaaatcagtaaatcagggcagtttttcttttacttgactcagtaactttgcctgatacacagacaaattcaattcctgggtactgaacattactccctgacttaatctgtaaacaaaggagaagaaggaagagaaataaaggagaaaattatcttacagccacttaacaaccccatatttggcagcaaatacaatgaatgtaaactaaatcgcgatacctgtctttccgaaacaaatgtaagtttatttaagaactaacataccacagagcaaattgtcatgacacaaatgcaccaattgcccatgaagcaaagtgccccaaacctagagcagtcaatacaccttcctgaaaaggacaatctaagtagcccattttggcatggcacctgcattgatagctctgaactgcagaatgctctagtggctccttcaattagtttgtcttttactcagaatctgcttcacctggagtatgttatagttcagtcttcatgccatttttaaggggaaacaaagcaagatttaagtttcatctctaatttttccttaacaataagttcagtatttttctaagtttgaaagaatgcaatagaccaaaatacaaattaagatattatacactgaattcaaatcaaaataaaactcacggtgtgggggtttagcaataggtaggtggtttttcttttttgttttgagttggagtctaactctgtcgcccaggctggagtgcagtggcatgatctctgctcactgcagcctctgtctcccaggttcaagcaattctcctgtcagcctcacgagtagctggtattataggcacatgccactaagcccagctaatttttaaatttttagaagagacaggagtctcaacatgttggcctggctggtctcaatctcctgacctcaagtgatccacccgccttggcctcccaaagtgctgggattacaggcatgagccaccatacccagcccaatagataggttttgcatattcattttgtttaattcacttgttagttttccattaaatttaagtgaatatttgcattagtactagaacaaaggttgatgctacctgtcccaagctgagagccatatttgaatttcaatgtatattcctccagttatagtgtcattttttttctttactatggaaagaggcacaatatacacaaagacacaaatctaaaaataaaaaaaaaatctaagtacaatcctctttgacttacttactcagaatgttagaaactattttaaatagccatatgtgtaaggctgaatggtctacccattatttaaacaaaatatgtaatgatttggaaacatgtcagaagaggagtgtgagaattatgtttaaagaagaggattgcaataaaaacctatgagtaacctcatggtacctaaacaaatgaaaataagcctcctgttttattattaagccacatgaagaaacatttggtaagcattacaaaaatgaaagtgaaagtcaccattaaaaataaaattagaggtggtggctcacgcctataatctcagcactttgggaggctgaggcgggcggatcacgaggtcaggagttccagatcagcctggccaacatagtgaaacctcgtctgtactaaaaatacaataattagctgggaatgttggtgcatgcctgtggtcccagcgactcaggaagctgaggcaaggaatcgctggaaccagggaggcagaggttgccctgagccgagatcacaccactgcactccagcctgggcaacagagcaagactccatctcaagaaaaaaaaaaaaatccaattaggaaaaaagtgcactcaaggtaaagtaaaatcaatgttataattacattgtgtgattattgaataaatgaatttttatatgtctgtatgacaaaaacactgaacccagacttatacctagtaaattttagatatgagtatcaaaaatgatgatggcagattagttgtttggtctcagtttctctctctttttctgtctttcagtagtcatctcccagttccagaactcccccaggattattaactgagggaggaaaagaaagaaaatccatgatggggccagatacattagatcatagaattcattagaattaccttgtcctgtctatccattgatgctgattcttttaagcttaggtcttacatgtgcatattaaataactatgatttgttactaattattgcataaaatatgtatttctacatatcaataattaaccataggtctatgagtgccagagacccatagagctctagaaaattcaggtggcaaaaggaagatctagagaatgtgtacaaggcaaaggccagctgggatagtaaaagaataaacagactttatttttatagaagccaggaatgtagacctacctccaaggtagggaggaaggtacagtcaataaatcagactgggtcagtagtggatatggagaagagacagataagctgttcaagatgatttgaagtgaaaagataatgtatccttacaaaaggcccaggaaaccttcacctcactctcatcaggaatacgcataagagaataatgccaagacaatttctcctatattggcaaaattgagttttccacctatattatgtgtagttacttatctacatgtaagatgtgctccaattcattctaatcaccagttgtactttgggaggttgatctattacagaggttctcatcttgaaagaacatcagaattacctgaaaggcttgttagaatgcagatgactaggctccacttccagagtttctaaatcagtaggtctgaagatggcctaacaatgtgcattcctaacaaatttccttgatactgatgctgccggtcgggggaacacattttgagaagcattgatcctgtctgaattaattatttgagggccatcccaggagttgaggtaaaggtagcaagtcaaacaggaacttgctcagttaccatgagcacttcatccatgtcctttgatcccacagccatttgagaatatcttcaattcctaagtacttctgtagcccttatataccataatctcttggatcaccctgcttccccagagctgtccttccccagcaaacgccaacagtccccacagcagaaatacatttactcaggaacaggtttcttcttgacttggatcttcccacgataatttacgtgattctacaagtcttataattcacctcataaaagctactgtttcttctttcccttcatttttatccctgatgccaaatcagtttaaaacttaaatcagttttgattataaaaaataatagatctacatgatttggatatgaatcccaaagatctagagcaaattaaatgtcataatccccacctcccacctcaatggcaagcaggacacaatcccatgggttatcagtgatactattttgaaacaaattacacttattgtaaagagaagagagtttagcacagtgtatctatacctagacatgtagtgaaaactggtgacagatggtacctgttttgggtctcagattgtgacatattttaatgaacattaaattcttattcactgcctgagtcagcaaaggaattttacctcaaattctagaccagctgtcaggttttgttaattggcttaaactatcaaatgacaagacctatagaaaacatattttctctttgttcacaagcaaggtgacataacacaaattttaatcctattggaaaattattgactttcttaaaagagcatttttatggccctgaggctagccaagatttctgctcacaaaaatgttaacatagaggcacattattgttagaaatgacagttctcagttgcagttattttttccaaggaatcaactgatatgaggactactgaaatagattgaaaggcctggacctgagtctggatgtcttagtgttcattttaagtctgatactaatgttgtaggatacagatcctgtgttttttcttgatctcgattttctcttggaaacaaactgagtagatggtcctaatgaactttacatgtgtaatgagattgaagaaacactagatgagatgcaaaatctcatctagctttaacatatttggattttgtcagtttgtggcttcctaagaacaactttcttgattggtaaatctagtcaacaatatatgcaggaactttgactagatattaagatttggaatttatcatcatgtaaaataactgtactattctggcatgtggtactttccaaagatggctgtaaaatatcctcatctcagatgctttgctataacttgaccttggtgtttctccatgaggaaatgaaatctaattcccttttccttgaatctgggcaggcttgtgactttttcagcacacagaatatgactgaccatcaccattatgattgaccgtctgaagcacatgattctgtatttaactagcaatatatcttcgctcctaatcagagggcatgactgcattttgataatcagtggtcactcacttatttactgaaaggattcacattttgcctgagaagaacaatgtttgtaaggaatattctgctttaaggagatgtaatccatgcatccattcctctagatatgatagaatccctcatgaatttatcctctcctctctgtggcatgtgacagtgtgtaccacttcctacttttttgaaatctttattctcctcacttttgtgataccactttccccttgtggtatctgctcaatcttttggtcaacatcttatcctctgcctactccttgattgtagacattcctccctgaaatctattcgtttcacttaatgtgtcactctacacaatccctcagaagcattttgattgcttctgaatcaataactagtcatgaaccattttctgagattctagttgtgtaaaccaactgattaatggaaaggatttttaacttggatgtctcaaagacattttacacggaatatatccaaatctgaaataattatcatttttgtcattccagcaattcctcttctattctcctgttagggctaataaccctcctaggaacccagtcacccaaatgaaatgtctaggaaccatttcaaacttctgcctcttatcacaagtttcattcatcacatcttaacattctaatgtttctcttcttatcttaatgcccaatgctacttagttcaggtcttctgattagtcctcgtaccatcaaacatcttcctaccaaaaagaattacaaaaatgcaaatatgattcttttgcaaactctcaatggctccccatcagctgcaggccaaaactacaaatacagctgatatttttgcactcgtgttttcaaacatatacaggttacttttctgaactctattttcggcagtcacatcacttaataaagtccatattctttgagcaataatttcttatcaataataagctagcttgtaataacaagtaatacataagtgaatctattttaaattaaaagaccaatgagggttagcatttatggagcaaaaaaaatgtatgaaacaaataaatagctggtaaaatggtacgtatttaaaatgagtggaaaaatttacttaagtttagaaattattgcattattatgaagtacaatgcaataataaaggtgaaattatggaacactacttacaaccattttgttttataaaagttcatatcaaatgaacatttaatcaaatctatcaaaaattttaagaaatcataaagtagaatatgtcacgtgaaaaattaaactcatagtatcagaccggcctcttttactagaaatgataaaattcacagagtaagagaaactttagagtttttttttttttttttaaatcttggaaattcctgctgaaaccaaatgcttcaatgaagtcttttctgaaatccatttattgccaaagaaatctcattctcaaaacactcgaggtatttataatcaatgtcatttgataggctttaatttttttttgcttgaaaaactaggtgatattgtttggatctctgttctccaaatctcatgttgaaatgtgattcccagcattggaggtagggcctggtgggaggtgattggctcatgagggcggatgtctcatgaatggcttagcacaatccctttcatgatgagtcagttcccattcagttagttcacatgaaatctggttgtttaaaagagtctgggaccttcctcttatctcttttgtttccactcttgcaatgtgatatacactggctccccttctccttctgccatgattgtaagcttcctgaggcacttaccaggagcagatgctggtgtcatgcttcttgtacagcctgcagaaccatgagccagttaaacctctttatttcataagttacccagtcccagtctcaggtacccctttataataaactaaggttaaactccatcaatgtcaggataaccgtcgcttgtaactctcacatattattctgagaatcaacgtcagtctatttttttagaactatgctgcttagaactttatgaaaggctcacagacatttcttagtattactttattaattttaattgaagtcttattctggtatgctatgttttatcaagagtacaactttgaaaaacaaagttgaaaatccacctatagttttttcccactttaattcagaaaagtagcaatataacatctttgaataatctatgatccaagcaaaaataaacatttaatattcaatagcatagaagagactaaataatagtgataatatacagtactgggtttttataagaccattgaaagctagaaagtacatacggccagtttttgaagacttgataacatttcattttgatctttaaagccagttgtgtgaatcttgttcactgcatcttctttttctgaaagccatgcactaaaaaggcactgcaagacattaaagaattccaaggaataaataaacataaatctttacttttccaatttaatatccccccgtgtcttttacagctagtttctcacacatgacacacctgttcttcagtaagacgttgccatttgagaaggatgtcttgtaaaagaacccagcggtcttctgtccatctacagatgtttgcccatcgatctcccaatacctggagaagagacaatcaagcacagcatcagcaaacaattggtaactacgttttattaaaaatggcatgaataatttgccaaagtatctcagtctcctatgtacgctagaagttggaagggacactctttctgatctgcttacatttaaataagtggtgtgactgtcatttgtctttatctcaccaagtcttgtacctttcatagaaaagcaaagagacaagcaatatgaagtggttattataccactatataaaatggctccatagcaaatgtaagataacaaagacatacatatagagaggattttgcagtgagaacaagtaaaaggtgtattttccttaggtttgaaaatacaccctaaagaataaaagtctaactactaaatagaatgcctcaaaagactcttaattgaaacaatcttgcataatgagaattgcctaccatttggattgtagaagaaaattcttagtaacttaaattctattactatgtagatttttcaattttctcaattattacaaaagtattaaaattttctgtttctaaactactctagtgagaaaactaacaatctctgagtaaaaactactatatcattaacatgtcactaatgtctaagaacacacactattttaatatgtaacataaaccaactatcaatgatttttggaaggaaaacaaatattgtgatgctttctatgcaaaggaagcatttcaaaatggcagttagctcaacctcattatgatgcactttatagcctgaattttcaactttttgtaactttttcatataaataagaaacttattttctcatatatatattggacctttaaagctagaaatcataaaatattgacgtgctttattttatatagaattagagttagaaaaatgtttataactcatatttttgaaaaatctactcagtgtctaaggtctcataatttctatgttactttatactacatatgtgtattaacccacctagaggatattaacacatgatttaaacaatgcaaatgaaattagcatcatgaaaataatccacctattttttttttttttgtagacagagttttgctcctgtcacccaggctggagtgcaatggcactatctcagctcactgcaacctccacctcctggattcagggaattctcctgcctcagcctccccagtagctgagattacaggcatccaccaccatgtctggctaatttttgtatttttagtagacacggggtttcgccatcttggccaggctgctctcgaactcctgacctcaggtgatccacctgcctcagcctcccaaagtgatgggattacaggcatgagccactgcacctggccctaatccacctatttctaagtgactaggagagtcacgtttcttaaattgtttaatctatcaccacttaaaaaaaaatacacgcatgggtaaacagaaggcagtcaacattttcctacagtattaacataatcatgtacttatatgcagctcaatcataagtgagttttcagtttttcttcataaatatcaatgttattgctttcagcataatgtaactgttaattttttgtagtttcactttctactcaacttattttgaattatgtttacaataaaagccatagcgctcaaacagtgatgcgagatacccacaggaaatgtgcgagcttaaatcaatgaatttagtcacttcaaccatctaattattacgaagcagtatatataggttttttctaaaacatacttgcatttttttagctaacttcctagtgaccctgtcagtgcatgtcaggtaaaatggcacgtaacaaaatggttaatagattagttgtgggagaaaaaagcttcaaatggagaaaatcttatctcttaagtataaactacaccatctacctgacgtgatgatgcagatctacaaagtcaaaatgtgggaaatttattgtagcccatcaactccagtgaagaagacagtcaagggaagaagggacaaactcaagctatagcatcatattcataaacaaaaaagactttcaagtatatatagcatcttctctctagtgctacaagacatatagtatccactgaagcagcattttaagcttgtaaccccataggtggaaatgtataatttattaattttagtgggaatacaaatccaaataaagatcccctattccaggttgtataacattttcaaatttattgaaattctgagatgtactaatgggatgcatttaatattgcagttttgttcactgtatgagtcacaaaaaactaatagagtagttctcctttatccataggggatatgcttcaaaatcctcaggtggatgcctaaaactgcaggtagtacaaaaccctatatatagtatttatgaatttatttttctttcttcgcaatttcacggatagacttgctcttaccacagattttgagcaaccccagcatgcgatttttttcttgccttattaagttgggaaccttttcacataaagaaaacccttcacagtttttctttggcatatttgaactgccaccataactactcttgcactttggggccatgactaagtaaaactagggtgacttgaacacaagcactgcgataccatgacagtgtttctaagaacctagacaggtactgagtaatgggcgggtaacattgacagcatgaagacgctggacaaaggggtgattcagtcctgggtgagacagaggtgggatagcacaagatttcattatgctactcaaaacagcatgcaatttaaaatttatgaattgtttatttctggaatttttcatttaatattttctgactgtggttgactgccagtaattgaagccaaggagagcaaaaccatggatgagggagggagggagggagggagggagggattgctgtaattaaacactcttttaggtacataggcaacctatttaacataactatttaaaaaatgccacttaaagtgttctttatatccaaataatggagcaagtttatgattcagctaatatctaggttacagttaatgacagccatcaatgcattcattcattgatcatgaatttattatataacaaatatgtaccaaatatctggatatgccaaatattaagagaagatgttacaggctcaattgtgtcccatgaaatccatgttgaagccctatgccccacctactacatcggaatgtgcccatatttggagatagagcctataaatagaccattaagttacaatgagtctattagggttactctagtccaatatgatgggtatccttatgagaagaggaaatttggacacagcaaaacaccagggatatgtgcaacacagaggagagaccacgtgaggatacaggaacaaggcattcatctgcaatccaaggagagaggcctcacaagagaccaatccttgccagtaccttggtcttgaacttctggcccccagaatggtgagaaagtgtttgtattgtttaagccaccagtccatgttattttttaatgatagccctcacaaaggagtaatacaaaagacaattaagatagatggattctttttcaagaaatacttggctaaatgtctgtcgaataataataccaacccgttaaagaattgcaaatgttaaacaagagtatgtatgggaaagtattattaatttgaaacaagttatttaagagttggtcgttgtttacaatttgcttgatcatggttcttacatcaaatctaagaactgccaagggtcatctattttactgtattcactgtagaaaggcacccattaaatctttacgaataaatgtttagtcttcaagtatattctttaaaggtttccaacacaagacagcatgaacacatatcctttagtaacatattctattgcttaaacctatcttactcttagaaaatactcaatgaattgaatctaagtcacttctgtagcaaggcaggcatagtgctttccactgatctcagtgtaagcggaaaagtgaattagaaattacttgctcatacgctgtaaacatctgcccatacatttttgtgatgccatatgcacaagtataaatagataatacacgaagtgctttaaatttatggatttacctatttattgcttagcaatattggccttaatttgaattacaaagaatgaagcaaagcaattggaagactatatccctcagctctggaatcactcaaagatgctggttcctatcattgcctgaatggctataacaaaattgttagacaagtgtaagaaattggataaaatggggctaatacatatattttttaaagaaccactgtattaggattagaaacctcttctctagagaaaaaaaaaatatgtaacttcaactctgtttctctgagtttctatttacgtataggaatcccttgagcttttagcaataatgcatatttttatagagctaaacattctacacataaatgtaaaaccaatgaattacaaagtctcacaaaatggtaaaagaagttaatttttatttatattctcattttgtctcagcagtaagtgaagctaaaggtcagctcacttcgtctaacattttcatggactaaatcacaactccattatcgtccatgctcagatccacaacggggaggattttttcctcccatttaattcacatgtcatattgttgtacgtgccaaggacatttctcatctgaattcctttgtttggttgagttgctatttcaattcaaaagtgaaaaatggctactaaaagaacatttggataaaggtaactgaggaaaatctgacaagcctgggaggtaaatcttaagtatggtgacccttgaatttactggagccagggatagaatatgaaacctaaactgtgcccatcagtattggcgttaagagatagagtgttcccaggcgtatatccactaaggcggaaacaattatgtgccatggaccacacaatgcatcagcaacggggctttatgaaagagggaggcagaaaacaacccatcttattttattgcaggttaagaccctataatacacttctctgctaaatgaattttatgtgtaatgagccctctgaaaatcccttatttcttgatttttctcttactttatcaacaactatgcagttaaaacgtataagcaacttactcttactgatgttgaaatggaaatcacatcaaaaaccattgaaaaaaacaaaaatccattatgaggcagaaatgtggcagagtcctactgaatagtgtttagccaagggtatggcttggttctcagttttacacatttctacaaactgaactgaagcaccatactataaaatggtgtaccttatatcttcactgtataacatatggtacagggcggataaacctattttgatgagttatgaaacaactactggaagttttttcaaaagtataattcttacttctatttaaatgatcctgtaataatctcctgtctgaactcaaggaatttttagctgtcacttccaaaggggcaggttacagatgaggaaactgacagataggttaagtaacttgtctgaggtcacagaagccacagtactgagtgtctgggatttgacctcagatccatttggctacaagttcatgctcgttcataatggtattcattcagtagggcattcattataaaagatatgccttctaatttgtgctacacaacctacagtgagatatccagatgccgaatccctttggagtcttttcatattttgttttagcagaagtttgactagatttaacatttaatctaatctgcttcacaaggatgtgaagcttaatgttataatttgattcaaaaacatttgacactgtaactctgtatttgtttaatcataaaacgtcagcaaatacttgcacttccagattaagaacatgtggcctttgcaggacttatttttaaaaggtaagtatgactgatttgttcattaaattctgcctttgcaattgtgctgaaagtgtagtgagattttaacacgaagaagcatgttcttctctacgctatttcagtcagtttcctatattatttatttgtgtgagtatacaaagtgctaatgaataaatctggaaaagccttttgttgttgtcactgctgttattctttgcaggatattatttaatgtcttttttttttttttttggcagcttaataaactctgtactctccagctcccaccagtctgttcaattgggataccagaaaataaagagcaggagttctaaggagcattccagcgtaacagtgttccttccagcattcatcacattcccaggcattccttggtagcttgaggtttcctcttccttatcgttttatacctcgcagactctgagctccttgaggtgggctccttacctttgaggttaatgtcttgcacaaatatcccaaaactgaatactactactgtcgttatcaataggtggctttccccacccaacttttgtcttagaaccatcttttttggatctttcaatctgctaatcattacataaagtataaacttcctgcattcccacttcagttctactgttgcccaactttgtaatatctgtgaacaaactcaatcttgctgtgctttagttttctcaccagtgaaatagagataatagtacagactctcctagacaggtaactgctagggtcagatagatcaataaatgtgaaagtgctcttaaatctgtgatgaattattgagatgcttgtgatagtaaggatttagagctcagtcgataaaaaaatcagcctttattccagatgtgataaatctggagcatgatagaattttaatatagaacacagtgaaacattttagaaggacaattaatgataattttttttgcatttttttctatacttgataaagcttatgttttatacaagaattgaaaatttttacctttacaattttaaacaacagggccatattccaataggtatcctttttttctttttctttgagacagagtctttctctgtcccctaggctggagagcagtggcgcgatctcggctcactgcaacctccaccacccaagttcaagggattcttgtgcctcagtttcccaagtagctgggattacaggtgtgagacaccacacctggctcttttttgtattttagtagagatggggtttcaccatgttggctggtctcatctcaaactcctgacctcaagtgatctgcccgcctcggcctcgcaaagtgctgggattgcaggcgtgagccactgagcacgggctccaaaaggtatcttatttgaaagcaagtgcatagaagataaatatccctctatgtctcatgccaactcttgacatcacaacttttcatccacaagaaatcacaaattctaacgtacatacctaataaaatgcataagataatgtaggtgtaacagaataggtagtaatggggactgtggctaaatgaagagcctgtgctagagaaaacagggcaacttgactcctgctctggttactatgtagaaaaacagactaaggatcatcagatcatttgctttctctagagaggttagaaattcttagttcatgtcacatttttttcaatttcaaacaatggtagctaataaactactattaaataccatagggactaaatagaactttatctaaatacatctgtaattttagatgcaatagaccaattcctagaaagacacaaatgattcgagctgactccaaaacggaaaatctggaaaaatgtaatgttgaaattccaattaaaaatggacatttttatgtgtattaaatacataaaaatttaattttaaaatttcccatttgcaaattccagttatgaagccagttaccaagcctgcataatcaggtacttaaacctagcaagcatattacaagaaaggaaaataacaggccaatcactttcatggacgtaaaggaaaaactatgaatcaaagaaaatctagcaatacacaaaaaagattatacgtcttatccaggtttagtttattacaggaagaaaggcttttttagcattagaaaactaagtcatgtgatttgacatatagcagaataaagaagaaaaatacgaccatctcaaatgattctggaaaaatatatgataaaatttggcatccggtagtgataaaacctcttagaatattaagaacagaaggtatctacaacaaacctacaggaaagatcatacttaatgattatttattaaagttcttccctctgagacttaaaatgagaaataaatatccacaatactcccattgtactagagtatttatacagtacaatatgtcagggaaaattaatgacatgaaaaataattggaaagggagaaagaaaactgtcattactcaaaaacaacctatatatgtacatctgaataatactacagataatgtattcaaattattaagtaaatgtagcatggtacctggatacaagaccaagaaaaaaaatcaactgtatttctttatatcagcacaaatagaaaatgaaatttcaaaaatatattcataacagcaaaaatataaaaacccaagaaataaatctcagagaaagtttaagagcctttactttaaaaactataaaacattattgagagaaaataaagacctaactaaatgaaaggattgaaagactttacataataaaaatgttgattctgtacaagttgatccagagaatagatgaaatccaattaaaaccacagcagattctttttgggggcagggttcacaagctgttcttaaaattcatatggagatcgaaatggccaaaagcagtcaagataatctttaaaaaggaagaaaataaaatggcttttactgaccaactgaccaaaacaaacttaatgtgactaaactctagacaggcttttatttgactataggctcctgacctctcttttcttagagcgcttactttagggaaacttgcaaccaaaaacatattctctgcctctttgagatgtaaatcttctacaatccgggaatatctttctcaaggacctaggagccatctctttgaaatgtaattgttaatgatagcacgcctatctcccagtctctgtgggacagtaggagcctaacttcattaagtgccaattaacaatcacagattgcctaatcaccatcctaaccccctaatatcttccagtatttttctactagctctcctcagtgcttaaattctctcctgtctttctttcagtagaaatgatttccatctctctctcctatggcaatagtcttgatccataattcagtagtcttgaataaagtctttcttgcctgtttgtctggtgcattttttcttttacaatattaccagatacaggctgggcctggtagctcacgcctgcaatcccaacacttcggcaggccgaggctggcagatcacctgaggtcaggagttcaagaccaacctgaccaacatggtgaaaccctgtctctactcaaaatacaaaaaaaattagccaggcatgatggtgggcacctgcaaacccagctattcaggaggttgaggcaggagaattgcttgaaccagggaggcggatgttgcattgagctgagatcttgccactgcactccagcctgggtagaaacagcgaaactccatctcaaaaaaatattaccatatattaaaacttgtcataatgctatagtaattaaaacaatgtggaattagcatgaggacaggcaagtagagaaataaaactgattagagtccataaactgatccatgcacgtataggcattttatttctaatattttcgtcaaagatgacaccacagaatattgaggaaaggatggtcttattgaaaatctttgcaataagaccatcttttcctcaatattctacagtgccaacttgttgtttcagttggatctatatgggaaaaaatggacattcatcccttcctcatacctgtaataataggtggattgtaatacgaaaggtaaaacaaacagttcctatatagcaacccaggaccatagcttcagaattttaaagtagagagttttatttttaaactgaggacaaaagtacactaaacataacagaaaatattgaagtgaactatgttaaatttaaacttctgtttatgaagagatatatcattacggagtgaaaaggcaaggtacccattcaaaaagaaaaatgtaatataaacagcaaagaatacccagaatatatatattttaaactaaaataaatcagtaagagaaatatagaaaatccagtagaaaaacaggcatttcagagaagagttcatttaaatggccaataacaactgaaatagtattccgcctcactggtcatcagtatatacaaatgaaaaatgagagatgacattataaagtcaccagaaaggctcaaattaaaaagtttaacaaacaagtattcaagaagatatgaagcagtttgtactttcatttactactggtgagaatatgaatttatacaactttggaaaaccctttgttaatatcttgaaagctaaatatgcatatacccaatgattaagaaatgctattcttaggtaaatacctaatacaaaagtttacatatatacacaaaaatatacgtacaatttatgttgatagatgaattatttgtaatgcttccgaactggaaacaaccccaattttctgaacagaatatgtaaaatgtggtatattcatacaaagtaattctatccagcgatgaaaattaataaagtaatgctatatgcaacatagtgaatctcacaaatatagtatccagtgaaaaaagccagttaaaaaactgcatatataaaagtttcatttacatcaagttaaaaatatagcaagactaacctgcagcattataactcaagatacatgttacctttgaggagatgggaagagtttatgataccatagggcttgatggaggtttcctggttgctggtaacatactatctttttctggatgtggaatcatagtatgttacttctgtaataagtctttaagctataattataacttatgtcctttgcttgatacttcaatttaaaaagtaccataaagtttgcatttttttttcagaaccatcaacagataaacagataacaggttatatatacataatgcaatgttatttggccataaaaaggaatgaaatatagctatttgcaacaacataaatggaactggaggtcattatgttaaataagcaggcacagaaagacaaataccacatgttctcattcacatgtgggagctaaaaaattggatctcatagagctagagattagaatgatagatactggagactgggaagagtgtgtggatggaatgaagagaggttgtttaatgggtacatacgcttagatagaaggaataagttctaatgttcgatagcagagtaggaagactatataattatatacaacagtgtaacaaaatatcacatgtactctataagtatgtacaaatattatgtatcaataaacttaaaaattttttgtaaatgtattaacacttgcattcataaagaatattattggccgggtggccgggcgtggtggctcacgcctgtaatcccagcactttgggaggccgaggctggcggatcacgaggtcaggagatcaagaccaacctggctaacacagtgaaacccatctctacagaaaatacaaaaaattagccaggcgtggtggcaggcgcctgcagtcccagctactcgggagtctgaggtaggagaatggcatgaacccgggaggcagagcttacagtgagccgagatcgcgccactgcactccagcctgggtgacagagcaggactccgtctcaaaaaaaaaaaaaaaaaaaaaaaaaaaaaaagaatattattgttccagcatacttgcttatatttcccctgtaattttgtatggtgggtattatgatcactgttatctttgagtttcatttgataatttttatcatgagagaatttattgttcaactcataaattataaagtcagaatagaaaacagattgagtaatccagacattgtgttctttcaaatctacctaacaccctattggccaaatgtattacaacagaccgtgtattaacataaattgaaatctagcgttaactgtatacttacagcacattggctttggatgttcaaatttcattagaatattcaacatttatttatacttgatacaatgtgcagttgaaaaaacaatgcacatatcaaagctgatcaaaacatactcaaaagttttctaataactgaatcatgtgccattttatatttaagtaaataaaataaaaaatccagttcctcaagcataccagtcacaattcaagtgctcaaaatagccaaaggtgtatagcaacttccttactgaacagtgtcgttctagaaaagaaaaaaattttatatactaatgcaatcgagtgtgacaggtgttaatatatatatactgcttatataaactatatacatatataaaccattctcttctagaacagtgttgttctagaagagaaaaatatttatgtactaatgcaattgagtgggacaggtgctaaaataaataaatatatatgtttatattatatatatttgtacttgtaaatttaactcattcatgcaaatgctatatctattcatatatatatgaatagatattgcattttatacagatagatagtatttgcatgaatgagttaaatttacaggtacgaatacattactgtgttacataggtttctgtattcccccgttgctgattagtaaaccaaaactgaaaaaaatcacataattttcacaaggccacatagcaaatttctactatgaatttgagagattgggagaaatctcaggttgagttgtcacacatctgaataccagtgtcagccttgccacctgcaagctatatgaacttggatttaacttcattatgcattggctttctcatttgtgatatagggttggcattacatacaaagcatgtaaaactcctgaaaaataataatctaataattataattattgcttcttgggcaacaaatgttgatgcttagctttgtggattatttccatcacatttaaagttttttttaaatgcatttaattcaccaaatataaaattaggaactagagcgaaacatcaaaatgtttcaaccatattcctcttcataaataacttctatttcttaatttgatagggtctaacattctataaaattttctttctcatactatcccgaagatatgtactataaaaatttcagttacctaactgacatttaggtgatgagagaaaaatctgactttatcgtctttctgaacaactacctttcacagtatagcattttctttccaagtggctttgttattttaacattctctttgtaactgagatatagcacattccctttgtaacctgtgtgatactcatgttacacaagttaaaactattaacgacactaacagcaatgtccaaagagatgttaccattaaatgtctgtcattcttattgtctacttatccagatttgtcacctttaaaaattatcactgttggtcaaaataattggcagaatgtagtatttgacttctttatattttgccattatattcagattgttttttcttatgaaagtaattttgagaatcatgctttttaaagctgaagttctctacagaatgagggagaattatgcttctactagataagattgggcagtatttccttttattttcttgcactccacctgtattggaagggacattggaggctatcaagtctaacttcccactcagtatgtcacctcttttaaaacatacttgaacatgagattccagtttgtgttaaatattattaatgaagaacagctcaccactttccacagctcttatcgcattgtaagaatgctctgggctgatgatgataataatagtaactaatattattattgcttactatatttcagtgatttttaaatgctttagcttctcaactacccttttaccctttacagatatctgataatgtaggttctaatacaatcttcatattaaagatggggaaactaaagccaaggatggttaagtgacttgcccaaaggtatactgtagataaggaacagagcaggaagggtctatttctagagtttctcctcttaattaccttacaacaaaaagctctcccttttaagtcaaaaaaatctttcttggaattatatccaaccgtctgttcataggttcattcagttatcttacaagaattactgattacttgtatctgacaatgcaggcaagaatgtgtaagacacatctcatgtaatttagattctaataaaagagtaaagcacattaatattaactgcaaaagtatatgatcggtgcccaaacagacacaattagggtacagacatggcacaaagagggagtagtcatcactaggtagagtggccaatttcatggaggaaaacttgaaatgagttttctatacatagatgaaattatcaaagcagatcttatgaagcagagtcgtctgtttaaacccggtggtatgtgcaaagaggtcgtaacatacagggtatcagaaacagcttgtatgaatcaaatgcaggttgagggacataaagcagataacatgagacaagtctatagagactggtaggagtcaggtaatcaaataccttgtaggccaaagtatcagaatctggaaagtgactcaggattttaagcaaaggagaacgattaaacaggctcttgggaacccacactgacttcaatgtggagattggatggaagagcggtaagactgaaggcaaggactttgggggcttatgatatggcctataccttgagaaatgttgacaagaacaaagatgaaataataaatacaagataaggttgagaaatattttgacattgcatgcaaagggctcataagggaaaggacagggatgaatttggggatgactctaggtttctggtacaggtgtcatgataagtgccagtgcaatgacaaaaataagaaattcagtaaggaaagcaggtttaaaggaaggcaatgtacagtgaggtaagtttcatcttgttgagtttgaagtgttgtttggacttcaaggatgtgttcagaagataattagaagaaaatggactcaggaaagatctgggcagaagacatccagagttaccaacttctgtctgcttctgatattatgacattttgaaaaaccatagagaaagtgccttcctttttcaccatcacaatagtgttcatgtgccatttccctatgattagttattttttaattaaataatcgcccactctacaaatattcttcacaggatgctgccatctgagaaaatcctgctaagatagagtaccaatcgtgggcgtaaaatacagtgtattcaaatcagcatagagtataattattagttcatgtaatctagacactatatcacagtctgtgattgcattaactaagaatctgtatcatccttaatatcaagcttgtttcaaagtaagcatgtgcactctatctcatatgtgcttatgtttatgtatatgtatgtatatacatatatatacatatgcacaaagatgtacgtatgtatatatatagaaacataaagagatgtatataaatttaactatatacacatttatacatatatttttatatagacaaaattacatgtatttttacacacttacatttatatatatttacatttatatctatagatgggaagtcagaccctttgtatctcaaactaattcaactgatttatactacttgcatttttaaaaagcagcaacatttcgaactataaacatgagttttctgacttaaaacaataggatgtaacatttgtatatgatattctaactcctcaggacatagctataaaccttctaagttaatatgggagcagaaatattccattaaccactcctacaggggcacactttacacagagccccagctaaatcctcaaatggcttccttccccagaattttcagcacgtaaatcagatactagaaaggaatatattaaaacacagactcacccacgaacactcatagagaaagatagactcaccttaccaataaacagtatcacgcagaggctttgctaaaaggttcaggaaaatcagaatacctcaaattcattccattccattggatcagccaatttaataagtctaacaaaataatttgtcttaatactaccacaaagtatttctacaaattgtttaatgtcatctgatataaagttggtttacatgactcaattttagcgaatgtagcttagttcttagaaaactatctcatctgcaaaaattattccttcaggcaataaatatgtttattaactgcatgagataagtgagaaaccataccagtgagcatggcctcatgtttaataatctgatccaaaattgtgttttccaggttttccttcttgaaaatagaatacttgttgtgacggttaatattatgtgtcaacttcatggaattgagggatgcctagatcactgatgaagtattgtttcttccgggtgtgtctgtgagagtgtagccaaagaaggctgacatgtggaccagtggactgggagaggaaggcccaccctcaatgtgggtgggcaccacccaatcagctgccagttagactagaacaaagccaggagaacagggataaagtagcttgcttggtaagtttactcactctcttcctgtgccctgcggggcagttggcttcctctcctcctgccctcggacatcagactccaggactccaggttctccagtctttggactgggggacttacaccagtgatttcccaggggctctaaggcctttggcctcacactgagagctgcactgtcagcttctctggtcttgaggcttttggacttggactgcaccaggctactaggttctctcttctcccagcttgcagatggcgtatcatgggacttcaccttgtaatcatgtgagccaattctccatgataaactcctaaatgtatattttatatacacatatatacatctatctatccatccatccatccatccagtgggttctgtccttctagagaaccttaatacactctgtctttatccattctttataattatttttattaggaaaatcaaaatacgatatgatagtcttgctatgttgcccaggctaatctttgaacttctgggctcaagcaatattctctccccagccttccaaagtgctgggattacaggtgtgagccactgtacctagcctcattcttttcatatacttttaattctccaaaatattaggcagtaacttcaatattaaagtattttaacaaaataattcaaatgccttttatatggcagaaattctcctggttctatgaccacacagaccttcaatacatctatagttggctctcaacttttaacttgtacagaataacatacctaaaaatagggttttaatggttttgctttttctttggaagacattttcattagagcatcttctataagctatgggcttaaccatgtttctccttctttctttattagaaacagttatctcccaagaacaaaaggctttctttatggtctttttatagtcttttttcatgcaagtttttataaaccacgctctcttgatttaccatttatccatcctagaaactctacccacctccaccaatctcacttatgatggcagcagcagcctgtctggagcggccactgcaaagatgccagctgcagcaagggaggcgtggccagggctgtgcactgtgtggagccaccaagggccaggaacaagcaggagcgctgctccctactgagttggcagggtgggagccccatgcttccaggtgcagctgcagccacccagccacagctccggacctgggcattcctgcgctcttgggggcctgggaagcccccctgcctccacatactaagaagtgcctgctcccactccctggcatctcctcgctccccgcactggctcctgggagaagcaaagttgcggccaagaccaggtgttgtcgcaacctgactggttatgtgtgtgctcgggacagtgctggcatgccagccccctgctgccttgcgcccgtctggactttgggcactgatgagcatgggagagaggctgagtggggactgaggatggttcggtgtgggcctgcaggtaccccttggtataaactgcctaggctacatggatggcatgttgatggtggcaggaggcagactggctcctgggcagaaaggagcagatccacagagaaacccctccttcaagccaagaatggcctgaagcctgggggctgggctgccagttctgggtggagtttgtggcccagaatgagaacttatggtgctttttctgggcctatccatggatgtccatggaccaattagaatgtacctcctcccttccgagcccataaaaaccccagactcagacaaacttagacattgggactaccagccgcaggaaggagctacctactttgtgtctccttgactcttcaggatgacctgcctgcataaaggagccacccaccatgggtctcctctctactcacagctgcacactccctgggacgacctgcctgtggaaaggagctacccaccgtggtatcctgagagctgttctctcgctcaatgaagctcctctgcaccttgctcaccctccagttgtccatgtacctcattcttcctggacatgggacaagaactcaggacttgctgaatggcaggacaaaaagagctgtaacacaaacagggctgaaacatgccccccactcaccatgctatgggcaatgagaaacagagaagagctgtggccttttgcagagcccagaccttggggctcctcaagccagggttgtggcatgctgtaacatgctccttggggctctgtggttcctggtgtctctgagctttcaggtgccaccgcgatcccctgtccagacattggtgcctgcagcagaagctacttgtggtacatctggtccagccacagcctcacatggagctgccaccagtactggtgcctgtagctgccttccgctgcagctggcatgcctgtctgtgcacagtggccaggcctcatgctcgcttgctcacatacctcttactgctctgtgcctggcttgcccttggcaggcatggggatccgggccagtagtgcaagccaagcacagcctgccaggctgagtgggtgcaaggagcccagcgggcacaagcaaaacccagacagaggtgctgccggccacagaggtttctggctggcaaagtgacacccaaggatcccatgacacttacatgcacactttatccattttcctccaatgtatgatttagatcttagcttaaagaaaactttcctcaggaatcatctgttgcgttcaaagttcagtctaagtcagagtaatttcctgtcacaaaagcttattttttgcctttataaataagttgcatccattctttaacatttgctcatttttaaaaatactttattaatgtctatttttatactggattgcatgtaccaagagcgcagttcccatgcctacctgcctatcatagtgaccatggatgacaaggaattagcattctactacaaagagggagactgagatatagtcaccattgttccagggttccaaggaaggcagtaggctctcaaattacccatcgcaaccagggtagatagtgacaaattcttttttttaactgtcttacctggttacccaacacaatccctgggacatagtaagaacataacgagtacttgttgaaaaaaattcaaatgggatgtggaatgcttagaaagagatgtggtaatgacctctaaaactgaagactatataaatgaccaattttagttataaaatttagtttataaaaatatttctcaatcaaataagttaactggcatcactgcctatgaaacagactctctacgcactgacatcctggaagcctctaaagttaaggacaagactctaatctgcagtaacattgctgagggacaagctgaacctttgagagaaagaatctaattatcggagagcacacttttcagaatattacacttcataagctatgtcatctttcagaaactctaagcatatattctgacctgtctttggttttcttcaaaccttttccaaagaagactctaaaggtattttaaagttagagaaatcctaaaatatcatcataatagaatttacagaataaatcaatacatgcagatatatcctattggaagtatttttagagttctaactcagggtgttaagtatgcatctctcttccttattggactaaatggggacttcccttcctactttcccccatctgtacctctttaccaaagacagctggctatcctttttgagcctctggatggcatttcaacagaattttagtgcaatggatgaaggaattgtggtgatgagggatgccagggcgaaggaagagaaggcgtgagatgggcactcaacactaataggttttgaggaataagttaaggatagccagactctgctctaataaaaagcctgctaagatccttctctgagtcctgatgattgtttttcttttaggggatccaaatacctgtttctctttcctgtaattcttctaattacgtctaccagaatccctctcagtccagtattaaacatattaaagtccacagtctctgaagctaccctagaattataatatacccagggtatttgtgttaaatttttttatgtttttatactttatcaatcttttaatactttatgatttctccttactcctccttctgtaccatcttctcgtcctcttcttcttgcttttaaaaagtaaactaggtaagacaagattatatcacttgcaaagaacctaagaatcatctctgtttcaaagtcaaatggaagcagagcattccacgacaattccagccaatagttaaataaagtatagaactcaagcatggattcttttgggactgaaggaactgatgggatggaatcaaagaaaagttatagcaagggctttctctccacttgattccttttaatgctgcccttttagatactagtctagattatcttaaagtcacatgacactacagagctatatagaggcaaaatgagaacatcaaaagaggaaagaagattgaagacaaaagaggaggctggaaggcagtagccattaaaggggtatgcaatcatggacaaatgcagatagagtttaagcaaattagggataatcagtacatttaccgatatttagtagatgtctttgggccaaagaaataaaggcagaaaataaggtgaaaatgaaagcaagtagaaaacaaatacagaagagtataggcccaccatacaaccatctgtgagttctacggactgtttttcaagatgccttaaccacacaagcatcaccttggatgaattatattgaaaagctattcacactgggtcagctaatgatgaaatgggtgctttcaattgttattttaaatggaaatactccatgccttagaaaaatgtctgcatttaaattttttttaaccagtaacctcccttcaacccctgcttcccagccttatttaatattaattgaaattttctggtaaagtattagattttacccatccgcagttagttactattgtatcagaattatggaattctttaaatcacagcacttcagctgattatgagtgtgtgtatattgtacacatattgtattctaagtattttaatatataaattgcattctaaatttttaaaatacttttcaagttatagttcttttaaaggacatatttagtttactaagcaaaataatctgaccttaagttgttcttccaaagcagcagttgcgtgatctccactagattcatcaactaccaccaccatgtgagtgagagaattgaccctgacttgttcttgttctagatcttcttgaagcacctgaaagataaaatgttttaaaggaaattaaaatgatattcttacatgtgtgttgaaatgatttgctctcaaatggtgaaatttatttctgctacatctcaggtactcccattttttattaacctaaaaccattccaagccaattttctgctatgacgctcagcaaaatttatatgttctattgttaatttaactggaaagtatctagagaagacaaatgttaagaaaggtacagcaggatgttctccttctcatcccaccccctttctccctttcaaggacttttttcctacaactatcagcacttctggcattttcaggctcttcttctctactgaacttctccattaccataaaaataaaacaaactcttgatccaacaaaccggtcctcctactgtcctattatgtgttcctcttcactgaaaaaaaaaaaaacaaatgtatcctatagttactgtgcctacatatttatcctactattcactttgcccactaacccattgaaatatcttttgtaaaggacaccatcaactttcatgttcctaaattcaataaccatttgttatagcgtcttacttgacatgttgattactaacctaattggccactccctcattcttgacaccttctcttgattaccctcctacctatgtgctactttttttattttttttttctattttggagacggattctcactgtgtcacccagggtggaatgccaatggcatgatctcggctcactgcaaactccacctaccgggttcaagggattctcctgcctcagcctcccgagtagctgagattacaggtgcacaccaccacgcccagctaattttttgtattttcagttgagacgggatttcaccacgttggccaggctgctctcaaactcctgacctcaggtaatctacccacctcagcctcccaaagtgctgagattacaaacgtgagccactgtgcctggcctatacactactttttagctcctttactcgttttttcccttccgctcaaactacaaatcagatgtcagtccgatttataaaaaccaatagatttctatcatactaagaaagaaaatttaacttctctacctgaaattcttatatgatctagcacctgactacctcaccagtctaattgtataccattctcgccctcacagtgtttcagaatgacttgctttgtctctcttccaaaaatgtgtcaagctgttccctctaccaggattgcttttcttccagatgtttaaatcatttctttatcattcaggactcaatgtaagtgtcacctacctagagcagcttttcatgagcaaactatccaatgttgctccctagtaattcaccatttctgtcatttttttaatcatagtattgtcactactcaataatttcttatgtatcagcttagtccttttgtctctacttactataataggcagtccactagaacagagatgccctctgtccttctcactatgtattacaagcaaataaagatcaataaacatttgtcagataaatggtaccatgtgggggtttggggaaaacatgcacagatgagtttgttccttcctgattgcacaaagattacaatataataggaagaattagtgatttttggtgtaatcacaattacactaacctcaacagaaaataaccacttggtctcaactgaaccctaggataaaaccagaataattcaaatactgcctttctaacttacaaatgtggctctgaaaaaatcatttccccctattaagtgaggctgtcacaaaacagtatttccaatctttttaaaaacatgatgtacaattattttgtaatgatgaacaggggtaaacacaggaataaattaggggtaaacaaaggaggctgctctagaaccaaggtatgttgcctgggtgctccagatcccataagaccttaccctgttacactatttattattgggatttctctgaatagctatttgagacttctaggcaactactttgtttcttagaacattttgttacataacacaagagtggagaaacaagtttgggacatttcccgttactttctggcaaacgtgctgtccctacttgcaaaacaacagtgcttagcacctatcagtctagctcttaggtattcaaactctatggcaggtggaagggaacttattaggatggctgaatcacaatctcaaatgcatgagcatttttatcctaggcttcttattttcgaagcctcaacattttagaacactataaaatcacttctttttacttcgtctctctagattttcatactacattttcaagtgaagcaatttagaataaaatgactatgcatctattttgtgtgtgcaatctatactgcctatcatgcctttgacattccagagcttataatggttaataaaactctttttgccatgaggccaaaaatggaaacattaaaattcagagttgtccttgacagtcatgttgagtctgtgttttctgagttatataagacaggactgggaacattttgaaggtgtcagccgggaatgtttcaaataataattaaaatgataatttggtggccagtgtatcataagttggttttctgaatttagtcaattcttttctgtccttcaatgagtatatataattacatatattacaaaattacaagtaaataatgccagttttcatttttacatgtaaattgctttttcacaattttaatatattttacttaagaagtgtaagaaaaacattggatccatggaatgaatccaactcttattgagtcttttaaagtctatgtgatcaaacgtactatattctccattacttagttgttctgattttgtttcgttcatctatttgttttataattggaaatggcattcttgccatattgatcaagggtttatattttatgcttggcagaagtgctaacgtaaagtaccactaaagagagttgtgagatgatagcattaaaatctaacacaagaaccctctggacttacggtgagtacaaggaaataaaggagtggggaaaggctctctacagtgactaagaacgttgaagagtccagagtgctggagtagatttgcataaggtacatttgatttaatgttatttccagtatctcttctcctctatgactttttaaaattgtatttcttctttctcagctaattaggaattaaactaaaaaaggttaaactgacttttttgagcacactaaatagctgtaagacaaaagctatggtaaaacagtaagcacgtctcctattttctcagacttcaaatgcgaaataaatattagtgaatataactgtattagctaatctccttaatatcagcaaaatacagattatgaactatgcaacgttcagggtttacttttacactgattcttacaagtagcagaaacgccagacataaaaagctggagttaaaaagttcaattgttctgccaaactaggaatccatgaataaaggccttgatcattggggtaaagaatgcctgcctgtttctccagttggaaagaaatgaattctcaagagtatttaaaaaaaataatatgctaaagtgttgtaaggctatatttaattacaattttaaatactgacttcttatggatttcaatttgtcatagatgaatttatacaacggagatttatattggatttgctaattaagcctgaaatatgagccaaatagtttccaaatatagatgcatccctagagaagtacacaaaaatgtttgtctgtcagaaaataataccttcaaattaaaatattgtaatataatattgttaaaatgttttcctttattaaaagcttccagattgtacatacacatacacatatatacacacatactaggtactttattatgcatttattttcattattttattaaaggaatgcttttgtaacacttaccagatttcaaacatctatcatgttcctagttaaatttcattaccattattagatacaaatgttaccaatgtttgttgtcaaatgtcaaataatgtatttttttctttatgacaagagaaaaggccaacagtgagatgtaacattaagaatgcctagattggacaaacagtttttgttatacctctgtgaataattgtatttcttctaaataagtctctagttaaagggcttaacaaaatttgttactcccttagtacatgttcccaattttattatttaaacctgacttttcttgtacttcttttaaatgccatcagtgatactgaattcttctggctcttgtccatgtcaagttggttttcaaaagtggcttagaaaaaccactggagagccacttcagtgtttattctagatctatgctattttaccctttcttagaacacatgtaaaataatacttaggaaataaagacatggaattatgtaaggctagggaaatttttgatttgatgtttaaaggtgaagagcaataattaatcgaaaggcagtataatagaaaacaaaaacaaggatgggtatcctgtaaattcgatgggagaagcttttgttttacttgtctatttcttttggccatagcatagactcagctatggaaagaacaggaaaagaacagctgttacctatatgtaaagttttttttttttttaactactcctccgacttcattgaatacccaacagctaattgccggtacttgcaggtcacacacacacaaacacgcacacgcacacacacacacacacacacacacaaaacacacccctagaaacaacacagaacgctgttcatcatgaattggaaggcaatctattgtctccaaaaatgactttaaaattaatatatttagatgtttaattacaaatattcagtagtttgtagtttatctcaataaatgcacacataaggaaagactaacgagaaaaaaattgtagcaaacataaaatttgcaaaggacattaagaattcagaaggttctaggaatagagttgagtctaacatccaggaaagaagtatcttaaaaaagctgtctcatgaacaaaaaaatccctagatactaatgatcatgttaattcaagacatctggacaggaattgactttttttcaaataaaaacttcaagtacagatcagaaagtgttaggatttcttgggaaatgatggggtggtaggtaatttatttttttcactcttttcctctatgccccattccttctaccacctctacactgggctaggctctatatcccttgctggcctgaatgatatgatctggaaaggactttcgattttatttgcagtgaaatattcactttgctaagcctggctggtcacagtattgtctagctttccatgaagatctatttacggtatataactttgttataaatttgctgaatattttaaataatcttcctcaacaggctaccctagaaaagcttttgatattcacttacttaaatgtgattgaatatctttattagttcttatatcagaacacactgattttatctttttgttagaaatgaatgtttatgtttctgccaactcctaagctaccaaatgggggttctgaaagactgtttcaatggagagatttgaaaggctatacaagcacactaaatgcttctcaatagcctgaaggggactcaataaatacgaaaagaaactgttttaaaaataaagtagacaattaatgtactcctacatatggaaaaggacataggatgaaatagattgaccaaaacttgtgcatgactatgaggagacagtaaaactgtagtcaaaagtgtagcatctgaaatcagattttctatgtgtaattcctggaagcatcaataaccaatcacgtgactttgagaaagtcatcaaccacaccaagcctcagcttcctaatttgtaaaactaagataataaaactgcctatttctttatgtggttaagaagattgaataaggtaaaactgttttgcattttgcctggaaaacaatataaattccaaaaatattagcatctaattagttgaaagaattcatatttagccatatttatatcaaagttttgaaactaaactgcaatgacctaacctaatactaatctattttaccctcatctaatacattctgactatcatcctttctaatagacatcataagtgcaggaagagaatgtgatttttgaaaagtcatgaaaacaagtgaagttacagcaaagttttaaggtctggagaaatatacagtaagtgttaaatccttaaataatacctgaacttccaatttatttacactacattaataaaagtaggttcaaactacctcatctgatggttatcacagaaaaatttgcatgggcagacatatgtcatggagtgaggacagtccctaatcacgaaatggtagccctcaattctcttgcctttcctactctttctacaatccatgcatgcacccacccatacattctgcatatagttacagaattaaaatcagattaaaaaccaataacattgaataaataattataaaatgcctttactgaaaataattattgaaaaagaaaagaagattattgggagagagttggggtggaaagtttcaggcagagcacagaggaaatgctatgcattgtgctgctaacagaatatagttgtgaaattcagttccaatgattatcctcctgctcagacggtattgccattcttatcataagcctatattcctgtttcccttatagtctctttttcctctattttaaagaactacaggagtaatggtgatgaattatttcattaagcattttgattctgagtatttaatgtgtagctaccactactgcttactctatgtttgaagactcatatgcacacagtctctgtaccttctatctagacattcccaatcctgggaatccaaatgccacaacatcttcaaatctctttgtcacttctctgcaactgctctagtctctaggatctcaggtggagtcaagcttcactggaatctcaaaatggagagaaatggtctcaaaggcagacaggtcaaagttaaaatcagaatctaccaattaatactgaagttaccttgaacaactccttaaactctttgaacacatctatttgtctgtaaaatcaagtattaatatccttccaggccagacacttacagaacattctattctaccaccacagaatgtacattattctcatctgcacgtggatcattatcaaaaattgaaaatgtgctaggccacaaggtggttcttaacacatttttaaaaaaatcaaaatcatatcaagcatcttcttgcaccacagtggaaaaaaactagaaatgagtaccaagaagactccttaaatctatacaaatacatggaaattaaacaacctgctcctgaatgatctttggacaatgaaatcaaggaagaaattaaaactttttgaaacaaataaaaagagacatacaacatacctccacctctgggatacagcaaaagcagtcctaagatggaaatttatagcattaactgcctacaccaaaaagatagaaagatctaaaattagcaaactaatattgtacttcaatgaactagaaaaccaagaacaaaccgaaaccaaagctagcagaatataagaaataacaatgatcagagcagaactaaatgaaactgagataataaaagacaaaaaattaaaaaaattagagagttttctttgaaaagataaacaaaattaataggccactagctagattaaccaagaaaaaaacagaagaatcaaataagcaaagtcagagatgatagatgtgacgttacaactgataccatagaaatacgaaagattatcagactactatgggcatctctaggtacacaaattagaaaatctggaggaaatgaataaattcctggatacatatcaactcccaaaattgaaccacaagaagcaaaaatcttggacagaccaataacaaatagtgaaactgaatcagtaataaatatctcccaataaaataaagctcaggaccagacgtattcacagccgaattctaccagacatgcaaagaactggtaccaatcctattgtaactgttgcaaaatatcaaacaagaggaaattctccctaattaattctacgaagccagtatcaccatgataccaaaggcaggtaaggacacaacaaaaaggaaaccacaggccaatatccctgatgaacatagatgcaaaaatcctcaacagaatgctagcaaaccaaacccaaaagcataacaaaaagataatacatgacaataacgtgagctttatgccaggtaggcagggatatatgcagagcaatatctgtgattcaccacataacacaatatatgttttgtgtggtgcaatatatgcagagcaatatatgtgattcaccacataaaaagaattaaaaacaaaaaacatatgatcatctcaatagatgcagaaaaggcatttgataaaatccagcctctccccaagataaagaccctcaacaactaggcattgaaagaacatatctcaaaataacaaaagtcatatatgacaaaccaagagccaacatcatactaaacaggaacatgttgagagcacccccctcccccaagaactacaacaagacaaggatacccattttcactgctccaattcaacatagtactggaagtcctagctagagcaatcaggcaagagaaagaaataaaaggcatccaaattgggaaaaagaaagtcaaatgatttctcttcactgatgataggattttacatctagaaaacccttaagactcctccaaaaggaccctatatttgataaatgacttcagtaaagtttcaggatatgaaatcaatgtacaaaattggtagcatttctatacaccaataatgatcaagctgagaaccaaatcaagaactcaatctcatttacaacaactacaaaaaaaaaaaatacctaggaatgcctttaaacaaaaaagtgaaaggtgtctacaaggagaactacaaaacacccatgaaataaatcatagatgacacaaacaaatggaaaaactttccctgctcatggattgggagcatcaatattgttaaaataaccacactgctcaaagcaatttacagattgaacacagtccttataaattaccaacatcatttttcacagaattagaaaaagatagtaaaatacatagagaatcaaaaaagagcccaaatagtcaaagcaatgctaagcaagaagaataaagttgaaggcatcacattacctgacttcaaattatactaaaaggctacagtaaccaaaacagtatggtactggtataaaaacagatacatatagattgatttaaccaaattaagaacccagatataaaaccacatatctatgaccaacacatctttaacaaagtaaaaaaatgtatatatacactggggaaaggacatcctattcagtaaattgtgctgtaaatattggatagtcataagcagaagaatgaaactgggtcataaatcaccatatacaaaaattaactcaaaatgtattaaagacttaaatgtaagacctgaaaatataaaaatcctaaaagaaaacctaggaaaaactcttctcgacactggcttgggcaaagaatttatgactaagtactcaaaaacaaaagtagacaaatggaacttaattttaaaatcttctgaacagcaaaaacaaacaaacaaaaaaacaaaaaacaatcaacagaatgaacagacaacttatagaatggaaaacaattccgaactatacatctaacaaaaaactaatatctagaatctaaaagtaactcaacaagaagaaaaatagataaccccattaaaaagtaggcaaaggacattagcagacattttttaaaagaagatatacaagtggccaacaaacatatgagaaaatgctcaacatcactaatcatcagagaaatgcaaattaaaaccacaaggagatatgatctcacaccaatcagtatggctattatttgtttttttcaatgtcatttaaaaatttgtgggtacagagtaggtgtatttgtggggtacatgagatgttttgatacaggcatgcaaagtgaaataatcacatcatggagaatttagtatctatcaccttaagcatttgtcctttgtcttacaagcaacctaattatatgctttcacagttattgtaaaatgtacaagttattattgaccatagttactgtatgatatgatcaaatattatgtcttttcattctttctaactgtaatttttgtacccaataaccatccccacctcccttccaccacccttcccagtctctgataaccatccttctactctctatttccatgacttcaattgttttaatttttagatcccacaaataagtcagaacataagagatgtttgtctttctgtgcctggcttatttcacttaacataacgatctctagttccatccacattgttccaaatgacagtatctcatttttttaaggggatacctgtcattaaaaaagtcaaacaacaacaggtgttggcaaggatgtggagaaaagaaaatgtttattcactcttggtgggaatgtaagttaatataaacattatgtaaaacagtatggagatttctcaaagaacttaaaacacaactattggatcctgcaatcctagtactgggtatatactcaacaaaaacaacaaaaagtgttacatgaaaaagctacctgcagttgtatgtttatcatagcactatttacaatagcaaagaatcaacctaagcgtccatcagtaaatgattggataaagaaaatgtgatatgcacatgtatatatgtgtgtatatacgcatatatatatatatatatatacacacacacatacatatatatacacacatatatacacacacaccacagaacactacacagcctaagaaagtatgaaatcctgtcttttgcagttacatgaataggaactataggccattatcctaagtgaagtaacttggaaacagaaacctaaatgcaacatgttctcgcttataagaagaaactaaacaaagggtacacacggacatctagagtggaataatataaactggaaactacaaaagattataggctggtaggggggtgaggggtgaaaaattacctattgagtatagtgttcgctattcagattatggatatactaaaatcccagactccaccactacacgatatatccatgtaacaaacctgcacatgcaccccctcaatctattttaaaacttcttctaagacatgcttattactagagttaaatgagacaatacattaacttcagcttgtacagtgcttagatttggtaggtggtgaggaaatgcttattttctttcatttctgacgtattcacattatccttgcattcttacactgagattcatggaaatagcccttttgagcatcactatttatttctaataacttggtaatcacattatatttccattattaaatatcctcagtgtgccaaaactgtagaccattatgtaaaaatagtttagtgcttttttagtcttactagatatgacttagataaaaatttaattgttaaaggatacagtatcattacttccaatgaataagagagtactaccagatgtaccagtagaaatctactagtattagaaatccactagaaattctgttcataacagaaatattaaacaggatagttctccatattcttcagaaaaagtatcatattcaaccttatattttaacacgggattggatttacggacatgcattttgttataagatacggtcatacatttgataaggaaaattattgccttaaaattcatgttatcatgtgtgtcttagctttcttgtaaggtttccctaaaatgcattttaaaatgttttttataattagtttatctacattattaattttgtattacctatacgaaagaactgaaattgattgttacagtactggttcagagagagagagacattttacatgagactaactcagtaaattagaaatagggtacttatttttttcctttaaacaccattggagaggtcagtgtcttctcatgaggaagtattacaagagtaatgaagtataataactaatgttagtgcctctaagatgacagagtcttgatcaggtataattttcgtagctataccgatatactgtcaaacaaagctgtgacattctaagtaatgttactgaatcaatactcagtaatttctaataaagtaaataataatctgatagctagaaatacttgatttgtaaaataagaatatgggcatggattttatattattattattttaataatctatagcattactgtgcaaatatacccttggaatatgatgcttgttaatagaattcttatgggatattagatgtcttctcaattcgattttaaaaattgtaactgaatatcatgcacatactactacgtagactataaaagtgtgatgttcttttttacataaacttccaatcatttatgtcaaaataatactaccactcaaaccaatttcatagtcaatggtttagcactattaagatatttgcatatgggaatgcaacagagatagaaggaaaaaaggaaagtcagagattgaagacaccagagataacatcaccaggtaagccactttacagatgtatttttctacagctttatgaatttttttttgctgtatgcccaacgttttaattgaaattatcaaactttcatgcccttgtcagaaagttagccatgatggagacgatttggataataaaactagtcaatataatcagaacatgtgttctaaaaacatttactgagcatcaattattgactaagcactctgaaaacacaaaagaaatctggctctctggttataatacagtattttttcagattatagtgtttatcccccttaccatcataaccattaaactttcattaagcacttatgagggcaaaagacaggaaataaaatgaaacttcatagcagaaacaaacaacatgtaattttaaccttgctaaatatgagagtgagtttgctaaccactaaaagcaccacttgatcctatggcactgtcaaacttaactgaatcacttatccttcttccaactattgcatttctctttttcactgcctattttcttaattaccaatctcaagtcccaattgcccagtcccagaatctattactttgagctttttgttcatatcctaaatctagtcctattggttttgatttgatatccagaatgctttgtacctgtttacaatttttgttgtcattgctttcattcaggctctatatactttcagcaatatcctcttaacatgttttccggcctcctgtttctctgctcttttatttatcctcaaaaaatatcttcttaaatattaagataagttttcctaaattgctgctatttctagtttaatttctcatgaataatggtttcctgttactcatagaactactactgcaaatgcctgagtcttttatataagactcatgatcaccctccatgatcaggcttaaatcctccagcattcagtatagtacaagacatcgtaaatgattggtttctgcattcttcacagcacccatgtgctataatgagggtttgttcagtgatatggaatagaatgcaatggaatgaaatgaaatgtcagatcctttggcagaattatacctaatccttctctgtaacatgaacatctagatcattttaaaggtcaccagatgaggatatttcacaatcttggcaacccaaatgtctgcctttaactaaccttcaagaaaaggataggtgactgagtttctaagaggctacttagtttgtattaatcagtatttcacatataaccttcactgaagtcagaatatagagtatatattcacatcggcaaattcttgtaatttgtaaagtctttgttgatgctgtcaccaaggttatgcatctatgcacaaaagtctaaatctctcaaaagaatggaaaacctagctagtaaactcagctttaaacttcatcgcagtctcactgtgccaggagacaaaagatttcactgttaaatattttccttttgaaaaaaatgcctccaaaatggcaaacttctttactattaatgaaagctcaaggcttttcctcctcaatagcatcatgccactccttcgagggaaatcctttcattctttgtcaacatcactaataaattctaccccttaagacaaaaaagaccagctagaattatatgtgatatattttttcacaggggaatgagaggttcgatttgtttactccccagaaagactcactcttgggtgcctcaaagctaaagcaaacctctaaattctctccctacagcaatgtctatgaaggatgagtggtttctcccaaatggtgcagccaattgaacttttcttggttacccagagtaaagagtttggctagatttaatagtaaccaccatataggatcaattgctttaccttacctaattgccaggttcagtaaaagtgacttatcttcctgacatttcacagtgtctgaatttctagcctgcctcataataaaatgctgttgaaatgaagatagcaaaggatcctgtcacagaatatacagaagcatatctgtaatattcacagtgtacttgcaagatttgcaaacattttaatcttgccctccagttgagagagagagagcaggcgacctctgatctgagcagaatttaaatcaattcccagcaataaaatctgtatcttttctttaattttgtcatctgcaatcatctttaagaaaaaatggtgatggcacaaggatttaatgtctatctacacaaagctaaaaataaatattatattaggttagaagtttggtgatgcagcagatgggagttgcttttgtggggactctaaggttactgatgcattttgttgtcagaaggagaaatttccttactttcaatgatttacaattcttgggaaaaaaagctgcaaagcgattcaacgactatataaataaggctttagtttgaactcagttacccaaagaagtaacatttattttcttttgttttatgaagtgtggcaagactaacaaaacagtgttcctttaattctgtatgtatgctccttttagtcttaaaagacaatataatgtacatgtttcaggtttaaataaagtcaactctttgctaaattgtttgatgttaagtcaccttcttctcgccaaaattgttgccaagaaacaaaagagcattatcaatattcaggacttgaatatgaatctttcccttaatttttataaaaaaaaaatctgtcaaatatttcaaaaaatattgtcaaatctgtcaaaaaaaagagtgctcaaatagttaaaagtaggagttggccttactctctgagccagaaaaccaatgccttctggcctctttatgccctttaaataaataaataatgcctggaggtaaaatgttacataatcaacttgcatatactcctgttgccttcttttgtttcacattttttcttcaaggcaatttcatagtcattagaaatggcatactttcaagtaatgaataatatatttaaattttatgacaatatttgtcaaacgttttccatttcattcacattatatctttcagaaaaaactacaaaacatttcaggtacctggcagaatattaagatcctggatagcttgtctcaccttaatgaagagtctgttcagcgtcccaagctaagaacttccttcatagctgccctaggttatccgtacttagctatgctaacattcttcttctactgctcttttggagctcttctccctggatttcgctttacactccaggcatccagcagcagtgtcctgccttctgatgttcagtgttacgtggcctaatcttggccttttctaaaatacttcaacttccaaaagtattggacacatttaaactgtgactggaaggaacactagaaacaaactcactcttttatttccaaagtaaagatacagagaacctgggacattaagtgatgtttggaaaatgacaatttagttagtggtagaactggagctcgaattctggcttctagtgggagaagtttgtcttgggttagattcctccaaaaacacatcctgaacaaaagatttgtgaacaaataaatggtttatttggagggtgaactcgtaaggcattatgagagcacggggacgttcaggaagttaccctgtggatacctggagctcagtcttactggggaatctctgaaagactgtggagaatataccttagaaatgtcccactatgggacaaagattctacaggatttctctatcaacttttactcctcattggctaagggcagctctggtggcactaattccacttcctgtccaccttcaaactggctgaaatggttctgcaccagaaataccctccggtagagagaagccattgctgtacatcaaccttgtccaatccatgacccaggatggctttcaatgtggcccaacacaaatttgtaaactttcttaaaatattttttcaattatttcttttagttcaccagctatcattagtgttagtatattttatgtgtggcccaagacaattcttccaatgtcgcccagggaagccaacgggttggacacccctggtttatatagacactttctgcatgtaacttccagtgtaggccaagggaaagagggcagatatagtgtcaacgagagaagcaaatgtgccacatcggaaaagcggtacggttagagaactagcactgtacctaacttcttcttcaggtgctcaattagtatctatatgacaagtaatcacagttacaatttctacataattgcaatacagttgatgtttttttcctgatggcatagcagacggggattaccatagttacagttcttcttaaatgctagatcttagaggactcctgggggtcaataatagtaagggctggccccatttgtcattcaaaactgaagctcattaaacttaaaaaaaactctagaacttagaaataaatgtatctttcatttgcatggaagaactgtaaagctatatatgactgaatattataaaaagagagaattaagtttgacaaaaggcagatttcgaaggtatgaggtaaaggagcagatattcctattcaaagccataaatccaaaaaccacagatcataagtagagttgccagataaaataaaagacactcagcaaaatgtgaatttcagataaacaatgaacaatttgggacacacactaagaaaattatttgttgtttatctgaaatttacatttaagtaggcttcttttatttgtgtctgctaaatgtggcaaccctaatcctgggacaattacaaaggatcttgtgtgtgtgtgtgtttcctcatgaattgagcaggagcctatttcaacaataaaactcagagctaattgtaatattttatggcacttattaaaataaagcaccctcataattttggataagaaatattattgtagaagtctcaataacagaaacaaaaaaaaatgctttctggcagcgagggagcataactggaaatgtacaagtaaactgaagaaaaaagatggaaatattaacatttaaaaaatgtcatattctatagaaaagcaatgcttcagactctcatttatcatcaagcttggccagcttcaatttactataaattgaatgtaaaattacattaaaaaaaatcgtagccttattatttaaatttgcattacaagtaatccctatgaagtctgtcttccaggaaagcaaatttttaataaatcacataccctgcgttgttctcatccacaaatatgtttgatttcttttccaaatacgaaaagcctagctatgctgtattttttaaaaaaacaacaacaaatgtcttaatccattttgtgctgctgtaacaaaaataactgagaatgaggtaatttaggaagaatgtacctttattttttcacagttctcgagtttgggaaatccaagatcaagatgttagcatctggtgagggccttttcacagagttttcacatggtggtgcatggtggagggtcaagagataggagaacactgtgtgaagcctcttttatatgggacttgatcctattcttaagggaggagccctgatggattattcacccttaaatattccatctcctaatacaatcacctgaattttggaggggacttattcaagccattgcaacaaagattgcaaaaacaattaggtaaaaataatttttaaaatatggctgactttaagttttaattctctcccatcaaccatgtcatctgtgttactgtgtataggtactatacacagagtttgctttctagtagaaagcacgcaacataagatacacctaccttatgttgttgtacttggcgttttaggtcttcaagatcaggtccaagaggctcttcctccattttccttgttctttcttctgtttttgttagccagtcattcaactctttcagtttctgattctggagatccattaaaactctatgtaaactgaaaatttgaaagaagcctattatgacctctttgaaagcaacttattactgaacatcacaatgtaaaacaatagaatttataatatatggaatgttcgcatttgggggcatctattggacattgagaaggatgtaagtaaagcccactatcagtcaccccggaactattatttctcagacttataatagttcacaaatcctgatttctaaaaactttcacatagtcaactaaatgtgaacatgctaactgaagtgcaaagcatctgataattgactaagtagtatattttggcagttgttcgtttacattctcattatttagtatgtgtggtggttaaagatggccacaaattctttgtcacttttcccttcaagagatgaggtctattttccatccctgtgaatatgatctggacttgtgtttttttttttgaccacagaatgtggcataactgacaccacaccaattccaagtgtaggctataaaagaactggcagcatttgtatttcttcctctcttgaagcctagattccatgctgtaaaggaggccaggctacactaccgaatcattagagaccatataggagtgattctgcaggataaaatactgtattagaagtgagcttccagctcagcacagcccaaggggtgacccccagctataaaactagtaatataaaaacaacctggctgagccctgcttatattctcggtcttcagatcatgacgcaattataaattgttttaacccattaagtttggacgtcatttgatacacacaaatagactagagaaagggtgctttttccccacaaagatatagaaaatagtgggctgggtaatgaatttaaagtccaaaggcctaggttcacagcccagcggtaagctctacaaccaggttcttaaacgttctcaattacatttccagcatcagggacatgggataatgttttgcctattaattacacaactttatgttgaggatgaaaacacattattgttcattcattaattcaaccaaaatttgagatgcaaatgagaagtgctgatggttattttaaaggaaatactctttataaacatcatgtttaaagcatttttcaaaactatattctgaacattgatcttataatttgaattaggaatatgttattttgaatacataattttactctaaaatctttactggaagtttccattaatcatcacatttaaacacacaaagtgcacacatagctgagagtgttttttaacagatttaattttttggctgttttagattcacgaaaaattaatgagattataatacaaagagttatcatataacttgcactcagtctcccgttttattaacatcttatgttattatggaacatctcttacaattaatgaaccaatatttgtgcattagctggagactattattatattctgatttccttaaactattttttgtatttcagtatctctccaaggattccatattacactcaattgtcctgtttccttaatctgcttttggctatgacagtttctcagaatttttctggcagtttttaaaagtgctggccaggctggtattttgtagtatgcctctcagtggggatttgtctgattttttttcctcataattaaactggggtttttgaaagaccacagaagtaatgggccattttaagcacattttataaagcatatataccctcaacgtgacttatcaatgttaaatgtgaccacctggctaaagtaataggtgtcatgtttatccactataaagttactctttccccctcttttcacactgttttttaataagaaagtcactatacacagcccctgtggagtggggagttacattccctctccgtgagggcagagaagttacataagtttttggagttttttctgcattggagatttgtctctattcctccatttatttatgaaattatttatttacatagcatggactcatgtatagttatttgatactttgggctaaatccaatactagtttttgctttggatttttgctcaaatagttccagctttggacattgggaagtctcttagttggcttctttgacacatcccatcagtgttttttgtttagagcgagaccgtggagtttagcatgttcttactatctggcactaccaaatgttccaggctcattttctatattccctttcctagtgttagaatcagctgtttctccacagtgttctggttcctttttttttttttttttttttttttctttaaagaatgttactgaaacccaagatcctgttgctaggtatgctccttgcttctagggtgttgtagcttacaggacctctgggttgacataaagaagtggatgtgtgagtgtgtactcacccataaatacttctatatataattatctcatctgtattaacctaatattaatttatccatctctctccaccttgtgacttctgttccttatctgtgaactacctcttcaacttttttttgaactacctcttcaacattttgagttataagaaactcaaaaatgatttctttaaactagaagttgagatgaccgctgttcatgtttggctcctcatgctgctgaatccacagacagagaaaggggttaccatacagaacctaagcacaaatggtcaactgagttcacccaatacaatgcggggcaagtagtactacattagaaaactatgggcatttgccaggagtctcttagtatacccatatatgatagtgttaaccaataaaaaaaacagaagatactcgatcaatatggaaacactaataatatggttctttggaaggatgttttttatttcccactaaggtcaaagtacgcaactagaagaaattctgccatagtaaccaagacagcattgtattagcataaaaactgatcagtggaacataatagagaacccaggaataaattaatgcatttgcattcaactgattttggacatgggtgtcaagaacacaccgtgaggacaggacaccctcttcagcaaatgctaccaggaaaagtaagaatctacatgcagaagaatgaaattagacccttatcccttgccacatacaaaaaccaatttgaaatggattaaaaacttaaatttaagactcaaaactctcaatctattagtagaaaacatagaggacaagcttcatcacaattatttgggcaataacttttgaatatgactgtaaaagcacaagcaacaaaagcaaaaatagactgaggacttataccaaactaaaaatttctgcacagcaaaaaaattaaaattaaaattaaaaattaacagagtaaagagatatccaatagaatgagaaaaatatttgcaaactatatatctgatgggggttcatataaaaatatggaagaaattcaaccaactccatagcaagaaaacaaataacctgattaaaaataggcaaaagaccaaaatagacatttatcataaaagggacaaatggataacacagatatgaaaaaatgctcaacagcactaatcatctgggaaatgcaaattaaaaccacaatgaggtatcagcttacttgcaaagaaaagggaacacttatacactgtttgtgggagtgtaaattatttcaactattgttgaaaacagtgtggtgattccacaaagacctcaaaacagaactaccattggacccagcaatcctattattgtgtatacacttaaaggaatataaatcattctaccaaaaagacacatgcacacatatgttcgtggcagcactattcacaatcacaaagacaatcaacctaaatgcttatcagtggtaaactggataaagaaaatgtggtaaacacataccatggaatactatgcggccatgaaaaagagtaagattatgttctttgcagaaacgtagatgaagctggaggccattatccttagcaaaataacgcagaaacagaaaaccaaatacaccacgttctcacttataagtgggagctaaatgatgagaacacatgggcacatagagggaaacaacagacatggggcctattggagtttggagggtggcagaaggaaagaattaggaaaaaataactaatgagtactaagcttatacctggtgatgaaataatctgtacaataaacttccatgacacaagtttacccatgtaacaaaactgcacatgtacccttgcacctaaaagttaaaatataatagtaattaacgatatctttgtcaaaagaaaaaagaagagattatcacctcacttttgttagcatggctactatccaaaacaaaaaaagataaatgttgataacgatttaggaaaaaggcatgtattacgtacctgcaaaagttaaaaattactaattaaaaaaaagaaaacctttacacactgtaaatgggaatggcaatcagtacaggcatcatggaaaacagtatgaaggctccttgaaatatgaacaacaaaactacaatatgatacaaaatcccactatgaattatatatacaaaggaaatgaaatcagtatgtcaaagaaatatctgcactaccatttttattgcagcactattcatggccaagatatggaatcaatccaaatatccaccaacatatgaacggataaagaaaatgtggtatacatatatacaatggaatactattcagccataaaaaagaataaaatactgtcatttgcaacaacatggatgaacctggaggatattatgttaagtgaaataagccagtaaagaaagaaaaccactgcctaatttcacttatatgtggaatctaaaagagctgatcccacagaagtagggaatgaatagtggttaccagaggctgaggtggttatggggaagggggaggtatggagatacttttcaagggatatatagtcacagtcaaaatattcaagtgatgtattttacagcatggtgactacagctaatgaaaatatactcttgaaaaatgtagagagagaggacgttaaatattcccaccataaaaatgataaatatgtaaggtaatgcatatgttaattagctagattcaactgttccacaatatatatttactcagaagcatcacgttgtacatgatgaatatacaattttatctgtcaatttaaagtagggtttaaaaagcaatgtttagaaattgatagcatttcaaacaataaaatataaaagttgggtctgttgagtgtgtgtgtggatgctgcatactattggcaggaaagatagaacacactcaaatatgtttcgctcagtagactacttacacatttatgtgaagggtcgggggaaaaataataaacgatagtgaaggagccaggacctaacaacaaagacaactgacctagcatccccggaactggaagaaaaaaggaagagagctgttgccggagctcagtgagaattagagacatggaacaagagctgtccaacagtagctgtagtttaagaggaacacaattccagccactccacagtaagaaacagaagaggaagagaaaagtaccacaatctctgctttcaccctcttgccagtgcctcccattggctgaagtactttagcaaccaaaggccaagaggaacctgggtaacagaaaatctagacttcatcctctttgaacagagcaagaaggagaaaagtgaaatgaatctgctaaacagagtaactatcaaaatacttaaattagtataagtgtatttaaaacaaaaggatacaaaattccatcagcatctttatcctcatacactaatgccaggctatttaaaccccaacatggaacctgtatgtaatgttacataccactcacactcttcatataaaattacagggaaacaggggaagtaaaccagtaaaataaaatataaaagataatggctccatagctggtccgaagtattggggttgttatcagagctttcttccaatatgcatttcatattccttttgagagtgtttacaataatttagattgcactatttattgacttttaacattttagagacacatttaccatgaggaacattgcaatcagaagttatgagaataaactttcatttatcaaacacaaaaagtagacattttatttttatgagaaacaacagagatgagatatccatttaagtggaagcaaaaactgaaagttgctagtatttgaaagcatcatttactttttgcttttggacagacatttccttcaacaaatctttactgagtttcatatctatgcaggaaactcatatttgttaggaatggacaaaatacctatcttcaatttcaagtagcttagagactattagagacataaatacaaaaataattagaatataagaaatccattataattagatttatatacattcctgagggagtaaggagaggatacaaattgacctgcagtcattgggaacagtgtcctcgcagaacacacagcctaagagttgagacttgaaaaattcattcattaatttacgaaatatacaattattgagtacctggatactacggatggagaggcaaggaagaccaacacagccccttgctatcttggagtttatatggatggcgggtgagggccacagataatacatatagctcaacaggccattagttggttataatgtgatcatactatgaaatgagagcaattgaattgagtctgtaaaggggggcctttagtgcagtactggacaactgtgaagactgaagtcagaagtagtgaaaaagaaggtataaactctttctagacggaaagaaagacctgtgaaaggccctgtcacatcacagaggaaccggaaatccagtgcagcttgatcgcacaaggtgcaggatggttgtacagtatcatagcctaccttaatctgtgggtccacagagatttcttgagctctgccccaaatctgaaatttgaacacccagtaatctttcatgttctatcgtggtttcattttacaaacttggactcagagattgaccaataagaagagatgtacacataagtgttttatcttctttttttttttttctcttaatagagacaaggtctcattatgttgcccaggctggtcttcaactccttagctcaagcaatcctctccccttggcctcccaaaagtgctgggattataggcgcgagtccccgaacccagccaggtgttttctctttataagtgggatacagaaacatctggttggggatttttggggtagggaccagaatggctgggtgtgtgcaaacgggatggctcaatattttaatgactggtacagtcacatcaatgtctcccagccaaatagagccctgctttttctctcttcattagtggttctgaaagtgtggttactggaccctggaccaacagcatcagcccatcccctagaaacttgctagaagtgcaaattcaaaacttgctagaagtgtgtgcaagactcacacttactgaatcagaaactctgggatgaggtctagaaatgtgtattttaacaggacttccaggtgactgatgcatactcacacttgaaaattactgctctaggtaactttattctacaaacacaactcacccaaattctgcagagaccaagatattaacattaataggaggacaactgccaatccccaggagattactatgaattattttgacatgagacttttacattctcttcctgacttcacctccacttacagagagaagtgtgactgccaactgccaaagaatgggttctacctgaggctccaaaaagcaggatttcatgtgtctgaagcatgaaattaacctcagaacaagtttgaaaacagaagaacctaaggattgtggaggtgtgatactaataagcacgaaaacaaaaagcattcatcccattgttggaaaggattctgagatgttttaattgagaaaatatttcttttccttactacaggccttgactagatattagcaaatagtagtccatatgctggatttggtctcatactaattgaaaataaattgaaatttttgccagtagttaaaatttgagatattagctacaaatatcaaatctgaccactcttgatcatatttaataggattcagcaaccctaaaccttccttcctataggacaaaattgagtatcaattatacttcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacattccaggtaagaatattatttatttgaaaaccactgctagtctacttaaggtatgtgttcgatctattagttactactgctaaaactcagaagatatagatttatgtgacactggcagggaagtatcaaagggtatcagactcagaatgcccaagtatgcccttcagtaaagtaaggaagggctttattacagtactgatatgtgaaaaactctaaagattgaaataactagtaatgaagaggacgcttccttccttcactgaggcctgtgaaaagagcatcagtaaagtgcaggtgaattataggccagagttttctgggtgattagcaaggaagtgagtagtggtccattgcaaggctgaaccagaggaagaagcaaaattgaaggaggcactgatatcagaaggtgagtttaacagccttcatgacacaaatgtcctttttcccaaagatggtttaaataaaggggtgacttcagggagtggggaggttaacctctgggttaaaatgtcattaatattagttgtaaaatacactggctaacatttattcaactttttttaacataaccttgccaaggtaaagatttataatactagtatttttttttttttttttgagacagggtctcattctgttacccaggctcgagtacagtgacacaatcataactcactgaagccttgacctcccaggcccaaatgatcctcctgcctcagcctcctgagtagctgagactacaggtgcaccaccttccctggcaaatttttaactctttttgtatagatgtggtctccctatgttgcccaggctagtcttgaactcctggtctccagctatcctcctgcctcgacctcccaaagttctgggattacaggcgtgagccaccgcacctagctactgttattttatttctgaggatagtggtaggttaaagagctggcacagtggcatgtgaagccagtatagaaatcacaaaccctgtgtgacccaagactgtgcactattttatttttttcatgggcaaaatattgtattagatcatatgaaatttctgatatttcaatttctttgttgatgaaaatggcttcatatagttcaatttaaaacatgatgaaaatgagacaggagtttcttatttccagctaacattctaaagatgtaaataaatttggaaaaattgtcaaagtcacaaaataaaaatctaccatgcacagataggaaaaaatgtttgcatttttccaggtttcattttatatccttcaagtcgtcatttagacgggaaagtaaaagcaaaaggtgaatggagtatacatatatgactggcaatagagagccgagggagtggaattagaataaagtagtatagggcaggagttggtcctgacagtaggtataggcaaaagcatatcaggacatgatactaggaactgctacggtaaacttccaatcgttcagatcatctgagaatagagaggggctagcaaaacagataagttgtaagaacttggaactttggcaacatagagttacagacctaatggtctctagcgtcaacgacatttttgatatattgttagataacagacatccttatgattgtgcccagtgtttctcaaactttaatgtacatatgaatcacctggagagtgtcaaactatgcattctaagtcagtaggcctgggttggggcctgagattctgcatttctaacaactgcccaagggatatcaatgcttcggatccattaatcacattttaaggagcaatggtataagtcactttgagttggcctttttgtcatttgcagtaaatggcattctaagacgtagtatttttcaaatgattttactcgagagctgtcatcccacccccggacatgaaaacgtatctgtatgaacataaaggaattcaatgggaatgccagctttgctttacagaaactctgttagaatgtaggaaggcggctgggtgcgatggctcacgcctgtaatctcatcactttgggaggctgaggcggcggatcacaaggtcaggagttcgaaagcatcctggccaacatggtgaaaccccatctccactaaaaatacaaaaattagccgggagtggtggcacatgcctgtagtcccagctactcaggaggctgaggcaggacaattgcttgaacccgggaggcggaggttgcagtgagctgagttcgcaccattagactccagcctgagtgacagagtgaaacgccgtttcaaaaaacaaaaaagaaagaatgtaggaaggcaattattctttaaccagtgttgtccagaacttactaaaatgatgtaaatattctatgtgtgcactataggtatacatatataatggacactagtcaggtgggaataatgaacacttgaaatatgtatggctagtaaggctcagaaactgaatttttaactatatttaattataataattataatttacctacacatagctagcggctgcaatattggacagcacagctataaaccgacagataattagattaccaatatccgtgaatccttatttgcaagtacttatccataccaatttattttgtcctccaatgtctatgaggaatgacatcctaagtttagcaatctagcaataaacattaatagcattttttaaaattttcattttccatatacaaatttataaatgcaaaatagtacatgttttcattaatttcagcctgtatttgatggtcctaatagcattttttgtgctttatggaaatacattataaaatgtataaacatatattatgaaaacataatcatatgctaggcactaactaataaaggcataaatggatagactttataaaacctagaggactacaattaaaacttacaaattaccaagaggtgtgagctctttaggaagacaggctctcaggcccaattccctagaattcacagttactggcatatatgcaatcctcaatttaaaaaaatacacctaataaaaggaggtaatgtattataatgaaagtctagattagaaaagaactaccagtgatgttcaattgacatgtcttacatgtaaaatacaattacatgatttaagtcagaaataaaacctgtataatatgatttaagggaaagataccagtacaaattagagaaacttaatttttaatgcatgtttttacttttaaatgcacgccatttagaaactaaaattgtactgatgaaaattggaattgatttatttacttattcaaaatgatggctcaggctgggcacagtggctcaggcctgtaatcccagcattttgggaggccgaggtggctggatcacctgaggtcaggagttcaagaccagcctggccaatagaaaccccatctctactaaaaatacaaaaattagctgggcgtggtggcaagcactttttaatcccggctactcaggaggctgaggcaggagaatcacttgaacccggggggacagaggttgcagtgagctgagatcacaccacttcactccagcctgggtgaaagaacaaaactccgtcttaaaaaaatagataaaaataacaaaacgatggctcaaaaattctagcaaggtggttcttatagatagattagttttggttttagcttaacaattctttatatgcaactagatgcttctagaatgctgtcatctgcttaaataagtaatttttaaaatcaactttgtttcagcttttgtttcattctctattaagaaaggtattgggggctggggaaggaatagcattaggagaaatacctaatgtaaatgagctgatgggtgcagcaaaccaacatggcacatgtatacctatgtatcaaacctgcgagttgtgcacatgcatcctagaaattaaagtataataataataataaaagagggagagaaaaaagaaaagaaatccaagataggttaaaaaacagaaagttattaattgaggtaatgtttaagtccggcttttattcaaactatcacagataggtgaattagtggaatttatataaataatgccttaatataaaaaggtactaattgattagaatcactgagagaacttttcaaaatgacgtcccagccccattccccaacaattcaatcagaatatctgggaatggagcccaggtattggttctgtaaaaaactatccaaccaggtaattcgaatgaacatccagggttgagaacgattgtgcctcttccccgcccccccccccgccccaggacacagccataatttttactttagcccttgggtcctcacaagtggcaaatacctggaaagctgtatccagacaacatgacttgttagggttaacatgaaccagatgcacagaggtaacatggagacaaaggatcaggatgcacaaacatgcgtttacttatttataaatgacttccacaagtactaaaatatctattatgtacccccagaaattacaaataaaaaagaagacttactaaagagtaattttgatcttgtagaatttggggcttttaaatataatttttaaatacaaaataataattgtgtgtcagaaaaaaagaggtattattgtaattaatcctattgattcagcaactgatattagccccaatttacaggtggggaaacaaaggcttacttgggtcaaaacgcaaacaagggaaggtgacaaagtgggaactcaggtagtttggctccggggcctgcttcacaatcatgcaatattgcctgaactaaaattaactttttagagattaactttatatctattataaagtcatttatggcactgattataaatattaaaaaaatagaaaacagaagttcatttggtggaattttatacagagattgtcattaataattttattattttcaccaaaacgaaaattacagttgttactcttgagacaattgttcttagcatgatgtttactttaatgatagaaaccacaataccctattttttaaatttttatttttttgggtatatagtatgtgtttatatttatgggatacaagagacatattcatacaggcatacaggcataatatgacattagggttaatagggtatccatcacctcgagcacttatcatttctttatgtgacaaacattccaattatactttttgttattttaaaacgtacaacaaattatgtttgacagtaatcatcctgtcgtgctatcaaatactacatcacattcattcaatctaactatatttttgtacccattaatgatccccactgcccccgacccactagcattcccatcctctggtaaccatcattctagtctctatctccatgagttcagttgttttaatttttttttttttttttttttttttttttttttttttaagctctcacaagtaagtgagaacatgcaaagtttgtttttctgtgccgggcttattttaatcaacataacgtcctccagttccatccatgttgttgtaagtgactggatctcattctttcttagtcaagcttaagacttgtcatttttgtcaaccctttcaaaaaaaccttctttttgttttgttgatcttttgtatcattttgttgtactttaatgtatttcagctctgttccttactgtaatatttattttctcatactaattttgggtttggtttgctccttcttttctagctctttaaggtgtatcattcaattatttgaaagttcttctgcttttttgatgtaggtatttatacctataaactttcctcatagtactgctttcactgcttcccataggttttggttacattgcgtttcctttttcattcgtttcaagaaattctatagtttccttcttaacttcttctttgacccactgataattcaagagcatattgtttaatttccatgtgtctctatagtttccaaaattcttcctactgatatcttgatatattcagttgtgatcagaaaagctaatttatgttattttgatttttgaattttctaagacttgtttcgtggcagaacatatggcttgtccttgaaaattatccatgtgctgagaagaagaatatgtactctgcagctgttggataaaatgttctgtaaatatctattagttcaaattggtctacactgcataataagtctgatgtttctttgttgattttatgtctggatgatctatctggccactgctgaaaatggggaattgaaatcaccggctattactgttttggggtctatctctctaactctaataatatttgatttatacgtctgggtgttccaatgttgggtacatatttatttacaattgttatgtcctcttgctgaattgacccctttatcattctacaatgaccggcgttgtccctttttatagtttttgtcttgaaacctattttgtctgataaaagaatagctaatcctgttcttttttggtttcgattggcatggaatacttgttccatccctttattttcagtctatctttatctttattggtcaagtgtgtttcttgtaagtaacagattattgtgtcttgtatattcttttatccattctgtcactcaatgtatttagattggatagtttagtcaatttacattccatgttatcattggtacgttaaggacttaaacacttcccattttgctatttcctttctggttgttttgtggccttctcttcattctctctttccttcctgtcttactattaatgaaagtaattttctctggtcatatgttatacattcttattaatttttatgtacctgagtacattatttgatttgtggtaactatgaggtttgtaaagaataagttataatccattatttgaaattcatgacaacactggttgcataaacaaataagcaaagagaaaactaaaaaaaaaaaaaatgctacactttaacttcatccccccactctttttgttgtttctatttatatcttattatagtgtctatgtcttgaaaagttgttgcagttatttttgataggttcgtcttttagtctttttactcaagatatgggtagttgagacatcataatcacagtgttataatattctctttgtaacagaatagtaacaaaccttactatcaccagtgagttttgttacttcagatgatgactcattgctcattaacatccttttctttaagattgaagaacgccctttaccatttcttgtagaaaaggtttggtgttaatgaaatctgtcagcttttctttgtcttagaaagtcttcatttctccttcaagtatgaagaggattttcatagatatactattctagaataaaagtcttttccttcagcactttaaatgtatcatgccactctcctggcctggaagttttccactgaaaattgtgctgccagacatactggagctatttctatgtgatttttttttttatatgattaccgcttttaagatcttttctttatccttgacctttggaagtttgatttttaaatgccctgaggtagtcttatttatattatatctccttggtgttctattatcttcttgtacttgaattttaatctctctctctaggtgggggaagttctgtgttattaccctcttcaataaactttttaggacttttttgtctcctctgactgtatttacaaatagcttgtcttcaagctaattctttctcctgcttgatcaattcttctgttactcgtctctgacgcattcttcagtatgtcagttaaatctttcaactccagaatttttgttcgattctttttatttcaatccctttgttaaatttatgtgtaggattctgaattccttctctgtactatcttggattttattgagcatcctcaaatcagccatttggaattctctgtctgaaaggtcacatatctgtctctccaagattggtcagcgatgccttatttagttcagttggtgagatcatgttttcttggatggtcttgatgcttccggatgttcatcaatgtctgggcattgaagactttggtatttattgtagtctttgcagtatcggcttgtttgtatccatacttctcaggagggctttccaggtatttaaaggttcttgggtgttgtgatttattcctttggtcactgcagccatatatgcactggggtgcacccaagcccagtaatgctgtgactcttgcagactgttaaacgtactgccttggtgatctttgggaagattcaggaaaatcccctgtattacctggtagataatctttttctctttccttcccctcaacaaagagagtctctctctgtgatgagctgcctggagctaaaggagaggtgacacaagcacccctgtagctaccacgactaggattgtgttgggtcactcctaaagccagtacaacactgggtcttgatcaaggcccacactgaccactgactggctatcacctacattcactcagggcccaaggactctacaatcggcaggtggcaaatccaatgaagcttgtgtttttcacttcagggtagcaatttttccctggtgggtttgcaagatcctatatgtaagccagggcctggggtcatgtattaggccattctcacaatgctataaagaaatatctgatactgggtaatttatgaagaaaagaggcttaaatggctcatggttctgcaggttgtccctgagacatgatgctggcatctgctctgcttctgcggaggcctcaggagatttacaatcatggcaaattgcgaaggaggagcagtcatgtcacacggccagggaagaggtgagtgggagggtaccacacacttttaaccaactggatctgacaagaattcacccactatcatgaaaacagcactaagaggatagtgctaaaccattcatgagaaattcaacgccatgattcattcggctcccacccaggccccacctctgacagtgaggattgtaattcaatgtgagatctgggcaagaacatacatccaaaccatactattccatcctggcccctcccaaatctcaagtccttctcacatttaaacatacaatcatgtcttccaaacagtcccccaaggtctttacttattccagaattaactcaaaagtccggagtctcatctgagacaaggtaagtttcttctacctatgagcccgtaaaatcaaaaaccaattagttacttccaagatacaatgggattataagcattgagtcaacactcctattccaaaagggtgaaattggtcaaaagaaaggtctcatgcaagtctgaaacccagcagggtagtcattaaatcttaaaactccaaaattatctgctttgactccatgtcctacatccagggtaaactggtgggagtggtgtgctcccaaggccttgggcagactccaactttgtggctttctagggttcagcttccaaagctgctcttatggtctggtgctgagtgtgtgtttcatttccagatacaagggtcaagctgtcagtggatctaccattctggagtctggaggacagtggccctcttcttacaggtccactaggcaatgccccagtggggactacgtgtgggggatcaaagcccacattttccctctgcattgccccaggagaagttctctgtgagggttctgcccctggagcaggcttctgcctggaaacccaggcttttccatacaacctctaaaatctagatggatgttcccaagcctcaactcttgcactctgtgcacctgcaggcttatggcttgtacccgctggagctgtggcccaagctgtacttgggccactctgagccacagctggagctacagtggccaggacgctgggtgcgggggggaggggttggggcgggggcacagtgtacgaggttgaacagggcagctgggaccctgggcctggcccaggaaaccattctgtcctcttaggcctccggatctataatgggaggggctgccttttagatctctgaaatgccttccaggcctttttccccattgtcttggctatcagcacttgccttctttgtaggtatacaaatttttctagcaagtggttgctcagaagccttcttgagttctcctgaaaatgggcttttattttctaccacatatccatgttgcaaattttgaaaacctttatggtctgctttccttttaaatatacatgtataaatatgtaaaaaacctgcacgttctgcacatgtatctcagaacttaaagtacaataaaataaaataataaatattccatcttatttctttgctcctgcatcagagagtaggttgttagaagtggccacacaacgtcttgaacattttgctgcttagaaattcattccgtcagacacacgagatcatcactctcaagttcaaactttcacagatatctagagcatggacataatacagccaacttctttgctaagggataacaaacatgtcatttactccagttgccaataagttcattctttccatctgagacctcgacagcttggacttcactgtgcatatcagtatcagcactttggtaacaatcatttaaccagtctctaagacattccaaattttccctcatctgtcttcttctgagccctccaaactcatccaacttctgtctgttacccaatttcaaagcagcttctacattttcaagtatcttgacagcaaagccccacttcttggtaacaattttctgtactaggccactctcgcattgctatcaagaaatacctgagactgagtaatttataaagaaaagacgcttaattggctcacagttctacaggctgtacaggaaatatgatgctggcatctgctcagctgctggggaggcctcaggaaacttacaattatggcagaaggtgaaggaggaacaggtacatcacatggccacagcaggagcaagagtgagagggagggtgccacgcttttaaacaaccagatcttgcaagaatttactcactattgcaaggacagtagcaaccaattatgaaaaatttgcccccatgatccaatgagctcccactaggccctacctcaaacactgcagattactacaattcaacgtgagatttgagcaggcacacatgtccaaactatatcaactcaagaacctaagaaatctacctggtgctctattctactgtggctaagctggcaccccacccaaaagataaagtccttccctctcttctctcccctttccacaaacagagatgtctctcctcatggccacgacgactactgaaccaaagagagtactgtctgaggtccaatgttcactcaagggccaaggccactttggccagcctgtggtgaatgctgtcagtcctgagtctctcccttcagggcagtaagaaaatggaatccaggagccaaactctggaatcagggaccctaggagcccacttgatgctctgccccactgtggtcaaactggaacccaagctgcaagccaaagtcccctttactctcacctctcctttcctgaagcagaaggattctctccctgtagccaccacagctgggaatgtactgggtcacacctgaaaccatcacagctctgagtctcacccaatacccacagcaagtactgcctggctacagctgctgattattcagggccctaggtccctttggtcagcatgtcatgaattctgccaggacggggtccttctcttcaaggtgacaggctctcttctggcccagggtgtgttcagaaatgttatctgtgagctagggcctggaatggggacctcaagactctgcctggtgccctatcctattgtatgtctgagctggtatccaagcagcaagacaaagttctctttcttgtctcctctcttcttcataagcggaaggaaggagtctttcctggagctgtgagctgtgctgcctggggttgggggaagggaagcacaagcagtcccttagctgccccagcggatgtctcactaggttgtatgtatcccaagtccactgactctgagcccggcacagcaccaggacttgcaaaggaactgcagtccttgtggcctagactacctttgaagtttatttagaaccacagagcactctaatccatgatgacaaggcttgccggaactcaggttccaaacactgggatggatgattcttccctgtctagggttcatctaaatgctccctctgcgggatttggctgagttctgttctttgtcggtttccactgtgacagggcagcactgattttcaatgcaaagtcctataatcactgcaatctcccttctgcaagcacatagactctctcttcatgccatgtgactgctgccatggatgagggagagctggtataggtgatagaatattgcctttactaccctcttctgtgcctctttctgtgatacaacccaaaaaccaggtactacgatcatgcacctaatttttcactcttatgaaggtgcttttctagtgtggacagttgttcaatttgatgttcctgcaacagggataattactggaggcttctgtttggcgatttttctccacctcctccacaataaacttcgagactcattttccctcaaatatatggtgaccatataaaatgactagatatttttaaaatgtatggtgtatcattaaatataggaatcagaaatcatgatatattataatccaagaaatggcaaacatgttttaatatagaaaagcaacattcatttaaaagaaaagcttgagtagtgcatgtacaaacatatgcacatagttttttgttgttgttgcatggcaataatgaatggtccataggaagcatattagtatttttcaactcccaagatttataacgtttatcaaagttcaataagtggcctgtgaaatataagctttaaagccagaatccaaacagaaccaattaccccctcaaatgtgtaagacttcagctgtcactgttttcactatctcatcacctttaccacaagtacatccatcgctattgtcctctagttctcatgctaactttctgaatgggtaccctcagcatctgtgaagctgtagaaaccctactggcctagtttacctacttgcctcagtaactagatctgctttcctccaaattctggtattccttactagactcagctgcaaagcctgacactgcatggtgtcacggtgtgtataaatcttaggcactaatatagtagtttccattggagaatgaagtgaggcaaggtctgacaaaattatacagtttttatccccctaaaactaatgtgttcattctcctctttacagcaccttctttcccaacacgaagtatgctgacatcttgggctaggaaagaagccaaggagagcatgtcatgtatcattttcaaaaattcccactaattgccatagttattatactgcaccctgcaacctgatcttggaggtcaaactttaaattacaacctcacagtaaatagttcagaaagaacctaatataaagttccccatccaacaactagaaatgaaggaaaatgttccagtttttcacaaaattaaacatgcactaacatttattttcctacttaatggaatgtgagaaatagtattgtttttatactgaattctatgagaaaatcgaaaatgtgtcattgttttcaaatcctgatccatttttgtcctccatccatatagctgaacagtttaattattaatatttttcaactatccgaggcaacattaaagttcaaatgcaaacacatttattttcattttgaaaacataaattcagtttagtaacaataacataaagaagctgcgtggctggatgcaaaagattcttggccaggcgtggtggctcatgcctgtaatcccagcactgaggctgaggaggctaaggcaggtggatcacgaggtcaggaggtcgagaccatcctgaataacatggtgaaaccccgtctctactaaaaatacaaaaagttagccgagcgtggtggcgggcacctgtagtcccaactactggggaggctgaaccaggagaatggcgtgaacccggggggcggagcttgcagtgagccgagatagcgccactgcactccagcctgggagacagggagactctgtctcaaaaaaaaaagaaaaagaaaaagaaaaagattcttgtggcaaatacattatggcaaccctcaaatcaatcttcctgattaaatgcttttaaagaaaataaagaaattggcagatgtcatcaggagccaaggacaaatatgaatatatcacgtttggaagactgtttaaattatctctagtaagaataggtaatgttgacactctgaaattctattcatttatgtggaaatagaagctcactctcaacttcaaaaattttgccactacatagcatctggcacagtgcctggcacatactacacactcaataaatatttcttcaatgtataagtagtataacttaattatgaacaagacatagttttgatatttctgattgggaatttttgtactaagattaaaatgtcaacttctattaaatctgctctctgagatagtctattagtttaatttgaattgttccaacccctggctgttacccagttccaaagtcacttccacgtgttcgggtatctttatagcagcaccccactctctgcggtaccaatgtactgtactagtctgttctcacgctgctaattaaagacataatagagactggataatttataaagaaaacaagtttaattgactcacagttcggcatggctggggaggcctcagaaaaaatcatgatggaaggggaagcaaacatgtccttcttcacatggcagcaggaagaagggccaagcaaaaggggaaaggccccttataaaaccatcagatcttgtgagaactcactcactatcatgagaacagcatgagggttacactcccatgattcaattaccttccaccaggtccctcccacaacacatggggattatgagaactacaattcaagatgagccaaaccatatcagcattatttatctttgtgagaaagcattgtttttgaagatacggctctctcatttctgtgaattccagaaatttagctttcctgtaatttaaactatgagtcacatgcattgtattattagtacaagagatgtccacatttagctgcattatcacatttttaattattgacagaaaaattattatgaccataatccatgtgcaacctaaccgaatgtcacgttatcatctataaataattcctacttcttattagtccaatagcttaattatcaatactcatcaacactcatatattgtctgttatatattattgcaccagaatcttgctactgcttaatcacccatggggtatgatatcaacatatgaggactgaatgaaatatcagcaccatttttagagctcctgagaaagtaattaaaatatttggcccacgtcacttgatagaaaaataggaacagaagatatctaagtagaggtttacaaagaagttgagatttctactctgtcttaatttcagttagatcagtgcttctcaaacttaaactgatcagggatcacctgggatattgctaaactgcacaattctgattctgtatatatcagaatgagagctgagagtctgcatttttaacaagttctcaggtgacgctgatgctactggtcctacaccaccttgatctgcaagttactattgcttaacattactggaagaagtaaaacagaaaaatcaatgaacttaccaaattgtgaaataaaatcacaattaggagtttgagattgtgcacctccaaagtatttactgcaacgaattcaattccaagattggaattacctgaataacttaatttagttgttcatctattcattcatatattcacatacgcaaacttcactgcacttgggagaaaataacccactcatttgttcagcacctccttttctctatccactctcacatatgccatcttatttccagagtcaaatagacacttgggggaaaaaaaaagagatgagccatatttgttagatgtatttttctgtccagtcaaagcattgatggtgattcacaattattttccatattatggcttgtgtatctacccagatactattcatatctctcctcctgctgatataaaccaaaaaacacaacttcacttggcctcctgacttgctttcatttttttcccttaccgtcacagaagttttagtttctgcctgcatgtcctaactacaattatcagaaaagttgatggaacttgctgtgcttaactttgagtccttataaaaatgtcagtaaatcttttttgctctctgcaggttgcatttttcaatcaaattaattagtttattcatagagaagaaaatcttctgttttccctgtgccagttgtcttcttgcacttccacagttggaagttgtgtgtttttcttccgaattccttacctcctaccatcccaagtgtattccacagcattaaaaaaaaaatcattggcttactcctcttaaggggttctaacaaaaccacatcaatattctcttgttttaaacactacattatgaaaggaatggcacttagttttctcatttaaatcatataaacattggtaaagttttgtaattgaccagtatcggcacgtgccaaactcatttgtgactggagatgtgttaataaacttctttattgtattagcttttacctcatcagaaatttatgtccataaaagcaacagaattggagggaaaatacaatagcaaggaaagaatcaaatgagagtgtggttatgaaggagaaagaaaggaggaagtatctgtatggttatctttcctgacattcctttgtaagcatatttttaaatgttgccattgtgaaaaaataactgcaaatgtatttctaatcatcctgctcatgctcccttatccccatacaaaataaccacagctatactctttgggaaaaaaaaatgactgaggcaattagaaaaggctggagaaaaaaagtaaaaaacatctatgagggtcaggtttggtagctcaggtctgtaatactagtactttgggaggccaaggtgggagaggatcacttgaggccaggagcttgagactagcctgggaaacataacaagacctcattccctgcaaaatttttttaaaagttaaaaaattatatataagttattatacaaaatatatgaaatataattatatataaaattatataatacttcatatagaaaatatcaaattacatataaaaagtgacatggtatggtaaaatagttaactgacagctcatcatcttatttatcacagttatctttcttcacattttataataattttgcattcacaaactaactttttataccctatctcatctagtatctttcagaggtatgtcagcctcatgacactattgctgttttacaaaactataaagtagagaacagaaaagaaaagtatattgccccagttcacataaataagtgtttgagaaagcaagcccttattccttaggcaaactggagaggattttatgtaaggcagaaatcagggcacgctattatctttgtatttttaatatttcttgttttgcataattgttgatggtttatgggataaatattatttcctagatgcaacttgaataatagtaactgtgggcacaaattgaagcagtctatttccaaaggaaaaagcacttttactgtcaaaaggaaaaaaaaataggaactaaaactaaacagagaagtggtttttaaaataactaaatggctaagatagtaaagtatacttttatcacaactaccagctggtctaagacactactgtgtcttaactggccaacttcactggcctaataactgtcctctcttcctccagtggccttcctgataggttttcttgacctatctctcacctacataaaatctgatggctttgtcttgcacttagtctagaattcaaagcccttattcaaagccctgactgacactacaatatgtaatcagtctcctacctatatttcaaccccatctcagacctcagccatctaacttaccaccctgcaactctacagtccccctggccttttggttcctccagcaagccaaactgtccctatttttgggcctttgcattagctgttcctaatccgtgaaccacacttccttgtgatctgcaaatagtggtaccttcttgtcattcaaatctcaaactaaatggtaccaaccttcaaagtcttacctggatcacaaagtctaaagtagcctcccctcaaccattctctatcacattacattttaatctcttcaaaaactatattcctatccggtatttttcttgtgttcttttttttcttggctgccagcctctacagaatatgtttcatgagatctggggccagaccttgtatgatcattattgagtctccagtgccattaattgtttttgataatgtattccattaatatttgttcatatagagagatatatgtgtattttatacgtatatatatatatatatatatatatatatctcacaatgactatatatcaaatataatttgatgttgctattaggttggtacaaaagtaattacagtttttcccattacttacaatggaaaaaaacatgattacttttgcagcaacctaatagtaagtatgttggtagataggattaataattgctaagtgtaaatgttcatagattttagtgataagcttatctgtatttacaagaagtttttaacttttgttatatcaacttagaaattatagcatagctttggatatacttaatatgactagacaaatgttaattatcatttctctaatcgctaaaccaaggcttaggcaggaaataatggcttccgactggatctatccaaaccctgtcttaggtagagagagaaaagaagtatcgatgaatccatttttgtttactagtaatcttctactctgaagtaatcatatatttagaaaaaaaataggtaatgctccaagttgaagctaatcattggagataatccattctcatgaccatgataatggaaactgaacaggttataatttatttgaagcattaagtaaaacctagattagttttttaaaaataatgacaataccctcttttcataatcacgttttttgtttcctctcacaaaatctttcaaaaatcaggttcagcaaagcttacataatggcttatcacattagaatttaataggttttatgcacgaacacatacatagtcaaagtggcaaggaagactgttatttataaactctcatattatttctgaatttgtgttgctcaaataatgctttgtatattcatttttaaggaattttccagaaaagtctatgtgatagaagtggttacatgtacgtgtctcattttaaaaactctgtgagatgttttagcaaaagctataccagctagaaggctctccttgccttcttaataattattctaaaagctgtaacacgtacaaaagctcttgaatcttccctaaggacaaactaattttttatgtcaatctcagctaggtggtaatactgccattttagcatttccattctctagtgggatggggatgaggaaattacacgcacagaagtctaggtgtctgtcatccttcacttaatggcagacatcccttgaaggggggaatttttgaatgaacatctttttaaatgttagaatcacagataaaagactttttttatgtttcagataagcaaagaaaaagttgcaattttaattccaggaggaattcatattttcttgcaactcaatttcacacagcaattaattaactgattagtatgaataattaatgccatattgttagttttattgaaaatggggagtgtaagaaaaatgagagcatttagcctccaggagaggatggaaacctagagtgcacaaaggagaagacactggtggctattatggcaaggacagtaaagaggtggttggattttcaaaactttctaattttgtttgaggttgctttaagttccacagatcactgcaaatagaagttctaacctgaagaatgttggcatatgaccacagaaggcagcttatatcttaatatcgataatagatggagtaaattagtggacctggtaaacactggggagtgggcagactcaacagttataatatgattattgtacctctcacatctaggggtagtgacaatcatcaccacgatcacagcaggcgaataatatcaatatgcatagattagtatctcctggcttggaatacatatatagttatgaaacctctatcttacatgtaccttatttattctttcaaaaggcctgagcttaaaaatgtgtttttcccctccataatttcacactataatttagtactggaataccaatccttctagcatatctaatgagtttccttggtccttttttttttttaacgcttttgaacttcataaataatagttaaataaacttaaggcatttggacaatttttttcacttaatgtattcaaatccacagttggcacttcatttcttttcatttaaaaataaatctatcttgtcttgataggctttacatgaatatacacacctaacaatataaatcaaaacacatatccagaatgatgagatctgcttgttacctttataagaaatatgtcatttttcagaaatgtctcaaatcctcttttttattaagtcaatatatattcttaagataattcatagccatactgtattttaataagaatttcccaaaacgtttgaataatgtttttcaagaggatttccatatatagatgagtaactctttaatattttcaagggctttttcttcagaagagaagtttcgtgtcaactatagctaataggtgattttatgtacacaatctcctgtgcatgcttctgtgccttttatagtgacattttaatgtttggaggaaaacctagaaaataataactatgacagaattttggcaaatcttaaaacatagttctgtagataacagtgcatctatctaacatctgctcttttagttacaaaagtgaaaaccaaaatgttatttctatgaaaatccaaccagtctcccttgaaagaaagctgtgtgccttgggaacaaactgagaatcgtaacttaaccatcaaaccacatcaaaataatcacaagcttccaaaacttgttagtcttcttaattaaaaacaaataaggacttacttgctttgtttttccatgctagctaccctgaggcattcccatcttgaatttaggagattcatctgctcttgtacttcagtttcttcatcttctgataattttcctgttccaatcagcttacttcccaattgtagaatattaccaacccggccctgatgggctgtcaaatccatcatgtacccctgacaaagaaggaagttaacaattgtaattagaactctaggtaaatcggtgtggttttgagttttatttgtttgcagttttaaacttgtggcccatttagatttatattcccagtaaaaggaatttaatttgtatttgcagaatcccaaaaccacttttaatatgaattaaggaaaattatcttaagtcaagttcttcagaagcaggccccgagataaggacttcagtgcaagtgatttattaaggaagagctcccaggaagttccgcaagggagttgaagatggaggaaaaaggacagggaagggaaagaagccaaacgagtgtatcatctcaggaaaagtctcccactgagagaagttaagcccaataccatacatcaactcaggaatgtaagtaatgcctcagcactgccttgacacaagagaaagaagttgggctttcgtattcctgttggccgatcaggtagaaatgccttcaatggttgctctccaaaagaaaacttcaaaatctgactgttggaatcccaagcacatcatagtaactaaatttccaaaatacaaggatgtaagagagtaattgaggaaaaaggatgacttgccattataacaagtcatatgttttgttttgtaaattaacgttttagtttacctcatgagtatgaaactggtctttcaccacttccacatcattagaaatctctccttgtgcttgcaatgtgtcctcagcagaaagaagccacgataatacttcttctaaagctgtttgataacggtccaggtttacttcactctccatcaatgaactgccaaatgacttgtcttcaggagcttccaaatgctgcacaataaaataaattgggtgttacacaattaatgtctttgcagattgttccagtacattaaatgatgaatcgaatgaaatatttaaaatgctaggactgtccactggcattatcaaacacaggaacagcagatacagacaatagggagttttcattttaacttcctcatgcatacatcaattttcaaatagcggtcaaaatccacaccaaattaatattgtattaaagctcttctagattactggaaggagtaaattagtatatcacctcatgttgctttttaaatgctataaatattgatctgtaggaactttcctcatttcttatttataataacttacatatacattatcagaattatatttacatacctctgcaatggcattaaaggaaatatctcttcctgagaggccctaggtaatgaaatatttccaaatatttacagaccagtaaaggcatcagtaagaaaacaaggaggtaggggaaaggaaggcaaaatttagaaagaaaaaaaatacctcacccacccatctaaaatttctaacagcataatgacttctgtgatttagcctttatttccagaaggccacgatttaaatagtaagacattatcttagaagaactaaaatatgaagtatgctttacccaatttaattagcaggatattaagtgagaatgcaaatggttgtcttggaatttccgtctggaccctaaagccaagagcaaagtgtacgaagcatccataattctaaagagaagatccagggtacctgttaaaaaattgctaagaagtgatcacaaaattggtctcacaacccttaatccaatatctagcttaaaggtgtgtaagagcaagcaaggaggtcgattagaaaaatctggtgagaaaggcttcctctggagaggctggagcgctctgcgtggctctaacttctccccatctgaagccaagtaatagagacggggtagtttacatgagctgtaaacctggccatatgtttgcagagatttgcatgctataggaaccatacactcaagtgacaggagaggcttcttgggataaactacatgtctgctgctttaacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattctatagcctattaaacaaaaggttctagagccaaaaacattaatctttttttttatactttaaatactagggtacatgtgcacaacgttcaggtttgttacatatgtatacatgtgccatgatggtgtgctacacccattaactcgtcatttaacatcaggtatatctcctaatactatccctcccccctccccccaccccactacgggacccagtgtgtgatgttccccttcctgtgtccaagggttctcattgttcaattcccacccatgagtgagaacatgtggtatttggttttttgtccttgcgttagcttgctgagaatgatggtctccagcttcatccatgtccctacaaaggacatgaactcatcctgttttatggctgcatagtatttcatggtgtatatgtgccacattttcttaatccagtctatcatcgatggacatttgggttggttccaagtctttgctattgtgaatagtgccgcaataaacatacgtgtgcatctgtctttatagcagcatgatttttaatcctttgggaatatacccagtaatgggtatattactgtaatgggataaaatgggatggctgggtcaaatggtatttctagttctagatccttgaggaattgcacactctcttccacaatggttgaactagtttacaatcccatcaacagtgtaaaagtgctcttatttctccacatcctctccagcacctgttgtttcctgactttttattgttcaccattctaactatgtgcaatggtatctcattgtggttttgatttgcatttctctgatggccagtgatgatgagcatttttttcatgtgtctgttggctgcatcaatgccttttttgagaagtgtctgttcatatcctttgcccactttttgatagggttgtttttttcttgtaaatttgtttgacttctttgtagattctggatattagccctttgccagatgattagattgtaaaaattttctcccattctgtaggttgcctgttcactatgatggtagtttcttttgctttgcagaagctccttggtttaattagatcccatttgtcaattttgactcttgttgccattgcttttggtgttttggacatgaagtccttacccatgcctatgtcctgaaaggtattgcctaggttttcttctaggtttttatggttttaggtctaacatttaagtctttgatccatcttgaattcatttttgtataatgtgtaaggaagggatccagtttcagctttctacatatggctagccagttttcccagcaccatttattaaatagggaatcctttccccattgcttgtttttctcaggtttgtcaaagatcagatagtagtagatatgtggcattatttctgagggctttgttctgttccattggtctatatctctattctgataccagtaccatgctgttttggttactgtagccttgtagtatagtttaaaatcaggtagtgtgatacctccagctttgttcttttggcttaggattgacctggcaatgtgggctcttttttggttccatatgaactttaaagtagttttttccaattccgtgtagaaagtcattggtagcttgatggggatggcattgaatctataaattaccttgggcagtatggccattttcacaatattgattcttcctatccatgagcatagaatgttcttccatttgtttgtgtcctcttgtattttggtgagcagtggtttgtagttctccttgaagaggtccttcacatcccttgcaagttggattcctaggtattttattctctttgaagcaattgtgaatggagttcactcatgatttgcctctgtctgttattggtgtataagaatgcttgtgatttttgcacattgatttgtatcctgagactttgctgaagttgcttatcagcttaagtagattttgggctgagacaatggggttttctagatatacaatcatgtcatctgcaaacagggacaatttgacttcctcttttcctaattgaataccctttatttccttcttctgcctgattgccctggccggaacttccaacactatgttgaataggagtggtgagagagggcatccctgtcttgtgccagttttcaaagggaatgcttccagtttttgcccattcaatatgatagtggctgtgggtttgtcatacatagctcttattattttaagatacgtcccatcaatacctaatttattgagagtttttagcatgaaggttgttgaattttgtcaaaggccttttctgcatctatggagataatcatgtggtttctatctttggttctgtttatatgctgcattatatttattgatttgtgtgtgttgaaccagccctgcatcccagggatgaagcccacttgataatggtggataagctttttgatgtgctgctggattcggattgccagtattttattgaggatttttgcatcaatgttcatcaaggatattggtctaaaattctcttttttttgttttgtctctgccaggctttggtatcaggatgatgcttgcctcataaaatgagttagggaggattccctctttttctattcattggaatagtttcagaaggaatggtaccagctcttccttgtacctctggtagaattcggctgtgaatccatctggtcctggactttttttggttggtaggctattaattattgcctcaatttcagagcctgttattggtctattcagggattcaacttcctggtttagtcttgggagggtgtatgtgtccacgaatttatccattccttctagattttctagtttatttgcgtagaggtgtttacagttttctctgatggtagtttgaatttctgtgggatcggtggtgatatcccctttattattttttattgcatctatttgattcttctctcttttcttattagtcttgctagcgatctatcaattttgttgatcataaccagctcctagattcattgattttttaaagggctttttgtgtctctatttccttcagttgggctctgatcttagttatttcttgccttctgctagcttttgaatgtgtttgctcttgcttctctagttcttttaattgttatgttagggtgtcaattttagatctttcctgctttctcttgtgggcattcagtgctataaatttccctctacacactgctttaaatgtgtcccacagattctggtatgttgtgtctttgttctcattggtttcaaagaacatctttatttctgccttcatttcgttatgtacccagtagtcattcagcagcaggttgttcagtttccatgtagttgagtggttttgagtgagtttcttaatccagagttctagtttgattgaactgtggtctgagagacactttgttataatttctgttcttttacatttgctgaggggtgctttaacttccaactatgtggtcaattttggaataagtgtgatgtggtgctgagaagaatgtataatctgttgattaggggtggagagttctgtagatgtctatgaggtccgcttgttgcagagctgagttcaattcttggatatccttgttgacattctgtctcactgatctgtctaatgttgtcagtggggtgttaaagtctcccattattaacgtgtgggagtctaagtctctttgtaggtctataaggacttgctttatgaatctgggtgctcctgaattgggtgcatatatatttaggatagttagctcttcttgttgaattgatccctttaccattatgtaatggccttctttgtctcttttgatctttgttggtctaaagtctgttttatcagacactaggattgcaacccctgcctttttttgaaaaacattaatcttaattcctacattaaaaaaatggctctggcaaagattgctcatcctccaatatgtatctttcttcaccctttatgtagtattagaaagtttaggggacaatttggctatctagaaatgtcactacagttcccactttcccttgcagttagatgtggcatgtaaccaagtattggccagttggatataacgcatccaacttcgtcattaagacgtaaatgggcatagatatgctctcttcttcgtcctccctcctgaaggtcgtgatacacacatgaagctggtgagctatcctcaaccgtgactacgaagacagcgtcccaggggatgatcgaaaaactgggcaacaggactatggatccctgaatgagcagagacttcctacaaggcctccatcactcccatctacacaacatttaagagaagtaagtctgaaagagaaacaaactcattttttagttcatccatccttgtgtttttgttagtgccacgaaacctacagcaatctcatatactgatatactctaattttctagcagctgagattttactataaaaatgtatctgtaaaagcttatatgtgagtttaaaataaactttctactataaaatcagatgtctctctaaaactctactctgtctctctaaaacatactctcaatgaaggttccagtcattttgcttcatcgtttttcaagtcacatacctttagatattacactaacccttgcattgtaggaaggcggggacactgaccccgtgcctaacagcacagtacacagataataaatatttactaaattgtttggggtaattttaatttcttatttaaggtcatttgtgcttccaatttcaggttttatataaaatatgttttaaccaatcaataccttgaaaatggagtaatatggcataaaatattcatagtttcaaatatatgtcttcccaatattcctattcatatttcatatgtgtttatacatatatacatattcacatacatatatagtataccaacttatatgtgtgtgtgtgtgtgtgtgtgtgtgtgttttcttcctctaatttctctaattctaccatttatatctttgggtatacatttactttctaacttattttatattttattcctttattttttcctgtacttcacctgagactttctgtcttggctattataatccacacaatagaacctttctcataaaatcaagaaggaagaaaaagaaataagcactgttatggcaaattctcctaaatcaatggaaggtcagagagaaaataatagaagatttagagaaatgtacctagaacaatttaataacccaatataaaagatttctttttaaaagcaagtttataataaaattttcataagcatcaataaaaaaactttctcagaaatttattagatggcacatgaaagacgtctagcctagtgatttctttgttcttactgtttcatataattcttacaaacaccctaaaaggggggacctatttccaagatgaggatgaggaaatccaagtcacacctatgaggtgtgggaggaaaaatgggatacccagtaaacaaaccgacattccttggctgacagagattcatgaagtccagagaagaaggatgaacataataactctgtactgtttggtggatgtttcaataattttaaaagtcagtatttggttggaattcatatgagttggtaattgaaacgagattttgtaaaagtactaaatttaatttaaaataggatagttacaaaatgtctcagaagaccaaataaattcttaatgttattttccttaatcctaagtttaacaattttattaattttcaaatacgtctcatggaaaaacaccaagtcttatttattttaatcagtcatttataaataggaaaaaaatgattcactggatacttttaaaatgcaaaataattcagaagtaaactgctttagacaagtggtttttacataccaaaaaaatcaaaacaaaatacacatatctcgtgaaaacttattatttcaaattgacatatactgcacttaaataatattcctctagaatgaccgtagtccatagagtttgtaattgcatatacaaattaattgtgagctatgaggagaacctaaacataaatattcccatgtagcccgttttggaattttgctttttttctcatcatttataatattcttagctatgtactcatttattccacaagtctatatgtaaagaaattagaagttagcacaagagatgtccccaaaatatagaaacttatctacacttacactaatttcagtgaaaatcttattcttcctgttatttgatccaagactccttaaccttaagcttttttctgtaaagggctagataataggtatcttcaattttgcagaccactaaagaccagatgcccccaactcagctctgtcactgcaaattgtagccccaaagcatctggagacaatacattaagtgaataaacatggatgtgttccaataaaactttatttacaaaaatcaggtagcaagtctattttcaccctcaggccatagattgctatctcctgatgatgaaattgcttcccacatttaaactaatttctctgaacttctcactgttgattatctttcctctctccaatctctccccctccaattgattctcattgggtcactttcccactctattgcatgtccaagctagccatctctgaaatctcactgccctccccctgccctacctccattgctgtatataacaatgtctcaaagaaatcatgctgcataaaaccagtggccgcattcgggaaactttaagtcggcctcactttggagtaaaataaacatgaggtcaaattcaggttctggaatttataggtagtgtgtacttgaacttggcaaagttttttaatttcacactcttggtacacacctgaaaatagatatgatactaatttagagggtaattgtaaggctcacagacaacatacagcgattgtattgacattcagcatcaccctttgccattcaacttttataaaatcactttcactgcctcattgtttttatttagtgcaacccagaatagagaactaacaacaataaagaggagtttggttcaattagattttaggttgtaaaaatattctactaaattgacacatcttttctaactaggtaaattttctccaaggacattagctatattcacctccttaacatacaccagttgcttggtttatcccgttacctttcacatatatcactaaattctgtgtgctttctctttatttatgttacatacctttgtctcttttccttattccttaaacaaagatgtggtatatccttcataagggagagaaatccctatgggggaactaatgggtagcttcctgtctctacttcttgggcatctatagtgcttctgtgggatagtttcattattaaaattagggaaataatataaataactagtgagctaattaggaagacaattataagggtgtgattgtggaaatggggaagttcttttatgagaggtgatgtagcatctcggaagcctcacgacagtagacagtttattttgttcagcacctgacatacagtataacatactatatgtttgttgaatacaataatgtgtctcttagcatatgacatgtaacaatattccattttaccttatactgatatgaggacattttttttcctaagagaattagaccaaggcatctttccatgacagagcagggacaagaaatgacacaaactccacttgtttatttcacttactgccttcttcaatgcagtgttggcttccctattcaaggaaagagattcttggaatctcttcctattcctttcctattcaaggaaaggtcttcagagcctgccatttcaaagaatggtattaattcttgggaagactctggtagatttcattaacacctgcaaattccaccctctgcctcaaggaaagtaataaaagtcctctatcctgttggctgaaagcagtggaaagttcttcaattttatcattggctcctaataggagtaatcatgcttcagggtctgtatctctgtgtcccatagacaactaaagcttttgatcttagggttcatagaactgagaagaacgcagtaagtcttttgcatttcagaaaaataaaagtatgaaaccttttgataagtttccatctcttgttatactaacattacttctcatattttcaagtaaaaaaaaaactcaaaatcagggtgggctaagtgataagagcaatcacttctgatttggtgaagatactagaagaggattaaaggatatgtacagatatgtgtatattaccaactgaggaaatggaagcatgagcagaaaagcgaaacagaaccctaagtgaggtgaacatagaaagtaaacgtcctaaagtcataaacagagacaaaacctcactgaaagttttcacttataatatttttaaacagatttgacatttctttccatttattttctgtaggtatagaatattttataactgacctatttataatgggactaccaccaaatatccatttttaaaatgctctctccatagcatgaatgtcttataaaatctagtctctttcttaatattgttaatacagaagcttctccttcaaagattgaaggtttttttctgcttttggaaataatttgagaaataacatagtactcacagccacttgccaacctgaaaatgttcagcatttatgtaacacttgaccttttcaaaaataaagtacataactcaatcttttcaactactttgccatgagatgtccagaacatttctgtgtagtaaaatagatttcctaggttactctgattttgctgacaaagattttaagtattctactacttaagataacataatctataaacacactttagtgttcatagacatagcagcacatcaagagcaccaaaaacgctaataaataagagagaggcctgacattatgcatcctattaaggatctctgattttccacagaagatatcaagtaccatatattacatcaaattatctgaaaacctgtatattaaaaattggtaaagtttatttctttcttaattcttaaataagcctgtgaagagacattataatatgtccttctagaaccccagttcatcgtgtgtatctcctaagtgggtgctatccactgtgtagactgtgctttaaattataatgctgtcttcatcatctaaattcttttagaatttaccaccagaactgaagtatagtgaattaagtgtttaccatttgtgagggatggtgtaagcactccactaaatcatctaatttaacctcacaacataagggatgattattgtctacattttactatgaggagacctgattcataaaggttagaaacttgcccaaggtcgaagagctaataaaaagcagagatgggaactgaattcagtatctgtctcacgaaatcctgaatattaacttgttgccagacttttttgtaataactcaaggggaagaaacatttcccagagatagctagatttataaaatttaatttaaaaatcaaaatataataatgtgttatattttatgtgaatgtgatcattctaagtctctcatacactcacagaattgtggatagatttctttgattcatccagtctttttcacccttagaaatttctgtgaccaattttatatgtttataatatgattgtatatggcatataatttttgcattctaaacagatagcttgtctatataaaaataaaaaatgaactaccataagtttcattagcacaatgccttaaaatttactcacattttaaattttaaatcagtacataaaatatagatacaatgaaatatgcagcaaatattactgggattttgttggtatataatcatacccgaaacctgtcaaaacttaaaacacacccattggtacatttcaacttatttgttctactttggaaagcagaaatggaaagaaacagaataaacagaaatacctttttgtcacatagtgagataatcaatactatgtttaaaaacaaagtttctttatattttcaaaatagcctctagtggaatcagctaccatattcttgatttgcataatacttataaatttcctacaaactcagtacatattctatttggaagtttttatatataggctttatattacactaaaaaggtcatcaaattattgccacgtccataaattaaaatatgttaaactccaaatatgaaagtacggcagctcttcaaaaaccttaacataaaggtaaattaaaattatgcaaattgagtagaaaactcatgcagaaactgtaaatctggaatagggaagccatttaaggtaaaagagaaatcgtcacaagtatgcttagaatttcctgatttagaaatagtgggacaaaatacaatcctacctatcaagcttttcagataataacattgtgcctaggcctgaaagtacatgcatgacatttgtttgaaaggattgtgattgccttgtaaacttcttttacaaatttattaacacgggttgttccgtatagttggccaacattgcttatttcttccactgccctacaacaaccataaactcccaattattctgggagtagtttatcagagtacagattatctggaggtgttatttctctttcatttggcctttcacagctcattagtacctcaacaagaaagttaaggcaaaggatggaaaggctgcagaatttctaaacaaataaatttgctccttgtcagcagcatatacagaacagcatttagagatatcacacaaaataactaaaatgggataaacaaagatatttaatgtatactgtggcaattttccttgagtgatttttccctctgtactgtcaaaaatattgactgaattgactgtaggttttggcatccaacagacctcaaagtcctttgtttttagcatgtaattgaccatctttagcgatatcacctgccattgagtaatgcattacatttgttgccaatatattgactatttttcaatgtgaagacaaaaactgaaaaccaaatttgcaaaggaagattgatgataatcttgagtggagtctactagaaagcttgtttgattttaggcttgccaatgcattcgatgccatcagcacagggatatctatccttgccttgaggagaaataagggaatcagaaaattaaggctcttttagtatctactcattagaggtgatatatccttaatcatgaaaataataatgtgttatatccattattattttgctttttaataagaatgtaagatatccataatcaattggtaaacttatctttgtctagcctatctactggcaattgaacaaataataaaaaaacttcaaatagataattttttacaaaattattttaattacagacttgccaggtagaagagcaactaacaaaagagcctttatacattcaatacatcataacttcatttattttatagagaagagcttgaaaatcatatggaattctggctctgtcacttagtacaaatagtgttgctttaacaaatatttattaagcaactacaaaggaccaggcactattttaggcaatgatgatatagccatatacaaaacagacagaaatctaagttctcattcagtgaatcatgtcactgaaggcatgctaatcaagagaaataagtaaaatagaaggatgtaagtgttatggagaaaaggaagcaaggaaggggaattgaaagtactagggaaaatatcattgagaaaaagatttaaagatatgagagagtaagtcatgtgagtatgtggaggaaatgtgttccaggtagaggcatctatgactgcggtggaatgagagacggtaacaacggtggaaaaggaagccagagaagaaacatagagaaaggaggaggtgattgtgcatgggcttataaaacagcaggactgcattttactgaatgtctggcaaggcatgggaaggttttcagcagaagagtgatgtgatttgccttacgttttaacaagaccatctggcagacaaaatggattacaggtaaggcaaggccaaagcaggcaggcttgtttaaaaggctatttcactaatttagaccagaggtgatggtggtggccatgtaagtagtcagaagtgatcagattctggatatatacctggttaaggtggacctggcataggtttttttttttttttttttttgagatggagtctcgctctgtcacccaggctggagtgcagtagcgcgatatccgctcactacaagctccgcctcccgggttcacgccattctcctgcctcagcctcccgagtagctgggactacaggcacctgccaccacggccggcaaattttttgtatttttagtagagacggggtttcaccgtgttagccaggatggtctcgatctcctgacctcgtgatccgcccgcctcggcctctcaaagtgctgggattacaggcgtgagccaccgcatccggccaaacctggcatagttttctaatcaacaacatcaggtgtgagaaagaacaagactaagtttgactcaaagatgttcatttggggcaactggaaggctatagtgaaaccttactgacacaggaaaaactattgacgaagcagatgtgggtgttagtaaatttagttttacatagggtaaatttgaattgactaggaatgtataaaaagttgtgtatctaagtttggagtttggcagaaagctctgagctgggggtaaacattgggaggcatcaacttacagacagtatttgatgccaggaggctagataagatcatcgagaaaatgaatgtggtctaagaaccaacccctggttactgtcatatcaggaatttgtgttgatggggaagaaccagcaaattaaaatcaaagcagatgctagaaaaacaggaagaaaacctggaatgtgtggtgccttagaaatcaaagaggggaaagtaaatgcatgtctcaaatcctcctacatttacttaagttacttaatttaggtagtacatataaggaatctcacattgtggctagcatactgtaaaaacttaataaatgtttgttgaacaaattatgtgtcatttcataacccaaccaacatatatcaggatactggttgtgatatatgcagaatacatttggcaattgagtgttaccaatatattatcaaacatgctagagaagtgtagtgtaccgagaattaagaatatgggctgtggaatcaaaatatctagactcaaattcttttctgtaccactgaaccttagtgttctcgtctgaaaatgggaataacaagaatataaactcctaatgttggtaagctaagttaaacatgttaataatatacatacagcatggaagaacctggtcttcagtaaatcctcaacaaattttgttattgtgccaattaaggcacacttaagaagcaatgtcttatgtattcaattaatactaaaatgagcacatattgtggattcatgtatcaactatgtattaatcactcacttagatcacaatggatataaagaataaaagagctgccctcaaggaaatcatagtccagtggaggaaacctacaagtaagcaaaaaatatatgtgctctcataagaacacgtccaagaagaaatggaagcattgaaaagggaagcgaaatatgaactgagaagtaggaatttttacacactactaagaccttgtcaagttagtgtcttcccttatggcgccatgtctaatacactcagcgttgtttcatcaacgtgttttcccggtaatcttttgggggaattgacagtcaaaccatgaacattggtactacatttatatttatgaaagatcattctggatgcagtgtggagaatgatctatggaagatgagggcagcaagaccagttagatatccagtgaatgacagtatgtaatagtcagaacctgactgctgccataagaactcaagaactgttgaaaaaatgaattgatgagatatatactgaggacttcaacaaaacagaagtagggaaagagggggagatgacagacttctgacatatatgatcttagagtgtattggacgtgggcactataaatatgacaaggacagtacagttgttgagaatgattcctaggtgtctttttttattattatacttcaagttctgggatacatgtgcagaacgtgcaggtttgttacataaatatacatgtgctatagtggtttgctgcacccatcaacccgtcatccaggttttaagccctgcatgcattaggtatttatcctaatgctctccctacccttgccctccactcccagacaggcgatggtgtgtgatgttcccctccctgtgtccatgtgttctcattgttcaactcccacttatgagtgagaacatgcggtatttggttttctgttcctgggttagtttgcttagaatgatggtttccagctccatccatgtccctgcaaaggacaagaactcattctattttatggtcgcatagtattccatgtatatgtgccacattttctttatccagtctatcattgatgggaatggtcaggagttcgagaccagcatggccaacatggtgaaaccctgtctctactaaaataacaaaaattagccaggcgtggtggtgggtgcctgtagtcccatctacttgggaggctgaggaagtagaatcgttgaacctgggaggcaggggtgcagtgagctgaaattgggtcaatgaactctaacctgggcaacagagcaataatctgtctccaaaaaaaaaaaaacagcaagcaaagacaaagcaaggttttgtgaggcaaggaattcaaaaccaccatatgacccaagaatccctccttctgggcatatacacaaaggaaaaaataacacaaccttgtaaagatatccgggcttctatgctcattgaagcattgttcacagtagccaagatatggaaacaacgtttaagtatccatggataaatgattaaagacattatggcatatatgcaattgaatattattcagtccttaaaaaaagaatgaaatcttgccatttgctacaacatggatgagcctagaatacattacactaagaatttaaaccttggatgacatcaatgagctctagaactcctcatgcgtagaaatcaccctacatttgactttcagtttatttaacaggtaacaacttctggttattactggcccggaagacgtttgtagtaaacagaagagacaactgtctctgtcctcatggaactcacacttttgtgtgattatacaagcaataaataaataaattatattgaacaaaaaaaagtttgttccaaattatatttgcagccactttatgaataaattgttgagcttagtgctgtgtgacacgataaattggaggattaagaaatgcattaagcaacaccaacaagggagtacaaatattatatttaaccatcatatttcattggaccttaagtgccattcttctagttttatggaggaaatgtattaggacatgataatcatctaatactgcactaaatattgtagtttactgttactgaaagcataagatggaaatcctaggggtcaacattatgtgacagaaaagatcacatgtataatatttgtcttttctacattttgtctatttgacactgggtcggctacaccttcgcttaaaagttctcaccattctctgcttttgtgttttttttttttttttttccagttttctactcaagtcagataatggtaaatctaattgcatcttgatgagctacttaaaaatacccttaaggctgggcactgtggctcatgcctgtaatcccagcactttgggaggccgaggcgggcggatcacctaaggtcaggagttcaagaccagcctggccaacatagcaaaaccttgtcactatttaaaaaaaaaaaaatacaaaaattagtcgggcatggtggcaggtgcctgtaatcccagctactagtgaggctaaggcagaagaatcgcttgagcccaggaggcggaggttgcagtgagccgagattgtgccactgcatgccagcctggcgacagagggagactccatctcgggaaaaaaaaaaaagtacacttaaatgacatacatttcatctcagagcctaagtataatttgaagcatttcaaattgctggcccatttgcttatcaaatcttgttatatttttgaatcacatttcattgttaaacaccctcagtgtatacactcatatgtccctatgcctatcaactttgtggactgagacaagaatattttttttacctcaagtgtaagaatgtaatcactatcaaaactcagactatttactgatgtttttctaaatggaatagtctgttgcattattcagtcatgagaaatcatgtttttgacagggcttgtttctcaagttggcttaaaaggttccttcgcatctctgcattattcacacattgctgtagaaggtgctaaaaacttggcatcaggagacagagtcctactgatcagcaggttatcatatgaatagtggaattccagcagcaagtgttttaaaacaaaatgccgcctgatacttattttatcatgttttataaaatcaaatcatgttaaactgttccagtgatgtcatggtctctgctctcttccctatgccatcttgctctctgataaaacttgaacttgaaagattttttttttttaatgaagggaggaaaatacagagactacggcattgaagagaattaagtaggaatcaatactaataataatcacttactaaaaatgggagtatgttagttaaatactaatgggattaaaacttcttatcgaagctgtatgctgaatgttcattacatttttctggacatttttgtcctgaaaaatcaacatttataggttgataccacatattttatatagcacattgtatgttatacacaggaatttacggtgtactgtagattcctaccacagagtgtatcatcaaaattaggagtttatcagaactcttaattctctcccaatctgaaatattaacatcattcttctatgaactatcccatctcctccttactttcatcactgaacctcagaattgattaaactttcctccttccagtttcccataatcagccgtaattctatgtattatttcttgttttccacacttatacttaaaaatccctctcacagcacacaagtatacttctaaaacagtagatccagttgcccttcccctacctgcatcctcctcaattcatttgcagcactgtttaacataactaccttctttaaagtctttttaaatatctgttatgtgatggtactttcctaaggaaactcttaaatcgtacctaactatgtctcccacctctagttccctacagatagatagatcgatcaacaaaacaatcaatcaaatattctgtccttgaacctcttcaaatttgattgtactttttttctctgtgaaatttcatgtactttttgggattactctgttatctctctccaccctagcccctgcaatgcgattctatcactggtcttaactgatctgttgataataaaccctgatttccaaatacagttagcttattctggaggcaaccttgacactttcaactcagcatggccctttttggttttttttggcaatccttcctaaaggcaaagtgcctctccattcagcttcataagtcccagggttgaaacacatgacttgttattcaaaacctgccaatgcccttctcttgcctactgaataaaatgtatctccttgagcatgatatgcaaaatcctccacaatgtgtccttcaacctcattttccagccgcctctcctactcctcctcccctaaccatatgccctacacacgaaacgaacagtcacaaaatgaactgacgattcgtgcttctttctcatttagctccacaaagtgaagtaatatttctatgggatgatctccttataaaaatcatacttgactatcaaggctcatcattcagttataccttctgctacctgctaagccaagatttatgaagctataatttatggtcccagaggatttatatgaaaagttattatacttcctatctctactgtgtcttaaagcagctgtaagagtgtctgtctcctctctagtgcataaagaacctgaggacaagtcaagtaacacccagtaattaacacaaattagatgatcagtaagtacttgacagattaaattactagtgtttgaccttcacatatgacactattatgtatattttaaaagtatcactgttgattagaaataaattttaacacaaaggccagaagacataacttagaaatcataggtttaggaattcaagatgcctaggtctattttactctgcctcttactagcacaaggacccttcagtaagtcttaatcttaatctgtatagtgggaagcttgattggtggtaaacctcataaatattgccattcaagtaactgccacatgctcctgccatattgtaagtgtacaatgaatgctacctaaattatcataaaacagtcaacagtgataacatgtatatgtgacgatttttgcaaaccttgttctatttggaattttaagaaagtaagcaacatgaaaccactggttgagaagatgtaattatttgtaaacaaagacctttatttttagtaaagattcatcagtgcaacctgtcagaattttctacttcaaatgatttaaaaataaatgattcaaaagtacagtttttttcctgctatggcagtagtgaacactgtactaatttgaacagattctgtgaatgccaaaagcattgtaatgttgacaaatgtgtacttctaaacagtgaggatgtgtgtgtgtgtgtgagtgggagaataatatacatataaagtacattccccagggtttgcttaggttttgatgacctaacccaaagcatcgcaaagatccaccaatatagatgacagtttatgttggaacacaatttaagaatatatactcagctacaagtgggtcggtacaaattgttaatatctcaatgtcaatactactcatgagtaaattaccaccaagataattatacatatatctctcaccttggatctttcagaaatttggcctaggtacttatataatgttctgaataatgtatctctctccattatttagtaaattatgtcagattcataaacatttctcaattaccagacatcaaactgttttcaacaaacttcttattccaattaactataacttcgatttttaaatttatgtacatacacacacacactctgagaaaaagagacagagttcaccaggttcccatttatcttcaaaattgaccctatataaatgttattttaaaacaaaagataaaaccataatcaggatactattattattaacaaatcagattacttggctatttctgcatatattttactctctgataaaaatattataatcattttctgccaaatataatctgcacctctgctaattactcattttccattaaaatgtaaaagtcaataaaacttatttagaaaaatggaaaatcatacatcaggttgacctgggaggctcccctattcttgtcctttacaaagtaatctaaccagataaagagcttcattttattcagcttattaaaccctatggtttgtttctgtaaattctatagtacacatttaagaccagtcatctgtgagaagaaaatgtaataccaccaaatttaaataacaatccaaactatgaaagtagatgcatatactttttatatgcttatgctttatataagctgtatagtatgtaactaactcaagtgggctcatccatcattggtttattgtttctctgaaaaaacacccctcaaggtctttatatgataaaatgaaaaatgacagaaaagaaaaatatgatgatattggaaataagcacattctgaaagccaatttgtcattgttttatgacatatatttatcttcatgtatatgagaacacctagcatagtcctttgcttctaacaggtactcaataaacttttgctaaattttgaatatattagttgtgggacaggtcctaaagtattgctctagaaatatttgattcatcagtaatagcctaacctatgctaaagatgactttgattgatagagggcagtccctttgaaagaaatccaactgaaatgtacagaacataaaaaaaatgcagtggatataaaacacagcattttccaagaaaaaatagagcatattttctggatccaataaaattagacacacacacactttcaaatacacttgcaattcatgatatattttattctattaaggatttatattattaaatcatgggaaaacactgaactctttcaaatactaccataaaataatttccaaactatattccatccttatgaaggaatcttgtggcttgggagcaattaatcacctccccaatcccatgcataagtcctgattgctttaaataaatcctttttgccagggacatagaacaaaaatccaactacaacattttatgctttaacacagtatattaactgtggaaacatgacttaacatgttccaaccagaaggtgtccagagttctgcttgactgagaaaaaaagtacttatttttcctttgacataagcaaagaaaaaaatgttacagttctggcagccatctatcataacaaaactgtatagggaaagaaataactacctggcatagataacggaagagtgaagagccaaaagagccactgagatacggagctgcagtgtgatgacaatgtgaatatttggattaaaggcttaccagaatcctgccattcctttggaattttctgttacataagccaataattcccaaggtttaattacaagaaatctttaatggaagaaaagatgtcacatgttactgctccaatgtggatgttttctgtatgtgtgtgtatgtgtatgtgtgtgcatgtgcgtgtgtgtgtctgcatatttcaagttttcttgagaagagttttccattattgtaccaaacatcattctagtttatatggactttggtatcaggaagtgggttgttgaaagttaatagatcctataatgtggaacaggctgaattatgagaagacaaggatgataaacctcccccaccccaactcaaaatgatacttggtacatgattaaaaaacagttgattaaacaatggtctattttatcctaagtcatgtgccttacgagtaccaacactattaggagatttgatagaaacaaaaatgttgccacctactggcctctttaaaccaagaaagaaaaaacctcatgctaatggttacttgtttttgaagtacagaaaaaaaagaaaatatagctttgtctgaagaagccctctctgcctgtggcttataacgtgaacgccttgagaggctgataatttggagcctgatatgagtggaaaagccaatttgtatttttactccaaatcgaatgtttgtatgaacagagacaggagaggcagaatgtaagacttaagtactaaaaaaaatcaactatagtgcttccctaaagcacttttgtgacaaagtagacgatccctcctatcatgaagaagcagcttctatgtaatctatacttcaaagatatactcaaagattggctatgccctctaccccaaccctgtgctgcaaattttctcagtcaggggattgtgcaaagcacagaggcctcttaaagatgtcaaaagaggttaacatttgaagcctaaaaccaaatcatagaatttgggttactgggtcatggaattgataagaacaaatactgaaagcctataaatagtaaacaaatctgattgccaaagaaaccccaggtctaactaaaaacaccttgttatcactcaaacctagggcaagcaccaggacttttaaacaacacaataagtagaataataaagtaacacaaaaccccaaaatatgtcaacttcagatatcatgatgaagacaagtatttagcaaaatttataatgaacagaaggaaaaatcaccaggaaggctctgaaagtgcaggatataatatctgtttcaatttggtttcttttataaatttagtttagttttaatcaggatgtgcccttctaactttttacttagcagtactggacatcaaattttttcacttagtcatagtccactggatggatcataaagactaattgaaagggactgctaatcacccagatatcccaaccttggagctgaatgcaatcactggataatgttttatacttgctctttttgaggagtctgagcatctttgaaagtgaatatatgctatgaagggtgtatagcaatgttggatattcaaagaggaggactgtagtaagcactgcaattatacagtcaatatcctttcttctactctctgatggcacagtagcctggtgatttggaaagcattgttattactctcagttctagatatgcgctcggtttttgtgcaagccaagtgggatactgctatgtactttgcttcagggaggtgttcaggccaggcatatgatctaagagtttccaagcagagagaaactcagaccttttgtttcctatttgggtaaagatatattctttacatttagctgtaaacaagggaaaagagtttccaagatctgctgagggaagccggtctgtatgagttcgaaaagttatggagggtaggcttagattaacagagaagcaaagacttctccttaaatccataataaaactctgtattaaacccttgagcaaaccttgaactctttacttagccaacaaattctctttgtatcttgagtacatttgaaaccaagcatcctaaataatacaggatataatagactttaatgttcttcatcaacttaataaatccttaaataatcaacaatcattctaatatgtacttatatcatcttcagtgccgaatgttctgatttcaaattcaatgttcaattgctcagttcaccaaatctagttaattgctgttagtcaaaaagcattctcattaatgacactgatgctattatcaataaaatggagtcattttgaattggtttgcttattcatcaaatggaatttttagaaaggatgtattatcttactacaactaggatgccaaatgggaatttaatgcaccattttttcacaggcttgctataaatcagaatctttaaaacatttctctccaattctctctcttccactcctgaaagagatggtaatatcatctgaatctctttcaaggaaaaaagattaatgaagtcatctgttgatagatttcacagcaattattcttcctcattaccagttcccaaacttcacctttcattttataaagtaacctttattttaaacctgcctgtattttaccttcttattttctggttgcctgatttataatttgtcattatattgcttatatattcatccacttttagtaaatcatgaagtgtgtgcataagtgtgtttatgaaaacccaacctttcctctaatgatagcttcataaagctctatgttgtgtcattttagcatacaggttaatagaatcaattctggaatgagattgtgtgtgtgttcaaatcctggcacagctgcttttcatgtgcataactgtgcacagatttcttaaccagcttatcaattttctcaagtgtaaaatggatatattaacagaatcttctcaatagggttgttataaacattgaattaatgtatgaaaagtgtttacagcaatgtttgttatataatgattgtccaatatcagttagtaatttttgtgacattattcatcatcacagacattatctaagagtaactggttcattatctaagatcaacactcaggaaggagcttaggctaataaaatgattcagagcccagaaattggaaaacttgggttgagtgacatacctatcagtttctaaccatactactttggtcaactcattcaagatatataaggttgtttttagttgacagagttaaaaatttcatcttttatctcacaagtaagctcactggggcataaataatacaaagcacgtaaaagggatatgaacattttataaggtgtgaagaatccctcttatacataagagcataacacattcttcagttgaagcaatagagccctttcactacctgttctgggaatggctcaacttatgtagcacttgctcttgtctttccacgaacacaaagtttgcagctgaaacatgaaacctctttcctgcttcccaatctaccagattttcaacatggataatataacataaaggacttatctgtctgtaccatagaaataagtagtattttgcctggctttccaagtcctcagagtctcaccataccctatttttctcagaatttcattgccattttggggcaatgaattcttttgagaatatgattgaaattctggatcctttacactatgtgtacacaaaaatgtttggagattgtgttagcgggattgtggacgctattatgcacatttaacaaactcttagggttttataaactgtgatgattgttataccattttatttatctgcaccggcttatcattacaagctcagttaacattctccatccttcagtaattagtaatgttagcccgtgtctttaaaaaacaaaacaaacacatatgtattgaggtatgatgtcctctgattatatatcttaatgtagtattttattttatagtgtactatttaccagttctgccagtgttaatcattgtccgtaattagaatattatttcctatcttcagttttctctattaaattgtgatttttgaagaccatgtcactattttcctgattttcatttattgaaattgaaaaatatatgtaagagtttttcatttattgacatttaaaaatatatgtaaaagagttttacatttttaaattacatgttttatttatttttgcatgttttaaaatatgtaatttcactgacaaatgaaaattcagagaaatgaaactcctataaaattaattgaaaagagtctagtgtaaaatattctgaatataacctttgttctaagtacatatatagatgtataaccacacaaataatttattttttcaaaaccagtcacaatgttgtcttagctacattttcagttatttaatgtattgtaaaaatatgccatgcaattaaactcttttatatcttaactttgtagtggcttcatggtattatatcatttggagatataatttatttaaagaaactaacagtatattcacatgtgcatatttccactgaacacacattaatttcattaacaaaaagaaatacaagaccaaagaagttgacctctaaactatcttcctatacttctaatgtgaacactattcaatcatctcataatttaaattaaaatgaaataaactacataggcactggaattttgtttctttctacctcttaaaatttggaatgctcccttaaaattaatagattccaataacttacaagaaaatacccacctttacacaaagttactataaaaatccttcatgtgtgattaaaaaataatatttacatgtttactttgtgatcagatttatacttagcagctcaatttttagaataatgatatgaggaaataactattatgaagccattttatcaaaaaaagagcaaaatatcaggatctcaaagagctattagcactccagtgctcattatagcacgattaaaaatagtcacgatgtgggaacaacgtaaatgcccgatagctgaatggataaagaagatgtggtaaatacatacaatggaattttattcagtctttaaaaagaaggaaaacttgcaatatgtgacaagttggatgaaccttgaaggtatattgtaaatgaaaaaagctagacacagaaatacaaatacttcatgattctactcacaccaggtatctaaaattgccaaactcagagaatcagagattagagtggtggcttttagaggctgaaaggaggagaaaatggggaaatgctaattaatgggcataaaattttcatcatgcaagatgaataaattctaaagatctgctacacaacgttgtctctaataatactgtattgtacacttaaaatggttatttgataaatctgttgagtgtccttacagaagaaaagaacagttttaacaaatgttttatgtatcacaaagcagatgatgatgccctatggtgtttcttgctaacaattttcaacacattttttatgtaaggtgaaatgtcaactaaaatatccaaatagacaaaagtgagcacaatgtgcagtaatataccttaagtcacacatttagtaagtagcagaaccagaattacagataaaagtcagactgattagcaactgtgtttgcgtgtccgtgtgtgtgtgtgtgtgtgtgttgtgttgtgtatgtgtgtatgggtgggtgcctacatgcttagtatattttaatctcctaaaatcaaagggcaactgtccaggccaatatgagtacattctacgaaacaagaataaacactaacatgtgatcccttctctactcctccctcattctctcacagtcagagttatattatctttccctgccccatgaccaaaaaagaatctgtgcttttcacattctgtcctttgtgaagagaaaatttgactggtcaacataaacttacgcacgttgtcactcctgtgaataattctaataaataaatgactaggaactttgactccctccttacaactttggcaataaaacagatttttaaacatataatttgcataagttaatcatgtaaatataaaaatttaaacataaaacaaatgtactgaaagaaaaaacaactattatgaggtcatgtataacaataaaatcaccactgataaacctaacacactaaaaagtaagataagtctcaaagtcactggaaaaaaatatgtaatgaaaaatttaaagttataaatcttacaaaaatataggacagtgcctaattatctgagtgattaatattgctaggtatgctaggggagatcagccaatgcttagtccagtgttatagttgagccttttgtatttctacagttatatgttttgcttcatgatatggtataattggagttattccacaggggaagttaatagaaggaaagaataaagatcagaacaaaagtaaataaaatagaaactagaaaaacaatagaaaatagtaacaacgaggttttggtttttttttttgtgaaaagatagactggcttgttcttgacatttactgattccacaatatgcaattcagatttagtaaagaacatttactgaatggaaattgtcacccaactctttctggttttttgtccttgttaagtgaatgaacaaaattggcgaaaaattttatgtccgaaagttcttaaagtctaggggaaacatttcttatgaactaaatgtaattcaaaaacatttaacagaaggaatcttaatgtcaggcagtgagaaaaaatagaaagtcaaagatctctaaagatgggggtgatgaaaaagaaaaggaactgccttttatgaaaatggaaatactattttgtttactggggggtagatttaggtaaataataaaatagaagttttaattggcaaagcgaaaaacacttaaaacatgctgaaaaagaccacgtcaatcaattttactcactttaaacatgtttttttcattcccttttcacagtatactgagactgaaactgacacaagaaacgttcactaaattgttgatgttcgtttcgctctaatatttgtacttttttttttttttttttttttttttttttgagacggagtcttactctgtcacccaggctggagtgcagtggcgcgatctcggctcactgcaacctccgcctctggggttcaagcgattctcctgcctcagcctctgagtagctgggaatacaggcatgtgccaccacacctggctgatttttgtatttttacttgagacggggcttcaccatgttggtcaggctggtctcgaactcctgaactcatgatccgcctgcttcggcctcccagagtgctgggattacaggcatgagccaccgtgcctggcctaaatttttgtactcttaaaaaactaagctatcatattgattatgaccatgacacatatgaccatgaaaatatttttctaatatttaacgtaacgtttagaaacatcactaagaacttcaaatacaatcaaaatactgactttgaatattgtttttttcaaaggcctgacgtttttgtccaacacaaataagactgtcttcacaactggtcctcaggcactgagtagagtaagtttctccaagccaaaggctgtctataaatcttaatctacttttgtacactactaaaatttcctctcatggaatggtgaaaaatctccaataattcttatgctttaatttattgagaaaaacaattatttcattcaaaattaggtattacatctcaaattatgaatgcccaatatttgttaaaagactcatatatttaatattacttcaaaaattagtgaaaactttatataagccaatattttcaaaatgtacttaaaaatagaaatttcattttgagcctcaacattgtttgctgtctctctccccccatcaactctccttccacccaccccaacctttctccccagcacacacacacagaaacacatacacacacacacacagtcaaagttgttttgaacagaaaaccctcaggctacgccccttatatttgagacgggagtgggggtaacagtccacagctgctcatctacttctggtaccttctctagccttatttatttcctagttacatattttacatcacttttcactgatttcttctccatacattttctacctttgaccagtaagtgatagttttcctctttatctaatctttttgctattaggcgataaagaatcttagagcagcaaagattccaaaatatctgtttcgtccatctcttaagcatagggttatttccatggctttagtaataccatttattgaaatcatgtcccacctaaagtattttcattcttttcttatctaagcctcgtaaaaagctctgttcaagatgaacttactctatggaaatcttcctgagtacgagtcgatggaccattgtaggatgcataaactgccgattcttggatcccattcatcacgctagtaataagccttatatatccatatttgtacgatctctccaatcactgaaattagtttggaaaaatcaaacatgtgtttgaaatacaaggtagcatatcccaccttgtattactcattcttttatacgtaactcttctattacgatgaggttgatgggattaataattcatagtaagagaaggaagatgacgtaaaactgtgctgcagcagggtttatattgcaggacctgcttcaaaaccctgaacaatatattagattcacgggcagctgctcccttaagtattgctgttcactcaactcttagaatatacaatacaatcgcaaactggggcatataaaagaaacgtgatgctttcattcatttgatcaatatgctttatgtacctagtatatattctagtccttttcctcttggagtttttactcattagggaaaaacgacctgcaaatatcgtaatgtcagtagtgataactacaatgaggaaaaaaattaaagctttgaaagaagacagaacaatggtagtggcatatcaaatagggtagtcagaaaagatctctttgcagtctaaggtaaaggaagtgcgccatatgaataactgggggaaaaacccttccaggaagagggagatacatgtgtaaagtcactgaactcaaagtatgcttggcgtatttgatgccaagctagtaggccagtgtatctggagctgagaaatggggttaagggtaggaaagaaggtaggatacctatagggaacaaatcacgatggtgttttggattttcttccgagtgtaaagtgaaattatttcaggatttagaactactctcaacatcttctctacttactcagtttgtaaattccttaagggcaataatatggccatatatgttccccatgcttggttcactgtctctcattccataatagttaccactattccacaagacccatcgattagaattatggatttaaggcttgcaaaggagaagaaagctcatcttagacagctatatggttccagtacatagtaagtgaacatattaataagccatgtgtcccgtgaccgactgccttttacaaccagtctcattaggtagtctatacttaaacactactctgacagagggctcactatcccccaaagccttttattgcattttgagacatttctattagcgagtattcaaatatcacatatttgaccccatgaattttagcaagttaacttagtttatgatttcaattttggaatttaattttttatgcttgaagagttcatatcaaaaaaaacaaattttgagagcatggccatgtttttatttcatagttcattttgtccttagatgtttctgacaacataaatttagcagtgtagcagttattaacaccattcatatttatttccagctttctacctttgagacatgtaatacgaatatatttcttagttctaagttgggtgagaccatgtaactagttgtgctcgtgagttgtgaactgaagcagatatgtcacttccagttcaagcaattaattgccagcacaagacctttcagaattttctttccctttgcggagtgactgggagtatcctagatagtagctgtttcatcaggctgggtttccaaatgaccacaatgaatagcgttcccttgctgattcacagtgcacattggaatgaaaaagttattataacatagtgaaatttaataaccagatctagaatgactggtttagatggcacttaataaacattaagtgactagtaacacattctaacagcagtctttaacctgcatattgtgatacattagtaaatctccaaaccacaattgggttatcatggtaaagagctttatggtagtttctaggacatactaattactcaataattttctattgaaagaaggagtggcgattcctcagggatctagaactagaaataccacttgacccagccatcacattactgggtatatacccaaaggattataaatcatgctgctataaagatacatgtacacgtatgcttattgtggcactactcacaatagcaaagacttggaatcaacccaaatgtccaacaatgatagactggattaagaaaatgtgccacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaatcgaacaatgagaacacatggacacaggaaggggaacatcacacactgggtcccgtagtggggtggggggagggggaagggatagcattaggagatatacctaatgttaaatgatgagttaatgggtgcagcacaccaacatggcacatgtatacatatgtaactaacctgcacattgtgcacatgtaccctaaaagtataataaaaaaaaaaagaaagaaagaaggagtgaatgtaaccattcacctaacaagaagtttttgagacatattgcctcaatatttcaagggccactgagtaataatgacttatttgtttaaaaattaagacggtaaaaatagtaagttgttaaatttccaatgaaaaaaattgcaccatagaagcaaaagtgaaatgttatagcacatacaaaacacacacacacacacatacatacacacacacacacacacacacacacacacacacacagtgtgtatacataatggatttagagttctagttatgaggatgagactagggaaataggcacagagataaagtgctgttagagacaacccatatgtataacttcgaatagaacatactccctatgtaagtgtttagtattattggtagatatgtgtattgctgtatgtatatacccacacacacacatatatatgcacacgtaacacacagatatatactctatttgaaaactttgcttataatctaaccatgtatcagtgctatctttacagcatggtattaagtatataactatagcatgaattttaaagatttcatgatattgcattaaaaatatttaccctaagttttattaatcctatggtgatcactattcaagtgtttattaaactttccctctttgaaaacctgttttaactatgtcttacatcatttcatttaccagattattactcctaaatttaaattttgtgattaaaaaattatgcaccagaaggacagcatcaatttattctgtcataagccctcttacaacttttgatgtttcctgtttctttatgttctgcaaaattatcagtattatcactgtttcaatctgcctatctggtagttaaaaataatttgattgtttatattatatttttttattaagtagatggtatgtctttttacatacttaatgatatatgggctttttcgcttttgtcattttctggctcatgttctttatgaattttcctattggggcattctagttttacttattgatttatcagcattatttatatatgagggctatcaatccttcgtatgttataaatgttactaataattttcccaactttatatttgacttctaactttccttagagtctttcttaaaagcatcataaccaatacatgatgcaagaattgccatactaaattcctttattgactccataaataattaactataatcatgctctatgaagcaatagaaatgttaagatttttaagagcttataaaaactttatttcacatttattcctggcttctaggatcaagtggccaataagcaattattaaattaatggtaatactacagtgcttccggcatacttgttcctgaactatttgaggtaccaaatagttaaaatgactttaatcacctagctcacctgaaatttaaattataaagtagaagtagaagaatccacgggctaatcttatttctcattccattaatgatctaaatttcttcttgaaatgactttttcaggtattataaagtaaatttgaatgtttcagaaagaggactacatatcttaggaagcagataattgccactggatttagcaatctgacacacaatatagaaatttctaattaaagttctatttttataatgctaatctttcagccaaaaatttccttgggacatgttataatgaagataaaatgtactaagattttaaattgaccagagttcccagagacacctaataaacattttcataaatattcactataagtaagttttattgtgaagtaatcccattgttatacatacctctcatcattggcatcattacactttaaataagttacctaatagaagtaagtatttaaaatgctaagcttgaaaatctggatttgctacacataaaagaggaacatgactttatgtagctgaattggtatgcagatgatctagaaatgaggagtttcataacgataccatcaactcatcattaatccttccaaagatagtttatttccccaaagatttaattgatagcattctcataatttaaaaaatgactgtatttctattaaactttataatgaacaaaatatgtgaccgttaattatgtgttgattttaaagtcactctaattattactaaataaggtatctcttcaaaagaattaatatttttctttacattgacatgcttaagggggtaaactcttagtgaaaacaaaaaagtttgctagtagatttgagacccacatggatttaacacatgtatgacataataggaggctctgtgttaatctacaagtttggtaacaagtttatgttgattaaccaagcattattacattttttcactgatattatttgtagataaagaccacaatatgcaaggatatgtgctgccagaattctatagcagggattaaaattaggcatgggtatccactaattatacattttaaggaatatatctgtatggccgggcacaatggctcacatctgtaatcacagaactttggatggccaaggcggctggatcacctgaggtcaagagttcgagaccagcctggccaaaatggggaaacctcgtctctactgaaaaatacaaaaattagctgggtgtggtggcaggcacctgtaataccagctactcaggaggctgaggcaggagagttgcttgaacccaggaggcagaggttgcattgagccaagatcgtgccagtgcacttcagccggggcaacagagcaaaaactccatctcaaaaaaaaaaaaaaaaaaaaaaagaaaagaaaagaaaagaaagaaatgtatctaagttttcattttcaatcatggttgtcatgtatcttaattatgatgttacaacactttgaatatagtttcattaaaatataaggttaataatttaaagagaaaagattaaaaatattaaaatattttctgaaaacaaaatagattgtaataaaattaatgcaaaaaagaaaatcaaattacttaatgaatgtagaaactagagatcgccctacagaaaatgtgacagtgtgatgaattagcttaaaataattataatccttaagaagacatcatgtttaacaaaattcaggatatcaggatcctagaccaaatatttctgctctgtaatcttaggtacatgacttagcatatctcagcttgagtgtcttcacctgtaaaatgaaaggtgtagaggtttcagtgtctacttaatattcttggtattaaattacacatacaaattatttccaaatggatttgaaatttcatttgtgctagaaagcaattaagtggccatttcggctcctactctgtgacacttatgtgcaaggacattctcaaacttcttaatcaggagcctggatatttgaagatctgtacaagcttacctaaaacaagtacagtcatcagtaagtagagtgcactttattgaacacctgttaggcaccatgctagccacatttcccaactaacctggattcttcagaagaatcttgtaagttctgacagattgtatttttttaagatggatacaatatgtttcatcttacatgttattcttcggatgtaacactgatacttctccatcaagagttgggtttatgtttctgccccttgactaggatggacccctgactatggaagaagttatactatgtgacttccaagactaagtcacaaaaggcaatagagtttctgcttggtactctttgggtcacttactcttggaatccagccagcatttagtgagtgactgcagattaaataaggccacatatacatgttccagccaactgccctggctgaagttccagcagtagccaccaggcatgttagtgaagaagccttcaaaatgacttcagcttcatctactattttattacacctatatgagaagccctgaacccatctgagacccagaatcaaaagagataataagaaaaacgaatgttgtttttataagctcccaagttttgagttgatttgctatatggcaatagttactggtgaacaaggtaagcacacctgtattacacaggtgagctaagcattacacaggtatgccaagagataactgagtcacacaactaaggtcaatcagttgtaacacgaattcttacttccataaagacttgatttgtaaaagaaaaataataaaacataaaaataaaaaagtattaaaataaatgtttgaaaaagatattccttaagaggcccttcctaaagaaggcatactgcatctagcctacatgtggagatccaaacaaactattaatgattacaaataagccgccctgacctgcttaaacaccggaacacagattagctaaattccatccaataattcattcaaattctaggaaccgacaaatcccataaaatgtaataaacatgacttaaatgagagcattcaaatatccttggttcgcaaaaattgactctatttttgtaacatccacagcaatacctctggacctatctctggtatcaagagacaaaaaagtcattttctagaatggttggtaaaattatatatcatctcttccagaaactccaaatatctttaccaaatgtaaaaatggactttcattctacattttttgacttatatttttaagattacattatcatttataaatataatgcaaaatggaagagtgttgatccacgttgttgtaaatatttctttacccttaactacttattgaatgcctgttgtgtaagaaggtgaatggagtctttcccctctaacactctatgtgatagtggaggcttttctcacatacactatgcattaattattttagccaccccatggaaagttgaaagtatctttattttagagatgagaaaactgagtaatagagagaaaatagcatatgcaggtcccacagactagattcctattatactcctgttttcatcttaatatcttagctatggaatattccttaatgttcttcgaaaagtttaacaccattaaaattcttatttacatcaaaataaacatgaatagaataattcagaggacaaaacaggaaatgtatttgggacatggatgacagaaaatttcctattcttatttagaattatcacttatatgtcaagaagaaaaataacattcccacactattcaaagctttttttaagcatcaatttcctaacctattttgataggtaactccatttgtggagttacatctttgtaagatttttttgaagatcagaaataataaatgtaaattacatgctaggcatttaacatatttcctaaatgcagacacacctagtggaataaatgatgtattttggttatactatccttataaaattttcatacttaatgagggctttaccttaaataactttttgtttttaagttacttacactaaatcatttttttaaaaacctctaggtttttggactataacacaataacgctcctttaatcttcataaagagaccactatgaacaattttacaccaagaaactgtaatctaaaaacatggttaaattcctagaaacataaaacctaccaaatctgaactgtgtaaaaatggaaaagtctgaatagatcaatacaagtaagggattgagtaagtaatttttaaactctcaacaaagaaaagcaaaagacgaggtgacttcataagtgatttctatcaaacattttttaaagaaaattaatgccaatgcttcacgaactctttgaaaaaactgaagtggagggagcacttccaaattcactttataaggtcagcattaccaaagccagaaaaagacatcccaagaaaactgcaactcaatatccttgacagatatagaggcaaaattctcaacaaaattctggcaaattttaacaacacattaaaaggatcatataccatgaccaagtgagatttatccttgggatacaaggatggttcaacatgaaaatcaattagtatgatacaccacgttaacagaataaataagaagtcacatgttcatttcattagatgctgaaaacttgtttggcaaaattcaacacaatttcactatttaaaaaaaaccattaaactctcaacaaactaggaatagaaggaaattgcttcaatgtaaaagccatatataaaaagatcgcaggtcatatcacaacaactgcgaactgaaaggattttctatgaaatcaggaacaggaggaacaaggtaagtatgcccattcttgccacttctaccgatggcaatactggaagtccttgctagaataattaggcaaaaaaaaaaaagtaaaggtatataaatcagaaatgaagaatgttattcctatttgcagatgacataatcttatgaatagaaaaccctagaatccattaaaaacactagaaccaatttaaaaatcagtaaagttgtaggatacaaaatcatcatacaaaaattagttgagtttctaggagacaaattccattcacaagagcaccaaaaagaaaacagtaataaactaaagaggtcaaagagtatgtactgaaaactataaaacattgatgaaagaaattaaagatgacaaaatcaaatggaaagacatcctacattcatggatcgaaggacttaaaattgtcattacattcaaagaaatctacagaactaatataatctttatcaaaattccaatggcatttttcacagaaacagagaaaaactctgaaattcatatggaaccacaaagaatcccaaatggctaaatcaaccttgagaaagaagtacaaaattggaggtatcacacttcctgatttcaaaatatattactaaactacagtaattaaaaataaattgtattgtcatgaagacagacatatagaccaatagaacagaatagagcccagatataaatctacacatatagggttaactgatgttccacgatagagccaagcatacacaaggaggaaaggataatctcttcaacaaatggtgttggaaaaactggatatccacgtgcaaaataatgaaattggtgcttatcttatgccatatgcaaatatcaactccaaacggataaaatatgtaaatgtaaaacctcaatccataaaactcctagaagaaaacattggaaaaatcttgtgacattcatcctcgcaattatttccaaaagcacaagcaataaaagcaaaaaaaatagaattaagactacataaaactaaaaatcttctgtttagaaaagggaacaaatcaacactgtgaaaaggcaatctatggaatgggaaaatacaaaccatatatatatattatgagaattatttctaactcagagctattaggagggttaaataaaatgaattatataaagaatacttcatggtatagctacattctaagttatcaaaaagacagcaaccaatatcatgattactattttaaatacatcagggcttaggtaagattttgtgatcagacctgaagaccttatattatattaacaactggttatcttctaaaatatataaagaattcctacaactcattggcaaaaaaaaaaaaactaaaaacgcaattaaaaatgggctaaaggcttgaacagacatttctccaaagacgacacccaaatggtcaacaggtgtatgaaaatatgttcaacattatgaattatcagggaaatgtaaatgaaaagcagaatgagctatcacatttatacctgttggatgcctactattaaaaaatggattagtaaggatgtggaataattggaactattgtacaccgttggtgaagtaaaaaatggcatggctattatggaaaataatatagttgctcctcaaaaattaaaaacagaactcccacttgatctagcaatctcacttttggatatttatccaaaagaattgaaatcaggatcttgaagggatacctgcaatgccatgttcattgcaacaccattcacaagagccaagatgtggaaacatcctcagtgtccactgatggatgaggggataaagaaaatgtggtatatacatacaagagattactattaatattcaaaaagaaagagatcctgccacattaacaacatggatgaaccctaaggacattatgggaagtgaaataagacagtcacataaggacaaacactccatgattctacttataagaggtatgtaaaatactcaagctgatcaaatcagagagtgaaatagtagttgctagaggctgtggagaggaggaagtgggaagctgctaattaacgaaggttcagctatgaaagatgagaaaattctcaagatctgttgtacaacttgtacctatactgaacaatgctgtattttacacttaaaaatcagttaagagggtgaatcccatgttaagtgttcttacacacaataaagtaaatttcaaaagaagttaaacgataagagtgtaactgttgaaaataacatcatcacatatattcacttcaaggttccttccagttttaaaattctactcagaagtcttcagtgtaccaatttatagagttgagctaaaacctaacaattctgtttctgggtaatttgttcagtcacatcaggatgtataaaggcttcctcgaagcaaattagtgatacttttaatctaaggagtggtctccctggctggcttcccatcctctgtttgccaattactttctacaatatgtggacagtctgagggacaagttgtgccaggagggggcaaaggcagagatagagtgaaaaatctcctctgcctcatcccctcccaacacaggattgctggatgtaaaatcacccagaagtgctttttctgctttataaaaggcattactatgttctgctctgcatggttccaagattgttcctcagcaacctcagaacaaaaaaggatatccttttccttagaatcttttactcggtatattaacttgccgaactctatacaggttgtgagtttgtttataaatcagaatccaggctatctcttctcataaaagtgctaataaaaacataaaaattttctcagatcagaccacaaaatcttatctaacccctgatgtatctaaagtagtaatcatattggttgccgggttttgagaacttacaatgtgcttataccatgcaatgttctttataaaattaatctcatttaacactcctaataactatatgagttagaaacagtttcaataatacacatgaggaaactgaggcccagagttcaagaaattctctgaaggtcacatagcaagtaagtaataatgaaggctcttaaaagtagatgtaggggggcagaagagtataggtaagagtgatgtcatatgagaaagactcaatttgcccttgttagctttgaagttgaaagggggcaatgagccagtgaatgtggtcagcctctagaagctagaaaaggcatggaaatggattctcctctacagcctccaaaaggaaggcagccctgctgatatgttaatgttagctgaatgagacctgttttaaacatctgaactaaagaactgtaaaataatgaatatgtgttgattaggggcactaggtttgtagttgttgcatcaaaaatcgaactaatacatatagacacatgattagttatcaggatgggttaatttaaaagaagtatgtttttgtccctgtggccatcaactattcagggtagtgttttgagaccgagtcttgccctgtcacccaggctggagtgcagtggccgatctcagctcactgcaacctccacctcctggcttcaagcaatcctcatgcctcagcttcccaagtagctgggattacaggtgtgtgccaccacactcgcttaatttttgtgttttcagtagaaacagcattttgccatgttggccaggctggtctcaaactcctagcctcaagtgatctccccgcgtcatcctccaaaagaggcgggattacaggcatgagccactacacccagctcgcggtgtagtttgtttttttaagtgttacaatgagggtagccttcacttttactgtcgtttgaacctactctaatcagcaacacctccaaatacacacacatgcacacaccactgaaattgttcttattaaaggggatataaactagagagagcatgtaactttatcggtcaaaatgggaaagttttaagagtgaataggagtgttagtaattccactgtagtaactgctatatattaggatttcccagacatcgtaccctactgttttcctaaattcactgaataattttcaatcatcatgttatttgaactcatcagcaatatttaatgtagttaggtatcttcctttctctgaaaacactttcttctggattccagaatgccacatctatcttctcctttttctctcccctttctagccacctttttcagcccctttgctgatgcctcatcatatatacatctagagatctcatctgtctacacatttttccttggcaatcttatcctggccgatggatttaaataacatctatgtgttgacttctaaattattatcctcaactctgatcttagaaccccttctttacatgcattcatagcctcataggcacctcaagattaatatgtttaaaactgaaatcctaacgttcactcccaaacctgttccttctacagtctcacccatcttggtttgtggcaactctatttggccagttgcttaagtaagaaacctcacggtaatccttgatttctctaattatttcataagtcacatctactgcatcaggagggaaatgactttgatgaaatattggcctccaattctgctaccagatatgctatgctagaggatcatgaaacagaaaagctcacagataaaattaaaaggctcatatcataccatttattttttttatttatgtatttttgagacagagtttcactcttgttgcccatgctgtagtgcaatggcatgatttcaactcactgcaacctccacctcccgggttcaagtgattctcctgcctcagcctcccgagtagctgggattacaggtgtgcgccaccacacccagctaattttgtatttttagtagagatggggttttaccatgttggttcggttggtctcgaactctgacctcaggtgatccacccaccttggcctcccaaagtactgggagtacaggcatgagccaccacgcccggccttaccatttattaaatgagttaaaaacgtatggcatgagggaagacagcaggaggataataaaattagaatactttcagacacagattgttttgcatgtttatgtgtcacttgcttcaataacagtacctggcacataataggtgattcaaacacaagcgctaaataatcaaatgtatgaatactgctctatgtgtgcgtaacgcaatatataagaatcaccgtcgagaaagtgcagcgtcaccctactataatgagcatgggcatggagttgaataaatgcaaatttgaattcaggttctgccacttactaattaggcctagaaatacaaattaagttggccaatttaaaacagagacaaaagcactctgagctaagggaagcataaaagctaatatggaaaattttggggcacctgtgtgggagaacgagtgatgtaatttggttgaaggaacatgaaatacgtgtgtaatgagcataaaaatataaaatattaatatatcataaatcttttcgaggcagtttaggagagtagccttgttatatggacaaaattaagcgaaaaaaattgtattattagggctctgaataacattaaaaaatggacaagaaacttcataataaacttcacttggagacatactaggtttgagatattagtggatatcaaggtatagatacatacaaagagttgaaaattaattggaaatgtggctataactcaagtaagattggaagtggtgaagacagagatacaatgatcatttgcatacagattgaatacagattgaagccaggttattaaattattattaaattatgttgataaaagaacaagtacagagataagaatgccaagatatttcccatgagtttcataagctaaagaagttggaagaacagaaagagccaggtaatgaaagacacagaatagtcagagaggaagaacccgctgagtgtagaggctgagaaaaatgtttcatcagtggtagaaagttaggagagctgaataaaagccatttgtctctgtgattaagaatacttatttgttgaataaataaatgaagttaaagcagagtgatgtgtctggggagtgagggcatgcacgtgttttccataggggacagtcacccacatggctctctcctcttatagagaacgttatttttctctgtagaccagcaagtaaacactttaataaagctttctgatggaatcagatccagcctgtcttgagttcctttgaagtagagcaggtacagcctgtaggggcagtgaaagctcagtccttttgacacttttgaaataaatgttcttagtgtgaataattaaggcatacacttatcaaacctaactacatgtaacatcatcttctgatatgcttcctttagtgacagaatatatcattccccatcccccatctcttgtgatttgtgctgtgtcttttttaaatgataaacattacatttatttgaatggcttattttaaataaaacaagtaagtgaatttgttgaattatctgtgatttatgacatattatgtatttggtaatatttacacaaaggtagaatgagcagagcctagcaagatgtaagtccatttgtaattacttcattaaggagtcatacctgagcgatgccttaatgaaggtggtgatgaggtgaaaatgtgctaccagaataggcattggagaaaacctagaaaaggcagctcaataaagtgataatgagagggggaaaaaaacccctatatctttgcttggtgtatgctccttaatcttaggaggtggcacttattccttaagtcttggtgatttcaacggagggaatggtgataaattgagtctagagagtcgatggagagtcaagaggtccagaatgagagagagtgagaagagagctttgcaagtaaactagccaaggatggaggtcataactatttcaaagcttagaattttcagctaatgcatcgattaactgccaaataaattactaattaaatgcacaccactatcttaacaaaaaattgagtctccaaaaatgtacacattttttagccgataggatcaggtctatcatttttaaactcccattcatagtgtagttttgataaaaatcacatcctctagcacgtttcgaattggctccattgagcaaaataaatcatttttgttaaaaagtaattcttgcaaatctagcaatcctagcacatttcattcccacgctgtaacatttataaggctatttcttgtatattgggttccatacaatattgaaagggtggaaaactccactgagtcttcctcatatagaaagtactaaacattgccgagaatatgacctggtttcagtgtgactttttcttataaatactacagagcctgctatacacaagtttaaattagcaaaattaaaggagagcatatgaagaagcttgcagttatatttttcttacatagaatatatattttagaatgaatagataaaataattcacttagaatgtatgtatttcctttacgtagatccagaaaaatctccccaaatagtgtaattagcaattttcacagatgtacctacacttttcgaagttacatatataaaacttttcatgagcctcatgttttttataaccattagcagcctttgtcaaagagaaccttagaggttattacataatgaaagtagaaaccattacgggaattcatatttatgaagaatcaacgtatagtaaacctagagaagactcaataacaaagcagaatcacatgagggaatcaataaaacttggaaaaacaaaccagctcttcacgaggagataaaaggcactgaaaaattcaagcaagtaaaagcagtgttagattatcttggaagcagttctctggtttgtacaacagagagtaaatgttgacagacctgtgaaggaaatgggctccgtgtagggtcagaggtggtgacataagcagcctgtgtgtaggcatagctcttgaatcgaggcttaggggaagaagttctctcatatccctgtgctagactgaccgtgatctgcagagaagggtttgggggagtggatagagaggagggggaaaaaccataagtaacccgaaaggactactttccaacatggtagaaaacagaacattaaatggaaatggtgagattcaatgtttaatactaaacatatataaatgatattcgaaattggtatactcccagaatgaaggcacttaatatcatgttggagagtaaatgatctgggaagatatgagcatgctatttagccatgaggattccaaagtaacacaactccaacatttatatgggatggtactcttcaatccggcaaaaacaggcatccataagcaattttctctaaatccaaagtaaataaaaacagaattcatcaggtccataccctggaaaggactaaaaatttcataagctaatacagagctagctcagcaaagtgagagagtttggcctaagagctctccacacattcagcagaaatgttgctaaaggtttcttcactgttgtttgtgcctgagaaagcataggaaaacatccaaaccacccactgttgagagaaagaacaagccaatgtcatggaagaaccccactaaattctatacaattatgtaacgaagaatttcatcatgtttttctttattgtttatttgaaatagtttaaaacacttttctattttcaaaattgttatcctgaataatcaaaatctgactttgtacatcatattgtcataaagtattttttaatgattaaaaactgtatttgcctttaatctttctctagctctttgttctagttgatgaagattttagagtttaatatgtacgtaagtttgcctttcatttcattgtgtgttacacaatggaaatttaatatattatgttctatattcctatgatatggtacatatgaatagtatttttaaaatatgttttgaaatgaatattgtagtcaatgaagcaaaattgaaaaggtttagtctgtctctttttgtacatatacatacattaggctttgtatatatacacgtgtatatacatataagttatatatatatgtgcacgtaatacctaaaaatgcatataaaacagaaaacatcttgaatagtagctgtcctttacacactttacctgttgagaatagtgcatttgatgatgtaactgaaaatgttcttctttagtcactttaggtggccttggcaacatttccacttcctggatggcttcaatgctcacttgttgaggcaaaacttggaagagtgatgtgatgtacattaagatggacttcttatctggataggtggtatcaacatctgtaagcacattaacactacacatcaatttttggtttctatatttgagactctaaaaggataatgaacaaatcaaagttaaaggaagacgatagattaatgaacagtgaattgtccatgaatgtcctccagagactaattagaacatgagaatgaggcctaaaatgtctttccaatttggcagaccaatgagatgagcagtaaagttaatttattttccttgttcatataaaaacttcattccatattactttttcctaagtcaaattgccaaactagcccatctaacagagtagctttcattagataagaaacaaaaataaaagattacattttccctccaatggaaagttatattaacatgtcaattcaaatggtgcactggtaattaaacaaatacacaaaatggtttaccgctttggttctcagtaaagaaacctgataccttttaactgaatgttgctgatattaaagtatgcagagagctaaataagtctctgctgaaatgagtcatgtatccacaatataaattaaacagaaaaataccatataatgatttttactattccgtgtatgttaaaaatatttgtttacattgtggtgcatgggataaagtagaatatcactttccttctcagacattagagacaaatgtaaaagtcccgcacattaagttgatctgacttcatatcctttgccacatccagaaagtgaatgaaacgcagcatttaaagtcaataatactttgtaataacacatataaagtggcagctccttcaaaagattcatttgctacttggcattaaaatttacttactgcactcattccagtgaaccaagatgtaaagtaatcctttatgtgaagtatgtcattagtactagaaatgttaacacataagttctgactatgaaatgctagcatttcattgtcatcctttttcatcctttaaaaagaaggaaattttgtcattgagacagcatgtgtaaatctggaggatattaagtgaaataagccaggcacagaaagataagtaccacatgatctcactaacacatggaatctaaaaagttgaattcatagaagtagagagtagaatggtgtttaccaggggctgtggggcaggggttgggaagatgttggtcaaaggacacaaaatttcagttagataggaaaaataagttcaggagatctattgtacaacctagtttataacaatgtattgtattcctaaaaattgctgcgagagtagatattaagtatactcaccatgaaacatgctaagcatatgaagtaaaacatgtattaattagttcaatgtagccattccagaacgtatacatatttcaaaacatcgtgttgtacatgataaatgtatgcaattttagttttttaatcattaatgaatataaaaatcaaagataaaagataaacataaatcctggcaggaggtcaaggtaatgtggcaatgtattttccttgccatacaatttatcttagcttaactactattaagatatctgtattcagtatgtatattctgatcaggtgttctgattataagtgaaaaagccaagagtaaagtctcaagtccgttagcacaaaagcaggttgaacaagtgacttcatcaattcttttgcaagtatcagaaccatgattaatcagaacagctatttttaaagtatttttaaaaagagttacaagagacgaaaaaattaatgttccttggtctacttctatccgtagaacaatacagtgcttctcaattcttaatgtacatatgaatcacctggggatcttttaaaactacagaatctgattcaatagatcggggtagagcctggagctctgcatttgcaatagtctcccaagtgatgctgaaactgctagtctgctacattttgaataagggccaaaaacattacttataagcagactgttacatcatctcccgttttattgttttattcatttattcaaatgatattagacatttcaatgcacaaggctgaaaggtacaaagttatacaacacatatggctcaacttattacactttaattattaatcaacagatggtcaaagtaatttttgcaagtactttttaaagaagaactaaataatattttgtgcatgaacactgccttccttaataatcttacaaacttagctttggaattctgaagcctagaaatctccaattcatttgataattgtttttcaaaatatttgaccaattgtttcttatatagtagatactatacttcaccgtatcttgaaattctagaaaatgttcttccttctcactagtaactagtcagctgtacctgtgattagcataacttagagctctttcatttttagtatattaaataaaaccatgatgtgagaaaacaaaaagggttgagcctgtgcctattcactgctgtgttatacatagacacatgcatgtatgtttggtctcaaatatatgccattataaaaagtaaaaaatggtgaaaaattggccaagcattatttttattgccccccaaaaaatttcaaacattgtaataaatttcatttacataaaacatgtggactaaatgcagctgttcataaatatcagtcattacaataaatatgcacttatttaaccaaactattgccattttgccccaaactattactatcccacttctgagattatgtggaattcaaaactgccagtaggtagaaataagtaatttttgaagaaaggaatttaggtcttctaaaatattttgaatttcatcaacatacattttcaagaaatctattatattcaaagtattttaatggattatccaggaaatttgaaagatagaaaattcatgaattctgcttctaatttggaataagaaagtaaataatagaagtacaaagtaattgcattgctgaacagaatttaaaatgtgttcctctaattggcacaaccagttgtttaacatgttcagatttttaaaatcatataatattggaggataaggcaattctctttaaataggaaactgaattaattatgcataggatttcaatagctggaaatgagggaatggggaagagtattcggggcagtgggaatatgtagaataaacatgcagaggtagggacacattagcgatgtcttggcaacagtggctttgtgtgtcttagagagagtagagtagtgaaaactaagatgaaactggtagattgtacatagaaaactgagggatcatcaacagcaaactagaaaacctggccttcattcaatagactagagagtaaatacttttcaatgagagggtgacaccatcaaaattttattaaagtaaattctttaagtacagaatggattgctggaggaaaacttgagagaaataggaggctaggaccataatccagatataaagtgttcaagatctaaggtacaactgtgtacgggggaaatgaaaacaagtcaatgaatgacaaaaattctaagatggatcaaaaatgacttcattcaattttcaaatcatttactccacagtctttggaaatgcctatatacaaagttatgtgctacagccttaggatataaagattaataaactgacaataaaacaaaggaggaagaggacgaaagaggacactgattgttctgcagccatggtaacaagtagacaccaacaaaagtttcaatctaccctatttattcatttaacaattagttcctccatgattcttatcatgcttcccccagccaaccagcagcaaacactcccttctgaaactttgccagagtggattcacttcaatgaagataattctcaaactaattaacaatggtctcacctgagttaccacgcttctaaagctatcatcatcctattcccaatctgaaatgttcttagattgctggacttctgactccccccgcaaaacctaagaatacgctcctttcagagactgtggttgaccaggagcattccctcttatttaagatgttatgaagcccaaatccaatgtttagtaaaactgtaaagtttgttgaaccttaataccattactatgttgcatttttttgtcatttttgtcatatttttgctgtttctatcattaacacaaaaacaaacctagttgtaggagaccatttgtatactattaacaggaagccagaagaatttacttagaaggaaaaagcatttatcacttattccatatgtgctaagtgattgtcatgtgctatagaatatacttagactatgttagattatgagtatatagcagatgagccaccccataattataaacattactttttatgggaaatcaaaataaatgttatggacttcggggtaatcctcatttatgatgactgcactaaggccaattcctggcactctgtgatcacctaagtatttgttaagaaactcaatacagaggacagttaaagtcatagaaattgatgagaattatgtaagacagtgactaaaggcaatggtatgataatgagtactataaagtatttgaggagtatgaaaatgatgggatgtaatttatacttcttattacacgacattaagattttatgaaatgagagcagtggctgaatccccaaagtaagaacttaacaattacatgaacgtaattttacaccaagactctactacataaaatgctcacggacaccagattttaataattgcttatccaatctttgaagccgtctcagaatgaaaatagtgagaactcacaatactgctagagattttactttatgaacaataacaccgtttctgatgagtgtttcatatttgaggatactatggaacaaataaatcatttagcgaaatttgatcatttttcgaataaagaagttgaacctcatggcggtctgaaggcaaattcaaaggctagtcaaaatcagattagaaaccagtcattgcactacactgccatggtaccttaacctcattctctcagatactatctcagtgtatttgaagaccaagtatcgcacaaagtttgctttcaacatgccctcaccccaagaaagtcaatgtgagtaagtaagatgaaagcagtgccttcaacaaaactaatcttgggcagtcaacctcagggaagtccgattagccagtcgctgggtgtaaccttcaaacaccgctgggaaatctaaagaagaggctctactgtctaaatttcaggccaagtttctgccaagggacaggcaggaatggaaatacagaattataatgcatagcatgtgtaattgaaaacaagcaagatttcaaagatagcaggtataaatgtgcactcacaaagctttagttggtcagtcttttaagagttttattaaacaacaaaaactgtgagaggatgtcatttagaaaccatgatgagcatcaacctccccacagggtttgtattaggaaacaaaaataaataaattcactgagaagaaaaggaatagagaaactggaaagaaggcacttctggtcataaactagccatagccagaatgctcaaaatatgaaaacagaaaggcctatatgttggcacaaccaaaacctatggttgtaaacaataacctaattcattgatgtgatattctaaaaggacaaagtgctggaagtaaagtggattattttttgaggcttgcatacgaagagatttatgttataatatcatctgatatctaaatgctggagtttctaagttgtagaccatatcatggcaatggactaattcattaaagcatgatattgttatttttaatattttgtatttggcattcagcactgactgcattgtacatacatgtattctctacttacaagtcactatatacaatagatatacaacattttaattaaaatttgcacaactcctcccatgttaaattttttaacattctgcaagatatgttctgccttagctaaattaagtactccttaattaatccatttttagcacttcattcactgatacaagcagttgcttttaccatttagtaacaatgcttctcattaaaggacggtaaaatgtcataatggaaataatttgcgttgatgaagatgattgaatttcatcataaaattaataacgataaaaagtaatggcctatatttatccaggagaaacacaaaacaattttatcttttgcactttccattacgcttttcaacatgcttatggtgtaactagcagaaaactatcaccatcatcttgttacaagtagaaaacagtggctcaggctgggcgctttagctcatgcctgtaatcccagcacttcgggaggacgaggcaggtgcatcgcctgaggttaggaatttgacaccagcctggccaacacggtgaaaagccgtctcaactaaaaatataaaaatttctccacatcctctccggcacctgttgtttcctgactttttaatgatcgccattctaactggtgtgagatggtatctcattgtggttttgatttgcatttctctgatggccagtgatgatgagcattttttcatgtgttttttggctgaataaatgtctcagggatctagaactagaaataccatttgagccagccatcccattactgggtatatacccaaaggactataaatcatgctgctataaagacacatgcacacgtatgtttactgcagcactattcacaatagcaaagacttggaaccaacccaaatgtccaacaatgatagactggattaagaaaatgtggcatatatgcaccatggaatactatgcagtcataaaaaaggatgagttcatgtcctttgtagggacatggatgaagctggaaaccatcattctcagcaaactatcacaaggacaaaaaaccaaacactgcatgttctcactcagaggtgggaactgaaaaaagagaacacttggacacaggaaggggaacatcacacaccggggcctgttgtggggtggggggagtggggaggggggagggatagcattaggagatatacctaatgcgaaatgacgagttaatgggtgcagcacaccaacatggcacatgtatacatatgtaacaaacctgcacgttgtgcacatgtaccctaaaacttaaagtataataataaaaaaaaaatgtaaaaattagctgggcatggtgatacacgcctctaatcccaggtgatcccagctattcgggaggctgaggttagagaatcgcttgaaccagggaggaggaggttgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagcactttgggaggctgaggtgggcggatcacctgaggtcaggagttcagagaccagcctggccaagatggtgaaaccccgtctctattaaaaatacaaaaatcagccgggtatggtggtgcatgcctgtaatcccacctactcgggaggctgaggcaggagaattgcttgaacccgggaggcagagatgacggtgagccgagatcacgccactgtactccagcctgggaaacagagcaagactccgtctcggagggggtaaaaaaaaatctatattgaaaatatgagacacagaaaaatatactccacaaacgtttattgagttactttgtgccaggctatattttagactttaataatacaatggtaaataaatgatcccagagatatgttctcatgaaagaatgactgtaatgggaaaggaagttacgaataaataatttcaaaattctcagtttaccacttgccactgtatccctgcttcattgaattgccttccataaaagccctcttcgctgggatagtttttggaaattaaatcagaatggaagctctgcagtgttaataccaaacatcctgagagtgcctcagagcaaatgcacagaagctggtggggaaaagtcagttaaatgaaaattcgcaaccaactgtgactttaggagttttaaataagacgtgtttcagttgaaaagtttttcaaaaatcaaatttctgccgtgtgccctaatcaacaggaaaagttctatctttaaattttcaatttccaaatgcaggaaattttcaaaattgtctcttccgtcacaattgtcctaagtttacatatgttaaatatattttatttgaaaaatacatccttgactatttaaatccttagaacaaatatttggtatgtaacttctaaacccaggagaacagacactaacttgacataacaaatggaagctactcagtcagcatgggagactacagatagaaaaacatctgtactttcttacaattctctcgacatgcctgttgtgggaagaactattagggtttacatttgagatgaaagtattttgactcagtgacatttaactctgcttaagtgattgtcacctgcggttttcgtgctttgcttttgacctaaccaaattgactttttctttcctctgctgctagaaaaagtatagtcagtttcagaagtaactccaccccttatcttcctcgctaacataaaatagtctatttgtgaaccttaattgtttacagtgttagaagttatacttgatacacagtgaggccagaataaagatgtttatttcatgtgacataaatttaattggttattattctttctggtatattttgggatttcaaaatatgcctgatggtataagggcagtcctggggcaaattactcaatgatgactagcttaacgcagatattgtacaaaatgatcaggtttttttttttttgaaaaaaatatggtaaaaatggacccactacatataaaagagcttagcctgttgaggcaaaaataccttgatcaaatcctgaccctatcactaataggtaagggactgtggtaaaattcactaatttccctgtcccagtttttatctataaaatgagtcatattagtatcttgcaaataattagggatgatgttaacagagaaaatgaatgcaaagtaaatgctcaatatatacgatctattatttttcctgatttccttccaattggcacataattgtaattcataggtttgcttgcattcatgccttcattaagtatttgtggaatgcctaccatgtgtcagacatgataccaattcaccaagcaattaatcacgttttataattagaatggctccatttcctaattcctaaggaagaaacgagtggaccattggacaaaccagatggcatacaacactgatgtgactctctcagcacaaaacatttatgtgggatggtgtcatggtggtatcatatgtcatacgcaacatcagaataaggggttcagtgttgagcaaaacaccatcacacacaaacttcaacaactgacaaaataactgatggcgaattaagttttcctgaactaatccaaagttttcagtagtactctaactgaaaactgaaaccagtggacgaacatcacgcatttgtgtattttctaagcactactggaggcatgctgatgaaacacacccaatcaagaagtagcaaactttaacccattttcaaattacaaagatacattttccttttgacagtacttatgaaatttcatttgagtttggagtttctggcttccaccattgtaattaggacctcccaactacaaatacaataatatccatggatgtcaagtaatttccaatgtgaaaaaaatgcaatttagaaatttacagaagtgaagataatcaaatgtgaagcattgatggagaaaggtacaagtgaaaaagagagtaagcatccaaaaccatgtaacacaaatatgatgatgataagggataactttataaaagagaatgtaataaatgatgttaagaatgcgtaaaacatagctgagattgattttcattaaaatgtatatactaaagtatattttttgaatagtgaatagaatttgatgtatgtgttaaaagacactgccttccatgcctgtaaagtacagcatgacccaatccttcacacttagctaaaagcactctaatgtcatccctctttctctttcacacattggtcttgttttgtttttgcatctcaaataccgaaggccattttacacctcttgatcttcatatttggtgctcttttacctaaaataatttctctttttgcatttttgattcattctcacccattaggtcttaactcatatggcacctcttcagagatgcatttcctatcccatttaaagaagcccaacccctttccctttattttacattgatttcctttacattgcttgtcacaaactgtcattattatgtttattttttatataagaatataaaaaccacaaaggcaggaacttcctttagattgttttaccaatgactgagaagtagtaggtactcagtatttgttaaatcagtaaatgaatggagagagaaccttttgggaataaaggttcattttcatggtctacaccccctgaatgtagagtaagacacatgttgaaaattgagcactgcttgaaggggcagaaagcacatagcaaggaacaggagcagcctgtatttttctccctacaaaattctgcaaaagagattcagtttggtatagaattagtttttatcaagtatcaattatatacaagaacttttattatgtttttttttcatttaaattcaccactctcttgtgagttaagaatacagcccaaggtcatacaaccaataagtgacagtctgattaaagtggaaaaaaaaaagtagagtccttggtttggctcccagttctttcattttgtgaccttggataaagttaagcataatgcacctcagcttcctattgtattgcaagaagtttttcttattgatcacatttccaaaaataagacttgatttgaagaacatctcatgctctagaaactgtatcagattatttttaagtgatagggaaagaagcattaatttccaaattagagagcattagcaggttaatcaagaagcctatgagtgatgatgacaaagttagtacattttaaattcagattgaaaatactcaagacacaggaaaactaatgttttattcattgttctaaactttggcatacacactacaaaatagcaccgtgctttacaaaaacgtattttcaaaaataatattgactgatatctacagaaaaaaaaatgtactcaagtgctctcagactgaggataggaaaagcagactccttagaactttggaagcatagcttccaaaaattttgtgctaagcgtctgcatacctgggggtttgaaagattcaagtgtgtgaattccttgtcatctcactaaaactatgagtcagcggtgggtaggattctaccaaataatgataattgtaaaaaatgctttttaagctcagatatatgagaaagggattcaataaagaaacaaaaacctaggatggtatacacacatttataaacaatatgatcactaatatataactataatatgcatgcaaacattacatatttggaaagcaactccctttgactagatattagcaacttcaaagactaaatagagaaaaggaaaggctttgcgtagaatcttactgctattttaattactgaatgttccttttgtccatttgcaattttaaaatttcttctttccttttctcagtggctggatgagggttaaaactgatatgctaaataccacataacccattttcttggtatagcttccagttcttcttgactctgaaatgtcggcctctctcaaatacctctccctcaggtagagctctactagcaggggcctgtctttcctgatgaccagaaacccaggggcttggtataactatctcaattactatatcctatggagcctgactccttatcatagctccagtccccatatgggctctgatcttggattgaccagatgggtcatttccactcttatctcaatgggaacgtgccccttgattaggaaagctttccctcagagaaaacacatcccattgacggttttggccccaagagttcaaccgttagttgtctttgatattttaatttcataagtctggatttaatctctcacttttaaacattttattacaaaagccatacatgcttattgtagtggaaaactaaaacagtacagacgcatttaaagttaatagtgaaagtaccccatatctctacagcaccacagtcccattagctagaagtaatacttgtcaccagatgctatgtcatccatacatccatgcatctatccattcagccattcttttagctatccatttatcatactcatctgcctgtctaatgagattaaacatatacactgtctatgcatgtactttcttaagatgtgctcaattagtaaagattcaaaatttagctttaccactcactggtattatgaatttggataagaaacttaatttcttcatttcttcataccctcattggtaaaatgaggcaaagacttttccaagaaggtaagtgcaagtaaggcatttagagcaatgcctggcataaagtatgttttcagcaaatttcaagtttaaaatgtatatacacatgtatatatacaatgtgaacttcaaaattaatttcagtaatgcatgtattcatttatccatttatttattctgtaactatttattggacacttgccataagtcgaggattatgctggacactgcagctgaaatagtgagcaaaaataaaaacaaacacaaacaaacctagaccctgattttatggtgcctatagtccaatggtagagatatatctgcctaacagtccatagcatgaaaaatactggagctactgtgtacaacgctgcaatgaacatccttacacatttgtcgtagatatgtatgagtattactatatatctaattcttaaatgtgaaacctcaggatcaaatatatgtaaaattacatattttgaaagataatactaaattgtctgattaaaatattacaagttgtgtttcctccaaaagaaacacagggcctatttacatgaaccctcataataagaagatatttgtactatgcatttatttattagttaagcttaattttattttgatgggctatttctaattttcccaagtgaatgtcctgaccataatatgtagccacttttaaaatattatactttgtatattcattgtaggagtgttatcatactgaggttattgattttttattactagtgtcattctgcagtccatcataggttttattactgtttaatggtctttcacaatggaaaatattttaattttgtgttggtaaatttgtcggtattttacagcctctaggttttatatcaccttaatattattgtaatattcttctacattgtaataaagtatttaaatgtttattcacattcaatcattatctgaaagttatcttagtatttgttgtgccttgggtttccacagttgaaggctttattagctaacctattctatctctagagacatgaaatgtcaccctaattgtgtactaaatttacctaaataaaagggaatgttgtcaaaatatctattccacaccattaaattatttctctatcatgtcatactatgttaagtatgttataaaatctactaaagcaaatcacctgtttgaaaataatttcttaactgtactcacgcatttacatttaaacaaattttagaattatctagaaaactgaatccctcttaccattcatgtgatttatgttcagtgtgctcaccctgaacataaacaccctttcttctctgcttattctctaagtggctgaccctttcacactgtatctcctgtgatcattagctggctagattccagttgcattaagctggtgggaagtaccagctggagattgaaagaagagggaaagagaaagctggggaaatttctctattatttccctgctccagagctgcataatgtagtatctgagttctaccaacaactacattccctccattggtgcagctttcactgaactccgttccccctttcctttcagctactatatagtaggaatagtagaaatagtaactacttcctactattgctcctctctagattatttcttgtcacctatttgttaatatatacttctgtaacttttaaaatacaattatcttcattttaccatctgagataaattctatttattgctagggttctgttatatcctctaaaataatacaaatatagatacacagagagtcgcatacatacatgtttgtgggcatgtgagtgtgtaattatacagatgctcctcgacttatgacagggttacattccaataaacccattgtccatagaaaatatagtgagtcaaaattgcatttaatacactgaacctgtcaaatattatagcttagcctagccttccttaaacatgcaagaacacttacattagcctatactttggcaaaaccatctaacacaaagcctgttctataaaaactaaagtactgaatatatcgtgtaatgcattgagcacagtagtgacagtgaaaaatggcatgattaaatgggtactcaaagtacggtttctactgaacgcacactgctttcacaccatcataaagttgaaaaatcattagtcaaaccatcttaagtcagggaccatctagatcttgattgaagtaacttcaggaactttagatttaaggggtacaagtgcaattttgttacatggatatgttgtgtagtgatcaagtctcggcttttagtgtacccatcacacaaatagtctacaatgtacctaataggtaatttttcatctctcacccccttcccactctcccatcttttggagtctccaatgttgagtattcaattctgtatgtccatgtgtacccattgattagttaccacttataggaaaatacagtatttgattttctgtttctgacttatttcacttaggatgatagcctccagtttcatccatgttgctgcaaaagacataattttattcctttgtggctcgttagtattccattatatatacacaccacattatctttatctactcatggacacaacttgattccacgattttgctattacgcatagtgctccagtgaacatgcgagtgtgactgaagttactttcaatgtacaaactaacttagggagaactagcattttcatcatatgtgacttcctttcctcatgtctttatttatgtacttatatacaactttaaacttcctataaaaaaaagcttatactttcttgtgcggtttacttctaagaaaactacatagattttggaacttctcttttttaaaaataattttattgtgtgttttaaggtatacacatgatgctataagatacacatgtaaatggttaccataatgaaaccataatgaaagaaattaacatatccatcatctcacataatcgttcccccaccctctgaccacgagaagctataatctactcatttagtaaaaattctgaatacaacacactattaactataatcctcatgttttatattagatctttcaacttgtttatcccacatatttgctactttatagactttgacctacatctccccatttcctccttccacccccaacctggtaaccactgttttattctctctatatagttatacacaatggaatattacttggcctttaaaaaggagatcttgggccaggcgtggtggctcatgcctgtaatcccagcactttgggaggccaaggcaggaggatcacaaggtcaagagattgagaccatcctggccaacatggtaaaagccaatcactactaaaaattcaaaaattagtttggcttggtggtgtgcgcctgtaatcccagctattcaggaggctgaggcaggagaatctcttaaagccaggaagtggaggttgcagtgagccgagattgtgccactgcacatcagcctggtgacagagattccatcaaaaaaaaaaaaaaaaaaaaaaaaaaggagatcttgaccaggtgtggtggcttatgcctataatcctagcacttagggacttagggaggccatggcaggcagatacgcagatcacctgaggtcaggagtttgagaccctggccaacatggtgaaaccccatctctactaaaaatgcaaaaattagctgggtgtggtggtgggcgcctgtaaatcccagctacttgggaggctgaggtaggataatcacttgaaccggggaggtggaggttgcagtgagccactgcactccagcttgagtggcagagtgagacttcatctcaaaacagaaacacaaaaaaaggagatcttcttatttgccacaggacagatggagccgaagaacattaggctaagtgaaataagcaagacacagaaagaaaaatattgcatgatctcacttgtttgtggaaactgaaaaacaaaaagtaactatgctgagtatcattttattaccactgtacatttcctaattttgagatcattttacataatgagaaaatcatattattttcaaataatttatcttgtgctttccaatatatatttcatgtaactttctctcgtcatataatattggctaggttctccagaaaaatactgaacagcgtcaatacagaggaggaatattcttgtcgtatttattgtttgagtcattctagcatattgatatgatttggatttgtttccttgcccaaatctcatgttgagttgtgttccccagtgttggaggaggggcctggtgggagatgataggatcatgagggtgaatttcccagttgctgttctcatgataatgagttctcatgagatctggttgtttaaaagtgtgtagtactgccccctgctttctcctccttctctggccatgtaaggtataagatgtgcctgcttccccttcgccttccacaagaaggtggaaatttcctgaggtatccccagccatacttcctgtacagcctgaagaactttgagttaagtaaacctcttatctttacaaattactcaatctcaggtagtttatagcaatgcgagaaaggactaatacagaaaattggtaccgagaggtagggcactgctacgaagatacatgagaacgtggaactaactttggaacagagtaagaagcacacgttggaacagtgtggagcgctcagaagacaggaagatgagggaaagtttgtaacttcctagagacttgaactgcttggaccaaaatgctgatattgatatggacaatgagatccaggctgaggtggtctcagatgaagatgaggaacttattgggaactgcaataaaggtcactctcgcaatgctttaacaaaaagagattggcagcattgtgcccctgctctaggtatgtgtggaacttttaacttgagactgatgatttagggtatatggtagaagaaatttctaaccagcaaaacatttaagatgtgacctggcttcttctaacagtatacggtcatatgtatgagcaaagagattatctgaaactggaacttatatttaaaagggaagcagagcataaaagtttagaaaatttgcagcctgaccatgtggtagaaaacaaaagcctattttctcggggtggtgggggaaattcaagctgtctgcggaaatttgcataagtaaaaaggaactgaatgttaataaccaagacaaaggggaaaatgcccaaaggcatttcagaaccctttgcagcagcccctcctatcacaggtctggaggtctaggaaggaaaaatgatttcggaggccaggcctagggcctcactgctctgcacaacctcaagacactgctccctatgtcccagacactccagctccagctgttactaaaaaggccccagatgtgtcttggggtgttgcttcagagggtgcaagccataagcattggtggcttccatgtggtgttaatcctgcaagtgtgcagagtgtgagagttgaggcttgagagcatccacctagatttcagagaatgtgtggaaacacctgcatgtccaggtagaagtctgctgcagcgggggagcctgcatagagaacctctactagggcagtgcagaagggtaatgtggggttagagctctcacacagagtccccactggggcactgcctacttgagctttgagaagagggccactgtcctccagagcctagaatggtctctccagtgacagtttgcaccatacacctggaaaagccccagtcactcaatgccagcccatgaaaacaactaagggtgctgtacaccctgctgagccacagggatggagatgcccaaggccttgggagcctgtcccttgcatcactgtggcttggatgagatgtggagtcaaaggaaattattttggagctttaagatttaatgactaccctgctgggttttggacttgcacagggcctgtaacccctttcttctgatcgatttaactcttttgagctaatgcctgtaccctcattgtatcttggaagtaactcattttgattttacaggatcataggttgaagggacttgccttagtctcagatgagactttggactgtggacttttgaactaatactggaatgagttaagactttggggaactgttgggaaagcatgattgtattttgaaatgtgagaacaatatgagatttgggaggggttggggcagaacgatatagtttggcactgtgtccctgcccaaatctcatgttgtattgtgatccccaatattgaatgaggcgcctggtgggaggtgactgaatcataggggcagatttccctcttactgttccaatgatagtgagttctcatgatatctggttgtgtgaaagcgtgtagcatctctgcctgctctctcttcctccttctctggccatgtaagccgtgcctacttccccttcaccttccacagtgatttcctgagacctccccagccatgcttcccatacagcctgtggaactgcaagtcaattaagcctcttttctttataaattacccagtcacaggtagttgtttatagcaatgtgagaacggactaatacacatatcaagataaggacatttattcccagattagtaagaacctttctcaggacttggtaatgtatttaagcaaatgtcattggatatattacttttgcttttactgataggactgactagttctggcttcctgactttaagaaaaggaagaacaaagattaaatattacctgttcactgttttgcattttattattaatataaatatgtcacataaaaacatcaattaaatgaaagccctgaatttcatcactttaaaagactttccttattgctctttaaaatatatggcaaatgtggatggaagtacacacttagcaaataattttgtcagctaaaactttttattccaatgttgactcaagtgtaaatagttaataaccttccatatttaaaatgctccattaggtaaataatctgtaattggtgcctctttatatcggggaagaggctatattcttggtagcaaaatagtctgattcaattacctacatatatagttactcaactagagaaggtaggcaaataggtgattcacaaacactaaacataactggacatagttggaaatactatgaatcacccatgcatcctctatcatgattatcatagcagtgttcctcaaagtatatctcaacttatcagccattgcatccacataatctgatgaattgaaaataataattaatataagatagactggttggaagcaaatagcttcaaatagaaagtattacaaaggttcagataatcttaatagagctaagcttctagaggtttacatgaaccaaataaaaatcagcactgagctttcatattccttttcaatttctcattatcaatttgtttctctgtgtgagtgtagggtgatgaagaatgaagtagatgaaattttcagtaaagtatacatatgttgccaagaaatcagaggcaaataattctataactttgggtcattgtactaaataaaagagaaaccttagtattgcaaagtttaaactgattatgttaatatgcatttgcctccaaatattatagtaaaataatggaataacaaaatttaattctggtggaaatattttggatattgtacagatgcacatgatgctttgagcatattaaatgtagacttacttttgtgttcttatttaagttattttcactgcttggaatgcctgatactttttttttcatttatttagctgaataaatgtacatttactgttatcagtcagtcaatatccaaatgcttggtgtgcagttatttcccagaatacctcaagagcttggtacacaatgcccttttccaacctctgaacgtttatcaccagatagactctatcatataatacgttgttatcccagcttgcatgtgcacacgtgcacacacatactatatgacctgacccattagaattcattcattcatatatatatatatatatacacacacacacgttttaatattaaagtaaattaaatatattaagtaaataaaatacacaagatacttacaagtaaagcaaacaagacaacattactagcatttctttgactgtttctatctgacagagccactcaacactcgtaacacctattatacgagtcaaatcataccttacaaaagagtttttgtctaccacaattctttattgttgttaccttttctaatttttttcagaatgggaggggaaacaatatgaactcctagaagacaatgcattttaacggtctaataccaagactggctcattttgcacccattaaatgcctgtgaaaaaattgaccaaaattggtcacagatggaacacatctcattgctcttcttagataatttctattacttacattttcttttacaatcgtttttttacttagctcacatccaaatgagcaaattacattcatttggaaatgttattcgattcacattgtttgcccccatggggatttttttaacgcctttttagaaactacttaaataggtcctaaatttattatcttggtccatgggtgttgaataagcaaactgagaaaatcattgttacaactgtcaattctacattaaaaatgatgttaaaatctggtcatacatctctggatctgacatattttagataaatattagaaagggttaagtagctgaggcgatagacattttaactagctagatcaaatctttctcataatgtatgcatagatcaaaacactacattttaccccattattatctgcttttatatttttttaaaaaagggttagctgtatatcgaaactctaaatttatttatcccacataactgcaagtttccatgtacacattgacttatttcctcaccctcactactcctggtaatcaccattctactgtctatgtattcaacttatacattttcttcagatttcagatgttagataacgtagcatatttttttctgtgtcttgcttatttcacttagtgtaatttccttcaggctcacctatgttgttacaaatggcactatcttttgtgaggctgaatatttgtgtgtgtgtgtgtgtgtgtcacaatttctttatctgtcagtggacactcaggttattttcatatcttggctattatgaatcataacgcaatgaacatgagagtaaggctatctccacaaggttctgatttcattttctgtgggtctatacccaggagtgggattgttgggtcatatggtagttctatttttaactttttgaggaaacactcccagacaattttccataatgtctgctctaatttacaccgacaccagcagtatgtcagggttccctttcctccttgcctttactggcacttgttatctcatcttttagataatactcatcctaacaggtatgaagtaataccttattatgattttgatttgcatttccctaatagtgatattgagcacgttttaatttccctgttggccgtttgcacatcttctttgaaaaaaaaaatgttcaagttctttcccaattttttaattgggttatttagtttgtcactatggaattgtgcaagttccttatatattttggatattaaacccttatcagatatatgttttgcaaatatctactcataatctgtaggctgtgtttttcttttgctttccagaagctttttagattaatgtagttccactagtttatttttgttttcttgcctgaaattttgatgtgatattcaaaaaatccttgcaaaggcgactgtcagagagctttttcctctctgttttcttctaggagtcttatgattttaggtcttatatttaagtctttagtccattttcacttaatttttgtgtacagtataagacaagggtacaatttacaacaccatttattgaagagactgtcctttccccacatatcttcttggtggtcctgtccaaaattagttgattatataggcttaggtttatttgtgagatctctattctgttccatcagtttatgtgtctgtttttatggcattacaatactctttttaatactgtagatttatgatataatttcaaatccaaagagcagtatttccaacttttttttcctcaagattgttctggctatttgggatttcatgtaagttttataatgctcttttatttctgtgaaaaaaaatgccatttagattttcacagggattacattaaatttgtacagtcaaccttctatttccacggatgcaactgtagaccagaaataatcaaaaatagaacaaaaaactcaatacaacaacaaaaaatattaatacaagtaaaaataatatatggtaacaactatttctatagcatttacattgtattaggtgtaataacaaataatcgatagatgttttaaagtatataggggggtgtgcataggtatatgcaaatactatgccattttgtataagggatttaagcatctttggattttggtatccactggcatcctggaacccatgtcccgtggataccaagggacagctatatatccatttgggtagtatggaaattttaacaatattacttcttccagtctacaaacatgggatattttcccatatatttaccttttaatttgttcctcaatgttttatagttttggttgtacgtatttttcactttcttctttaaattgggtcttaaatattttattctatgttatcataaatagaattttttaaaattttttggatatcttttgcataaaaatgcaactaattttatgttgattttgtattccactacttactgaactcatttattagttctaacatttttcttgtggagtccttaggggtttctacatatacgatcataccatttgcaaacagaaataatattacttcttcctttcagatgtgaaagccttttattaattttgtctcactgctcctgctagtatttttggtactatgacaaatggaagtggtaagagtgggcatccttgctttttagcaaatcttaaggggaaagctttcagtacaaccaccccacaaccaccgttgatcatattagctataggcttttcataaatagccttgatgttgaggaaatttccttccatacatattttgcgaagagttataataataaaaggatgtttagctttatcaaatgctttttctgcatgtattgagataatcatgtggtttttcatctttctgttaatgtagtatgtcgcattgattgatttgtgtatgttaaaccaaccttgtgtcctagggctaaacccacctggtcacggtttataatccaatgtgttatttgtcttgctaatactttattgaggactttcacatctatattcctcctagatattggcatatatatattttcttctcttgcggtgtctgtttgactttcgtatttagggtgatgctgaagtcataaatggctttggaggtatttcctcttctattatttagaagattttaagaacaaatggtataaattactctttaaatgtttggaagaaatgaggagaagtaggtcaaaggacacaaacttgaagttatattggataaataaatctcgataactgcttagtatgatgactacagttaatggcattgtattgtacactgaacattagctaagaaaagagactttaggtattcttaccataccaaaacagttattatggaagataatggataggataatttggttgaattcagtaatcatttcattatgtctatgtatatcgtaacatcttgtaccccttaaatcaggggtatgtaatcttttggcttccttaggctccatttgaagaataattatcttaggccacacctaaaatacactaacactaacaatagctaatcaactaaaaaaaaaaacctgcaaaaaaatctcataatgttttaagaaagtgggtgaattacagttaggctgcattcaaagctgtcctgggccacatgtagcccatgggctgtgagttggacaaggttgccttaagtacatccagtaaaagaataaaaactaaaactaaaataattagcacatattgttgtatttcaaatgatgacaattagattcgacagttgacaagtcaaatataatacatttaaatggtgcaattctacttcttgaggaaatcctttcaaaaaattggtccaactggaatgtataaatatacaattaagaattgtgcatttaaaatcaaaagtaataataaactctaaattaaatcagacttttttgctgaaactaaacgaggtgaataaaataggtgaagtgaacctaatttataaggctgttatggctcaaattcttcaaataaatttctgttcagttcttatcattttcataaagttgatttatgaggaactatgcaaatctagagtagtctactaaagtctgctttttatatgcttatttcacacaaaatggttattgaccatatgtattttgtctaggcccttaccaagaggagctgttaacataattgatttacaattcagttaggaagaaaacatgttaaagctaattttactctgaaacaataaatcaacccaatgtgaagtatatcacagcccataaaatgaacagtgatccaattgtacagttgaaccatgtagctcacatatcccatggcacttaaaatcttcatccagtcattaaataagtctcaagatccaaaagatttacataagcacaactgaataactttattagctcttctcttctgggtttataatgatgaactaaaaatactaacctgttataaattacatcagtaatctttcagctctttttctcatcatattataaatttacaatgttactgagattaaaaaatgtttatcatatgttaattatttgcatgatctttagcatttttaaacaatggaaaaaagagagctaccaaaaccagagttgtgttcttggcatcagaaagctctagtaaacatcaaataaactttaacagcttagtgcgtaaataacacagcctcaagtacaacaccttagccacagatagtacttaataaatagtcattgtttggttgtatctgtgtaacacaacagaagaaagtatacaatcctaatccttgctttagaatctagacattgttttcttagccatttctgcaataacagttaaaataaacgtaccagcatttctggtaaagactctaatatataagggtgttccagaaatttcaatatactagatttgacagtatggcttgagagagggatcccactgctgagcattctctgcctctcatatcatggatcatagtcacttatgaaattttatctataatattgtagtccataggtatatatatgtatatgcatgcatgtgtttatatacatgctatgattctacaaaatacttgacatctttaatgaccgcctataaagatacacatgggctgaaaatggatgaaaaaagatattccatgccaatggaaaccaaaaaacagcaggagtggctgtacttttttcagacagaacagatttcaagacaaaaacaaagagtcaaaaaaggtcattatataatgagaaaggggtcaattcagcaaaaggatacaacaattgcaaatatttaggcacccaacactggagcacccagataaataaagcaaatattattagagctaaagagagagagagatctcaactcaaaggctgagtagggtactagggggtggaggtaagctggggttggttaatgggtacaaaaattccttagaaagaataaaacatagtatttgcgagcacagcaaggtgactatactcaataatttaactgtacattttataataactcagtatcattggattgtttataacacaaaggataaatgcttgagtggatggataccccattctccatgtgattattatttactgcatgcctttatcaaagtatctcatgtactgtctctctctttctatacatatatacacatacaaactatgtacccacaaaaatttaaaaaattcccctggaatatatgcaatttctaataggtatatctcttaatctaaataatgttttgaacattctcatatacttttatccaatatatatgttacaaatttattacagctgaagaatctacgcaatcttaactttctatggaggcaatgacactactataaactatttatgacactgcggggttagcaaatcaacccatgaacaaatgtcattttctcttttgatcatattattagttcgatagataaggtcatattcacaatgtagcttatcaatgtctcccataataaattcacagacaaaattttgaatctgtactaaaatatagtattttaaaaacacacatgtggcagcacaccctatccaaaaagtgatggcaaatggccttgtgtcagtttaaagttatatctacttgatggtcatgtgactctcatttggactgcttccaccaaatataccttgccaatgatcttggatcttaaggcataaaaatacagctattataataaaatattttactctcctggaaagggtagcttttactctttgtaataaaattcagctatggatgtcttagctataataatatcgaaaccagtaagataaaatttaacagatcacctttaagtctgaaattaatattggaaagagcagttataaggactgcatgggtttataaattatttgtgggaagttttttttattatttatgactgacatgataattatacatatttatggggtccaacacaatgtttctacacacagacattggatgtgctaattaccctgaattaattatcacatattcaaagaaattataaatatataagatgatggattcagatattatttgagaatcaaggcaattcaaattctaggcctaacgtttactagatgtaggagctatgactaccatgacgataaaggacaccaaaagtgagcccaataataaaggctgtgggtattcatcttggagatggtagattcataaagaccttttcaaatggttaaaggcagtcatggttcctctaggttgaagtaaaatcaatgtgtgaatgttacaaagatactgatgcttctttaatgtgacaaattttaggcatgatatcatctttaataattataatagactagcaaaaaaaagatctgcttcagaaacacttccaactggtacaaaaattcagttagtgaatgcatagatatctctaatctgcactagagaaggtaatctgcccagattggcttagattacacattgtgtcttatgttcgcacacattatctcatttgctcctcaaaaaatactaaagtaggtggaacaagaactatatagagatgaattcattgagacttgtataaaaatggtttcacgagaccattgagtttataacagagcagaactctaaattctgattaatgttcaagcaactgactagaccaccttctaaattcatttactagagtcctgcttacacctctataatcaccttaattaatttttctatatcaggcctctgcttgcattgatattattggtcccttcagtgaataataaaatacttgacgttcctatgctgaatttttagaaccaatatttccttaggaaaatatccggaaacatgactttcctaatttaggatacatgttactgcgtcataacaacaaatgtgttaaaagtatttgttgatgattttctcttaaatataaaggtttctatgatgtatatatacacacatatacatgtatatacatacacatacacacatatacatattagcctttaaaatatattccaattcacttttatttaccaaattagactgctgtaaaacatgattactagaaaatgtaccacacaaaactctgatcactctgatcatacttttgtttttaatttaactttttttgtaatttaatctccatagtttataaagggcattactgcttgtcaggaaaaaatgagcttgtatttctcagctgtgtgtaaattacatgcattttatattttttaggcaaggcctctatcaatcaatattttcagaaaatgacactcctcagttaggcagggattgttactgaagctgataaatgtttactcttcattggagactgacaaatagcatatgacatagactactcttatgctcttacactgcttgtactaaaacttgtctagaaatataaaattcaaaaatgtgattttcatgtaaaactgctttcaaatttcttgttaggaagcttgccagacactccagagtaacattttgtgaagcaagtcagtattacacgcataagtaaatgaagtagagatttaaacaaaaatacaacccaatgttgtaatacaggcaaaatataatatttttaaatgatcaccatgtgaggtctatattcaaatgtcttttcataaatggagtccaggcactctttgtagtttatcaagagcaggtttaacagcagtagtttccacaaagcaggctgaagtcatttaatccatggctgctttttatacgcagctgctttatttgagcttagagaggagtagaccacataaatgtcatgttaatattctaaagtgagttaaattgtgttagcaacaaagcttgtcttatcagacatttcaccttggcctatgagaaaatgtgatagttatggtattaattgatattaatcagtaaggcagatatctttgggaatataatgcatagaaaatagtattttcttcctcttcttcttcctgtatttttttgaatctcttggcttcagtgagaacttcctgttggatttattcttatctttccttaattgtttaattttcttctttccacagttcttaaactgaagaaggcctgacgttggccatagccacttaaacactgttagtctttccatcttgccatgccaaactgaaatacttttacctatccactcatttagtaaatatttactcagtgtctaccattttccaactaccacaaaaggtgctagggcgcaattatgaacaaagaagtcagcagatacttttttcacagagcttacagtacagcaaacgggcaacacgtgtaagcaagtaagttcaatacaggttgaacatccctaataggaaaatttgaaatctgaaatgctacaaaatctgtaattttttgagtaactacacgatcatttttaagggaaatccttattgaatcatttcggatttcagattttcagattatggatgctcaactcgtatgtataataaagatattccaaactgaaaatatccaaaatccaaaacacttctggtcccaagcattttggataagggatactcaacatatattttggggcaagttttattatagggaaagctaacattgcccaatatttagtcttgaggcacaaagtcaaccattaatgtagcacttcagctttggaaacatttcatgttaatgaatattttggctgatttttctatgtatgtatcttctgcctcttttcaaacactgattcatggtagcttggcaagctgaatgattctccaagaggagtattatatgcttcaatgtcttatcttaaccacccccccaatctatctttaacatttccacatttcatatatcatctcagcagatttctacccttgtaagtttttgttaaaaagaaatatgccaaatttaatagagtatcatagatgaagaagtgtatatttgtatacttatgtctcttaaggagctttttatactaagaaattcagaaaactacatgttctggttctttaataattaaatatgtgtgttattcttttgactttcctatcaaagtaaaaacgttgtctcagcagggcattcaacatatcttaaccattcaccatagtactgactatgtaataaacaattttctaaatgtactagcaaaactaaagcatatatagtagcacagcctctgctctatatgaccatggtccaggaggtatacttaagagttggttaaatatttatagctgagttagtcatgtttttggctttgggaaactgcagtgttcagatccccactgttaaaatgtaacgtgggccaggcacaatggttcacattcctaatctcagcattttcggaggctgaggcaggaggatcgcttgaggccaggagtttgagaccaaccggggcaatgaagcaagaccctgtctctacaaaataacaataaaaaattgtttaaatgtacctctgcattgtgttgtacacctgcaattctagttactcaggaggctgagctagaaggatcacttgactcaggagttggaggcctgtggtaagctacgactgtgctagtgcactccagcctgggcaaaagagtaatatcttgtctcttaaaataaataaaatgtaatggtgccataagtaaatgcatagatatgtgatccaatccatgagttttaaaatatgtcaggtaacaccaaagtaggacacaaaaacaatttgaatgtttatgaaaaagagtacttcaacaggaagtagacttagagagccataggacagaagagtgtcttcctaggcaataggaatgacgttgaatcacattttggaaatagtaagatgtttgccctaggaataagcttaaagtagtaagagataagactaaaagaaaggacaggactagaaagcctatgaaaaatattagtaactactgagtttggaatctttaatataggtagtgggagccactaaatattttgaataatgaagttacatgatgaaattagtattttattaagagtgtggaggctatgtattcaatagattcaaatatgaaagagatgggagatacagaaaattttcagccatgagcagaaaaagagtaggaatagagcctaccagtgggaaaattaaaacttgaaatattggatcagaaatctgatttgagaggaggagccaagatggccgaataggaacagctccggtctacagctcccagagtgagcgacgcagaagacgggtgatttctgcatttccatctgaggtaccaggttcatctcactagggagtgccagacagtgggcgcagctcagtgggtgcgtgcaccgtgcgcgacccgaagcagggtgaggcattgcctcactcgggaagtgcaaggggtcagggagttccctttcctagtcaaagaaaggggtgacggacagcacctggaaaatcgggtcacacccacccgaatactgcgtgtttccgacgggcttaaaaaacggcacaccaggagattatatcctgcatctggctcggagggtcctaccccaacggaatctcgctgattgctagcacagcagtctgagatcaaactgcaaggtggcagcaaggctgggggaggggcacccgccattgcctaggcttgattaggtaaacaaagcagctgggaagcttgaactgggtggagcccaccacaactcaaggaggcctgcctgcctctgtaggctccacctctgagggcagggcacagacaaacaaaaagacagcagtaacctctgcagatttaaatatccctgtctgacagctttgaagagagcagtggttctcccagtacgcagctggagatctgagaaggggcagactgcctcctcaagtgggtgcctgacccctgacccccgagcaccctaactgggaggcactccccaaaaggggcatactgacacctcacacggcagggtactccaacagacctgcagctgagggtcctgtctgttagaaggaaaactaacaaacagaaaggacatccacacaaaaaacccatctggacgtcaccatcatcaaagtccaaaagtagataaaaccacaaagatggggaagaaacagagcagaaaaactggaaactctaaaaagcagagcacctctcctcctccaaaggaacacagttcctcactagcaacggaacaaagctggagagaggatgactttgacgagctgagagaagaaggcttcagacgatcaaattactctgagctacgggaggacattcaaaccaaaggcaaagaagttgaaaactttgaaaaacatttagaagaatgtataagtagaataaccattacagagaagtgcttaaaggagctgatggagctgaaaaccaaggctagagaagtacgtgaagaatgcagaagcctcaggagccgatgcgatcaactggaagaaagggtatcagtgatggaagatgaaattaatgaaatgaaccgagaagggaagtttagaggaaaaagaataaaaagaaatgagcaaagcctccaagaaatatgggactatgtgaaaagaccaaatctacgtctgattggtgtacctgaaagtgatggggagaatggaaccaatttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaagtgttaagggcagccagagagaaaggtcgggttaccctcaaagggaagcccatcacactaacagcggatctctcggcagacaccctacaagccagaagagagtgggggccaatattcaacattcttaaagaaaagaattttcaacccagaatttcacatccaggcaaactaagcttcataagtaaaggagaaataaaatactctacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaaccttaaatgtaaatgggctaaatgctccaactaaaagacacagactggcaacttggataaagagtcaagacccatcagtgagctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaggaatcaattcaacaggaagagctaactatcctaaatatatatgcacccaacaaaggagcacccagattcataaagcaagtcctgagtgacctacaaagagacttagactcccacacattaataatgggagactttaacaccccactgtcaacattagacagatcaacgagacagaaagccaacaaggatacccaggaattgaactcagctctgcaccaagtggacctaatagacatctacagaactctccaccccaaatcaacagaatatacattcttttcagcaccacaccacacctattccacaactgaccacatacttggaagtaaagctctcctcagcaaatgtagaagaacagaaattataacaaactatctctcagaccacagtgcaatcaaactagaactcagaattaagaatctcactcaaaaccgctcaactacatggaaactgaacaacctcctcctgaatgactacggggtgcataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctgcacacatacactctcccaagactaaaccaggaagaagttgaatctctgaatagaccaataacaggatctgaaattgtggcaataatcaatagcttaccaaccaaaaagagtccaggaccagatggattcacagccgaattcgaccagaggtacaaggaggaactggtaccattccttctgaaactattccaatcaatagaaaaagagggaatcctccctaactcattttatgaggccagcatcatcctgatacgaaagcctggcagagacacaaccaaaaaagagaattttagaccaatatccttgatgaacactgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctccatagatgcagaaaaggcctttgacaaaattcaacaacccttcatgctaaaaactctcagtaaattaggtattgacgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaaagtcaaattgaccctgtttgcagatgacatgattgtatatctagaaaaccccactgtctcagcctaaaatctccttaagctgatagggaacttcagcaaagtctcaggatacaaaatcaatgtacaaaaatcacaagcattcttatacaccaacaacagacaagcagagagccaaatcatgagtgaactcccattcacaattgcttcaaagagaataaaatacctaggaatccaacttacaagggatgtgaaggacctcttcgaggagaactacaaaccactgctcaatgaaataaaagaggatacaaacaaatggaagaacattccatgctcatgggtaggaagaatcaatatcgtgaaaatggccatactgcccaaggtaatttacagattcaatgtcatccccatcaagctaccaatgcctttcttcacagaattggaaaaaactactttaaagttgatatggaaccaaaaaagagcccgcatcaccaagtcactcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgccgcatatctaccactatctgatctttgacaaacctgagaaaaacaagcaatggggaaaggattccctatttaataaatggtgctaggaaaactggctagccatatgtagaaagctgaaactggatcccttcctcacaccttatacaaaaatcaattcaacatggattaaaaacttaaacgttagacctaaaaccataaaaaccctggaagaaaacctaggcattaccattcaggacataggcatgggcaaggacttcatgtctaaaacaccaaaagcaatggcaacaaaagccagaactgacaaatgggatctcgttaaactaaagagcttctgcacaacaaaagaaactaccatcagagtgaacaggcaacctacaaaatgggagaaaatttttgcaacctactcatctgacaaagggctaatatccagaatctacaatgaactcaaacaaatttacaagaaaaaacaaacaaccccatcaaaaagtgggcgaaggacatgaacagacaattctcaaaagaagacatttatgcagccaaaagacacatgaaaaaatgctcatcatcactgggcatcagagaaatgcaaatcaaaaccacaatgagataccatctcacaccagttagaatggcgatcattaaaaagtcaggaaacaacaggtgctggagaggatgtggagaaataggaacactttttcactgttggtgggactgtaaactagttcaaccattgtggaagtcagtgtggccattcctcagggatctagaactagaaatcgcatttgacccagccatcccgttactgggtatatacccataggactataaatcatgctgctataaagacacatgcacacgtatgtttattgcggcattattcacgatagcaaagacttggaaccaacccaaatgtccaacaatgatagagtggattaagaaaatgtggcacatatacaccatggaatgctatgcggccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacaccacactctggggactgtggtggggtggggggagggggtagggatagcactgggagatttatctaatgctagatgacgagttagtgggtgcagcgcaccagcatggcacatgtatacgtatgtaactaacctgcacaatgtgcacatgtaccctaaagcttaaagtataataataaaagaaaaaaaaacttaaaaatttcagcaaaccaaaatgtttgttaaaataaccattaaccacatatatatccaaatattcattatatataaaaaatttctttaaaatatcatgctcataaatagagtaagttttaattaacaggaaaattgtttcatatgttattatctttaccaaaaaataaaaatcaccaccaccaccaccaacagcaacaacaaaaggggggggacataaaatctatataattttttttttcttgaaaactcagcccaaatggccacctggtgcttcaagacgtgaagtgtgaatacatgtttcacttggaataaaataatatcttttcttatttacatccagatttcaaactccattttaccttgaacacaaagtaatgtgatttagtgtgaggaaagaaaggaaagctttttctatgaaaatgactattttatggtattttctaataattaggtcttataaaacttccccaatgtttttactacaatgctggtagaccacagccagtctgtcttgctccaggatttctgatgatcttattccattaaaaaaaaagactccacaagtcttgaaaactaaactatattagcatgtagttttgggttgatacaaacttctctcagctgcattcccattagataaaactgaatgatgcattggaaacttggaaattaaaaacatgtatctgtggcagaaagataatactgcacacaccatttttctttttgctgcttcactaaatcagttgatgctgaacacgcaataaggtgtataggccaggcccacagctccttttggtcaggtgcaattaggaactaatgttaactgtcttctaatgcgttacatcaatagtacatgaatgagtaataagctctaacttttgcaaaatatgtgaacaaattgatctactactcacaaactcattatccaacaaatttatttttgccctcacaaaaaataaacttataactgacaaaaaaataaaaaagaaatctgatttgatataacaggaattttaggaaaattaaagcattactaggagattcaaaaacggcttcatatagagttgataccatataaattgggtctatagaagcaaaagcctatagacatacaggaagctgtaattaaggtaatgagactagagctcaagtgaaatatgggcaaaactgatgaataaacctgattaagccaaaatcacagagggttaccagtgacttggttagaagtttgaacattttctaggcatccaataatgtggttgcgtaggcacaggaataaaactgagtttggttttggatgatggactttacctaaggtgggtcttgttgcttttaaaatcatcactcccttataaagaaaaaaaaatctatgcagacatcccaaaataacattaagacactgggcttcgacatcagtcctggattcattcaaatccaatctctacttcctattagttatctgtataatatgggtaaattcctttctctcctcaacagtttgcttctacattttaatgtacatgtgaagttcctagcccttaataaagcaattgtaaggcttaaataagaaactccaggtaaagtagctggcacataataagctcatattaaatattagctattttcacaaactgatcaggtttcttttcttggactgccggtgacacagcagaactagtaatgtagattttaaagttaattgaatggaggtaaaactaggagactgaaaacttcttctacatgttcacttgtcacccgtctgcagaacagaattggagaacatccataataacacaaggaaagagttagcagagcagataaggtatacgatatagatgatatggatatacttatagatggaatatcatactaggaagctgtcccaaattcatagaaatgaatctttcaaaaggagaggtgtgaaattcactctgaaattcaattagaatataattagtgactgttgagaatacagttttgatagaataaatgaggcagaagacagcttttaagggattaaggagaaaatggatattaagaaaatgtaacttcaggcatagagaataacttcaggatgttttgcaattataatggttataatggctcaaaacttgccaagtcctgcactaaatgtttcaaatcaactaattcatttaattcttgtaacagtcctatggtatgaatacaattctcactttcattttctagatgaggaaaaggctcagggatcttaagaaatttgcacaagtttacacagctaaaaagtggcaaggttagttttgacccaggcagtccagctccagaacctatgctgtcctccctactgttcacatggcttctgagacaagagtagtgatttaaatttagaacatgtggccaagtcttttaccctaatgtggcaaaatcaggaataaaaaattaagtgttttagtattcattttgggtaaatttctatgagtgcgcttgaaaacagttcatgaaactgagaaaaacacaagtgtaagattaccataatacaaagcatgtgatcactttggaaaggtgtatactactatggaaaaggtataggcaatacttctagttagaatgatttggaaaaggtttgtaggaaagatattttaattaaattccaccagaggaaaagaaataatacagcaattttgggaaattattaacagaccagtggttggagattgagataaatttggaaacttgagaagtatgtggttgaaatgtgaccatggacagtcgaaagtaccactgttgaagtgttttccattgtggaatcttaagagaagagcttttatactttagggcagcagttctcatagtgtggttctcagacatcagaatcaacagcaactgggaatttgtgagaagtgcaaccgctctggctgtactctagacctacaggatgagaaactcagggggtggatcccaacactccctgttttaacaaacctctaggttattctgatgcatgttcaagtttgagaacccttgttttaagggatgtggttgccattaagtctattcaccaaagttccattcttttattccaggctcctgatagtatcttttactctgcctacttgtactttgatatggccatgtgacttacttcatcaaattaaatgtgaacagaagtgatgtgcgccatttccaagcagaagctttacgggttatcgtgtgctttcacatgttctcttgcgttcttaaagtttatattgagatgacccttctctcagcccaggtccttcagctgagtacaatgagttgagacgcctaccaatctatagtgacatgaagtttggcgggaagaaaattctattcttttgagtcgctgagatatcagaattattcttatagatgcataatgtagtgtatcctgatttataggggccatggtacagagaagggatctatttcatggtaaagagaacatgtgtatcaacagatttatggtatctatggaagaggaaaacatgggaatcactattaaacctcagaaaaaaggatcatatattgtcacataaataagagaggagaaagaacagagagaaggagaagttaatgaccaccaacatattaacaatatttatctttcggtgtaagaattttacatgaatatttactatattattatttaagcattatataatcataaaatagaaatgaatattataaaagcataaagtttatgacacaaaattggcctcgaatctcatcttttggagggcataaactcatggaagactttcttaattagaccattttgtgagtgtatttactacctcttgatctgtatccatgtgtaggacactgttttaagtacttcccatgcgttatttctatgatctttctcatagacttgctgggtaaaatttgttatcccaaggttggcattgaattctcaagtgtttacataacatgccctagattatacagtaagtaaatatatactcatggattcaaatcaagttatttatgactctaaaacttaagttcttttcattatagcatgctgttgtatgaagatttatctgagtctgtacctacccagatataggaaggtgtgtgtgtacgtttgtttaaacaagttagtatatttggtaacctttagaaaataagtgactcttgtatgtgccgagaaggaggctggtgatttatgctcaatgtcatagtgtaatagaatctgtaataatcataataacgcaagaaaaatctgatgactggacatagctaatcacacggatattgccactaaatgtacttccattttacaataaagcgatgtgataaagaatcatgactctttgagagggcaacagcgctgacatttctaggtcaaaagttttcatgagattatggagtacctaaacatgtacaattagcctccagatgttcacacatctgcaatatattttttcaaacctttgtcactcactgtcagttaggattcgaaacatactaaagcttttctccccctttttaaacacaaaatcctaaaactttaggagccagacttggcacatatattgttgtcgttaaggtgatatccatgagtccataagacgatcaacaaccttatctgtctgctggattgtacaaacagaattaatagctgccttaagatagagtttggctgaacgagtagtacttctgggcatataaatggacttcagagaagtccatgaattttctggtatcatatgcaaattcttttgtgtttgtacaaatgtgcatgagagggtccaaagcttttgtcatatctctaattggtataataccaacacaatatttggttgcatagtcctgtgaatatactaaaaacattgagttgtatactttaaacagatgattgtatggcatataaattatatctcaataaagctgttccattttaaacatgactagcctagaaccttttaaataaacttgttaggcaaaagttgaagccgcttgatgtttatgttactattagattggtgcaacagtaattgcattttcttgccattgaaagtaatggcaaaaaccgtgattacttttgcaccaacttaatatatttttagaatgtgtgttccatgtcaaatggtccaactcttgactcaatcccaactaatgacctgttcagtgcccttgactatggtgccgtacacttggctatggtcatgccactatgatgacctggttacacagctaccacccattccctttggtaacagataacacaccattctgatattgtcactgcatcttctggcttgtatcactctacagtaatgacacaatccaactaatatgtcttttatttttaggaggaaagaatgatgtgtttattccgttctaaaataaagccaatgtttttattaaatattcttcgtgcccactgggatgtgaatgccaataggataaaatacatcagagaagcctaaggattccatgagaacaaggaatcagacaagtaatcatgtgccacagatagactcagctggtggaagtgaaaatattataggtcaagatgcctcataggtaagaggaaaaatgcgaggtagagaagaccgggagttaatagtgtaagtttaagctgctgggcaaggccgaagcatgaaatattcagaagggatacacagacacccaagctaaagctcatctggacaatcacaagggtttagaggagagtaaatgggacaaaagaatcaggaatgagacctaagcaatgagaaaatgggaagtaaattatgaagatacaaggcaacacagacattgggcagtaggtataaggaaaaaggctggggccaagaatcaaggctttggcctgcttcccatatgtgtgatatttgacaagtaagtaatcttttcgaaattttcatgttctcttctgtaaaattgttacatgaataatttatttaatcctcactgcaatcctacgatgtagatactattatgatccccattttacagatgaagaaacgaaggccaagagaggataagtaagttgccagagatcacactgctagtaaatggcaaaatggagattcaaaccccattaggctggtgctgatgataccctgtctcttcctctgagtccttcgcatttcagtggacattgttccaacttccacctgccagctcctgcatctctttgcctactggagtctgttcttccggagtgcatgcaatagatcaaaaatgctagggagtgaatgcacagcccctcccgggatctgccaacagatgaccagcaggagttggtgtataaataccttagcattctcatctcttcaaaggataagtctgaggtgtgtgttccacataattttcttcaagtccccagtcaaattgagcgccagttgtccaccacagtttaaactcttgaaatgtagtcttcattgactttccttccttctttgtctcactttatcattttcctactcatattccctagcatctcatcccaaataaactagaagggggaagtattctgaaaatcataaagacagggtaaatttaaactattattttattatcattattagtaacatcgatatctgagccaaaatcaaaaaagaaaggacccttatttgtactctttctggttaggattctaaccatgagtgttagaatgttgttggcactgaacccatagttacagtttccaataatttctgaatgccaagaaaagtgaccgtggaaggaaagcagagtttttaactctgtggaatgtgttcagtgggtgaggaatgggaggaagttctattttgctctcagtagaacattaaaaatggcttcctctgtaaagcattctgtggttcccccaagataagggcaggtctgtctgtcataaactgccatagcacccattacttatacaactaaataaaatagtattgagtgatgggtggttagtctctccaatgtagctctttttcaatgaaaatagacattgtgtttcttccagggcctcacacagttccctatatattttacataaaaaaatatatacctaaaatatttggtgcctaataaatatatagaaactatgctaggcacagggcagggtgtggtgatttagctagactatttaccctgtcctcataaacacacaaaatggatttaaggaacacatattcatctttaaaccctctctcaccagctagtaagcacactcagggcttttcagttaccctctacttacaagctatttctgaatcatttctgcaaccatcttctaggaaggataaccattcttacaattttttttttttttgccattcctccaaagttgctcttttgaatattatcaaaacttccaatttgccaaatctaataaactattttaacccacatcttacttaatgttttcagtggaatttagtacttaattattcctctcatgatcaaccctcccacctctctgccacaacctttttggtcttcctagcattgtgtgatcttggtgtcttcttctcataaggcatattctctcatggtttcaactgttaaatatgctaatgattaaaaactgtgcacctatctgctcaaacctcctttttaaggttcagattcatatacatggtggcctagtagacattttaccaaaagcacattaaattagacctaagaaaaatgaaatccatcttctttactccctccctccaaacctcgttatttaaactggacttctgttcacttgtgtaagacattatcatacagatcatcctagcatacttcacctccctatcctgtcatatctagtcattccttaagtcccatcaatgaatcttctccatcccaatcaatcctcttcatctgctttgtcaatactctaggttcaggatataaacacttttcatctggactattaccagtctccgaaaagatacaatttttctcaaatacgtatgattttagaagagattaccatcaggatcattggctcattatcttcagggcagtgatgcggggtgggagagttcttaaaggactgtattctacatgtgattatgagtcaaattttccagaccactgtagacacaatcttacacttcactgtttcacgcagctatgatacctacacaacaactgtaaggatgtgagtttgagatgtagattgttattgcagactaacaaccactccttgctaagtttgtttcaaaatggacttaagggggtgatctcagttgtttttggcaagaaaaaagtaattggcaagaaaaaagtaattggcaagaaagccagagaaagagaaagaggaaatgtttgttcagcccatgaatgagtaacattacaatgctttttataacttcaaacattcacccccatacaaatgctctataaaactattgtcatgatgatcaatcagcattttaagttgaaacatatatatccaagtttctgatcttgttctgtatcaacacagcactcacagaactcaggaaatccctatagcctccttagcttccatctttctcttgtcttttgaaataccttaaagcacaaaagcatattttcaggcaaaggtaaaaataattgtaggaatgatggtttcacagacagggtgtcttcagtgacagttaagttcctatggtgagacactgtaatgagttcaaagtgtttacagcttcaatactgcttgtcaaacactccttcaatgcaatgaattcttggctacaagccacaaatgtgctttgagaaataaaaagcgagtgaatatactggtgtttctattattggtccagctgagatagttgcttttttattcttaataaaagttttctcgaggtagtcataatttcaaaaccctgcttatagtaatgaatcatggttatttacaaagtaattcagtttcactatgatcacgatttgtataagtaatgtagtcatatagtcgaagacttttcagggatgttttctgtttaaactgataagctgcaaaattctgtattttccttaataaaaatgtttcaggaaaaagacagcgaacagctagatttgaagagtaaaaataaagaataaagccagtaggaaacacaaacttctagaacttttaaattgttaaacatctttgtggaagtaactaccattttcaccaaatctgcaaatcatattccaacaagttgtaaaaataagccataattcttagaattgaaagtctcttatcattctacaggtaataacatgacttggtcctgttctctgggtaatggagtaaaatgttactggcatattcccatgtttagacagatttgcaaatagccccagagaattccattcctaacctgggatatgttactcaaagacgttctatctggagtcaagctttcatacaagaatcatagacatacttcaagggatccatgaacactggaaagtatatggaaactatgttcacgttttttatttttcaagaaaatctacaccatccagcagaatctcacacagatccttaattttaaaatgagttaagaagcagtggtctagggcaggctatggttctcaaagtgtggatccagaccagcatcagcgtcacctgggacctttttagaaataccgaatttcaggactctcccagacttacttggttagtatctcagggagtgagacccagaaatctgtgttttctttttaatgtttaatcgacacataattatgcatatttaggaggtacagagtgatattttcctatatgaatataacatgtaataatcaaatcaggctaattatcatatccattacctcaaatatttgtcatttctttgtgttgggaagtttcaaaatcctctcttctagctatttaaacatgcacaataaattactgttaactgaagttaccttacagtgctttagaacactagtacatatccgtcctatttagcttatcattttgtatctgttaactagcttgtccctttcctccctctcctccctcttaccctccccggcttctgctaaccactattctactgcctgcttctatgaaatcaaactttttagctctaacatatgaaaacttgtgatatttatctcttcgtgcccgacttatttcacttaacagtatccaggctcatccatgttaccaccaattacaggatttcattctttttatggctgaataatattccattgtgtttatatgccatatttttaaattcatttatctgttaatggacacttaggttgattccgtatctcaacaatctgttttaacaaggcctccagaaaattctgatgtgcactcaagtttgagaacctctaatttgcgcaacaattttcaaatggattttttacaatgtctcctcaaattttgattcagttatgtttgggaaatatattttaaatcttcccaggcaattctgaggattaacctgtttgggacagctactccagggcaaagctactcaaactttagttggagaacgagtaccatcagcctcacctgggagacagttgtggctgcagaatcttgcccacatccttagacatactcaatcaagcgtgagagtgagacctagggatctgtgttttgctgggtttatttatttacttacttactgtatttgaaacaagatctcactctgttgtccaggctcgagtgcagtggcatgatcatgcactcactgtagcatcaaactcctgtgtttaagcaatcctgatcctcccgcctcagcgtcccgaatagttaggactacaggtttgcactaccacacctcgctaattttttttttaagtattttttgctgtgtttctcagtcttgtctggaactcctgggctgaagggatctgcctgccttggcctcccaaagtgctgggactacaggtgtgagccaacatgccggggaggaatccgttttaaccaccaccttccctgatgactctgatgcaggccacactttgagagcaaagcacagccacagaaaaaattagaaaagttgactattcatgtgacacaaaggcatatagctatgccttctatatgtaggctttgaataacttttaataatagtaaaaaagccaggatagcttttaataatggtagaagctactctttatttggtacttactatatgacaagcacaatggtaatacacgtatttcccttttatccttaaagaaaaagtgtaggccaggtgtggtggcttacacctgtaatcccagcactttgggaggctgaggcaggcagatcacctgaggacagaagtacgagaccagcctggccaacatggcaaaaccccgtttctactaaaaatacacgaattagccaggtgtggttgcggatgcctgtagtcccagctactcggggaggctgaggcaggagaattgcttgaacccgggaggcagcggtagcagtgagccaagatcatgccactgcactctccagactgggtgacagaacaagactccgtctcaaaaaaaaaaaaaagaaaagaaaagaaaagaaaaagaaaaaaggaaaactgcgagggtggggcatttaatcctgttatacagataagaaaactgaggagcaaaaagtttaattttcattaagtaccatagccagctggggtatgagtccagtttgaaagtttgtgattttaataattacatctacagaacttcagaaaatatattttgaaatgagtcttagggctaggtaaacccatgcattacatgtattattaaagggaaattaagaatgatatctcaaaccataaatgatggtattaggtaagtcagtaagtatatcaacatgcaaattaaaacagattatcaatacatagggattgactaagtataatatggcaaccaaattatcccagaattgccctctcaaagtaacaagagcttatacatgtgaacaaattttacacattctgtgatgtaaaaagactgtgtcatcagtcattgcagagaaccaggcagcaagtcacttccttacaattgttcacagctctctgattagctactttgcctgaagcataaaacataagcacattcttcctcacctctatgggtactaactggactgtttaatgtgatggagtaattaacagaaccttttctcccattggggacctacgtggcaagtgccccattaggtcctaggtacatacagaacccaaaaaatagaagccaatgtggggaggaaatggaactcattattttatatgctatggcacgatttcccccctaccaaatttactagactgattagtaaatgtaagccaaaatctaaggtgtgattgaatcactataatatccatcccttgagaactgtgactcagcagataggaaaagagaaaactaatgtccaacatcttgtcactgacacttgtgaaattatcatttgacaaaccatgaaataatttggcaggaatccaatacaacaaatgagtcatttcattaaatacaattctgtctccccagctaaatggtatgcaatgataagatcaccattttaatagttatctagaaatagatgcctaaaattctttcctttatgactttttaacagccaacctgagtacaataatgatattatccagaatttatatggtcaacattcaattgctcacaaggttattaaacagtttataaattatcctgttttcttcccctgctctctgctcctaagaattacatttcttattagaattttcctaaggaaatggaaagaatgaatggaaatgaagtggaaatgttcaatatttcaagttcttaacacgtttggacattatttgaggatcctggctaaagccaagatttgctgaaggcttttagggttcccagttgctataatctctttaagactctgataattgaggtagacaccaaggcagaactacgtaaaattatcatgtctgtaaacaacaaaaaaatgacacacaattaaaagccaaaaaactcattattgaatcaatagtgagaatttatgtggctaacaccacacatagcaaaaaagatttgatgttaggtattaggaattgcagctgttatatgaaccaatgaatcacaatttgttcatattaagacataggtagttatatacagttcactgatcttttttgaaatgtgattgtgagccatttccattggatgaaaaaacagacgccttgccttatttgtcacttttacccatgaaacctagtacatttctacatatatagaagacactcataagtgtttattgacttgtgatttacaacattaagaataaacagagatttttccctaacggaaaatcatgtatattgctacatttatgttaatcataaactctatgaaaactagcatagcattagagttagaaaactgaatcatgtctatcattttcaaactctatccatccttgagaaagctagtttcttcagattaaaatataaatacatttaaaaattctgacaaaagggagaaaaacttcccgtgtttcatatgaagttaggcgaaatttgatttacatttggaaagaagagaaatccacttattttagaagtaaatcaagaaatgtgcaaaatatctatcaggtatgaatttaaaatatgatattcattcaataatttataacagattgctataaatcagatacctgtattgtatttcttccctgtgtcaggttttggaaaccacagagaagtgcatatgacagtgacaggaagcagagccaaactcctaggcagataggggtgggtacccagtgaaaccccacttccaagctgaagacagttaaaggcctgaaagccaaactacaaatcaaatccttgcagtggattgagaacttgtcctcctatttggtgtgctttcctctgattgatctccacccttcacctattttacttatacctactgatatggtttggctgtgccctcacccaaatatcatcatgaattcccacatgttgtaggaaggacccagtgggaggtaactggatcatggggtcaggtatttcccgtgctgttctcatgatagtgaataagtttcacaaaatctgatggctttgtaagggggagtttccccacacaagctctctgtctgctgccatccatgtaagacgtgacttgctcttccttgccttccagcatgattgtgaagcttccctagctacgtggaactctaagtccattaaactctttttcctgtataaattatccattctctggcatgactttatcagcagtataaaaacaaattaatacagtgaattggtaccagtagagtggggtgctgctgaaaagacacgtgaaaatgtggaagcaactttggaactgggtaacaggcagaggttgcaacagtttgagagctcagaagacaggaaaatgtgggaaagtttgggacttcctagagacttgaatagctttgaccaagatgctgataatgatgtagagaatgaaatccaagctgagatggtctcagatagagatgagcaacttgttgggagcccgaacaaaagtgactcattatattttagcaaagagactgggagcattttgctcctgccctagagttatagggaactttgagcttgagaggggtgatttagcgttatctggtgggagaaacttctaagcagcaaagcattcgtgaggtgacttgggtcctgttaaggcattcagttttaaaagggaaacagagcataaaagtttggaaaaattacagcctgacaatgtgataaaaaagaaaatcacactttctgagaagaaattcacgcccactgcagaaatttgtataagtaacaaggaactgaatgttaatcaccaagacaatgagaaaaatgtctccagggcacgtcagagacctttgtggcagcccctcccatcacatgtctggagtttaggaggaaaaaatggttttgtgggctaggcccagggtccctctgtggtgtgcagcctagagacttggtgccctgtgtcccagccactccagctgtgactaaaaggggccgaggtacagcttgggctgttacttcagagggcggaagcccaagccttggcagcttccacgtcgtgttgagcccgcaggtgcacagaagtcaagaactgcggtttgggaacctctgcctagatttcagaggatgtatggaaaaacctggatgcccaggtagaagtttgctgtaggggcagggccctcatggagaacctctgctagggcagtgcaaaagaaaaatgtggggttagagccctcacacagagaccctactagagcactgtctattagagccatgaaaagagggccactgtcctccagaccccagaatggtagatccactggcagcttgcaacacacaccgaggaaagccacaatcaatgccagctcatgaaagcatccaggagggaggctgtaccctgaaaagccgcaggggcagagtggcccaagaccacgtgaacccctctcttgcatcagcatgacctggatgtgagatacgcagtcaaaggagatcattttggagctttaagatttgacagccctgctggatttcagacttgcatgtgccctgaagcccctttgttttggacaatttctcctatttggaagggctatatttacccaatgcctgtaaccccactgtatctaggaagtaactaatctgcttttgattttataggctcacaggcagaaggaaattgccttatctaggatgacactttggactgtggagttttgagttaatgagggaatgagtaaagactttggtgcactgttgggaaggcaagattggttttcaaatgtgaggatatgagatttgggaggggccgggggtggaatgatatggtttggctgagtccccacccaaatctcatcttgaattcccacatgttgtcagaggatccctgtgggaggtaattgaatcatggggacaggtctttcccatgctgttcttgtggtagtgaaagtctcacgagatctgatggctttgtaagtggagtttccctgcacaagctttctttgccctctgtcattcctgtaaaatgtgacttactcctccttgccttccaccatgattgtgaggcttccccatccacatagaattgcaagtctattaaaccctttttgctgtataaattacccaatctcaggtatctctttatcagcagcatgaaaacggactaatacacaagcactgacttctccctgcttagaacacctttccatccccacctgtattttcctccctcatgcctttaccctcttccttctccacaacaagctagtacccagacttccatctaaatatcacttccttcaaaaagacttcatttcttattcctccagatacagattccctgatttactatttttatagcactctgaattttaaatagtacacatcaaaaataaaattaaactattatacaatcataattatgctggtattcctcaaaagacaatatattccaagacatgagccttttcttatgtcttcaataaattcattcaggcctaacagaacactttgcccataggaggtgcttaatgaacatttatggaatttatagttcttccagatgtggttcgactttgcattgagtctaccttagaaatttgtttttcatactcataaagatttcctatttgaccaccacaaaccctctgcactgccactcatagtaagccacacagggagtatactccaaccaagcttcagtacaaattcttccctcagctgtgggtgttctataacatttaattggctttcttaaaatctgacacaaataactaaagactcttgatgctttgtcagagcaaaggagtgtgaaaccattatctcctctaaatactacattatactatactttgtatcatatttctgttaatttagcatttttagaatatttataatacaatgttagttctccctttctgtacttgcgtctacatgttaatatgttcttgagggaaggaaccgagccttattcacctttatataacctagcaagttgaccacatggttggtgttacataacaagccattgaaaataaagcaagcaagcaattaagaaggtaccaaaccctgctcaattctattttgtgggttttgaccccgtgatttagcctatcatgaaaaattctcatcttcattttgaccccccacccagatttgtgccatctgcaaaattgaaaattacccctttgctgatgttatgtaaggtattgatcaattattcagcagcacagaacctgtggtagcttactaattataataaaacaatatttagagttgctggtcacttaatatctaccaagcacctttttaaatacttttacatgtatgtaactacatacatacatgttaaacttaaatattttcaaaacaatcttatcagatggatacaattatcgccattttacagatgaggaaactgaaacacagtatgactaactttctgagggccacacagcttttaagtaatacagctaggattcaaacccaagcagtgcatctcaagatctcagacttttaccactctgccctcctgactaaaatgtgtattctatatacagagctcactctcccaagtcaatatggttattaattcctctgccaactctgtcatatagatcacttatcaccatcttatcccgataccatagaaccttagccactgttttactcaaatagaaataaaccattaaaaaaaaaaaataggtgccacagtaaaagtatgatctcttcaacctgatgagaccatcacaaccagtctcaaaacttcttttctgaagaacaagctattaatttagatgaatgagtcaataacaaacttatcgcagatttaaacatacagaaattttcacggcaaatctgtaaaatatgaggtcaataaatatctaatttatactcaatagcatttatactgttatagaaatgatgcaatatacaagacacataactgtacataacaccctagccattaaatcattgtgcagatggctcccactatcattgtgacttctgtgcctctttccccatagtgtttgccaagccataagctgatattttattttaccttcagttctctgtacattacagcttctctgcctgcaacatccttttcatctggctcctttacatgtcaggtaagttaccactgccccttcaaagcctttccttacggcctgagttttggttcaatgcatgacctgactgtaaaacactatttcccacatcatgtatgtctttccctactcatcacattgctgaagaattgcccatgtatctgcttgtctcccatgataaggacaatgtctttttcctttataacataatgaggagagctcaataatgaaagctcaactttttttttgtatgggtgaatgagtagttctaagtaaatacagtaaatttacttacagtatcaatttcaaagaaattctctcctctaaaaatattgtcttcagacaaggaaaaaaaacacaaaaaacggaacatgactaaaatcttaaaggaagatacggaagtgagcacacaatccttctgaagttaaaatatttctataaattcatatagctgtattctaaatctttttggtaagaatccctgaaatgtattctgaattctaatagatgaaaagttccctgtgggcaggtaatgtgtttactccaactaagagcagcccaacacaggaatatttgctctttgaggagtaatacatgttttataactcaatgatgttttcatattcttgagttcttaattacaaatattttcaaacaatattcaattatttgcttgccaggtataaaatataagttaaatagcaataaaaatatcaatggtttgaatttaataacatgttttttccttagcactatattttctaaatagtattagctacttaattaaacttttcctcaattgggaagtgatcaagaaaatggttgtgtatcaaaaggcagagtaagtgaaaacaagttggttacaggaggaagcagggtatgggtttcgcttgtgctatattaactgctccactggagcaaactaattaatttttcttcattgcactgtaatcagcaagcttaatctagggcaaagaagaatacaattgtgattgcaaatattaaggtcttactacctgtcattcagttgcagtaactacagaaagtctattcaataattaatgtgctatggctattggctttgttttgttattgaatacatttattttaagcagcattaagcgcataaattaaatcttagtaacattttcatataagtaactatcattaaaatgcatttgttccacagaagaaagaattatctcaccattccggctcaacaagaaattcagtcctgaacagacaaaaaagtttaaaaatattttataaacattaacctggacttttcgtagaagaaataaagctgagaacgtcatatttcagcagcttcaatacttgttttctgattgaatcataaatttcattactttatacttgcttctacaatgacaaagtacccaaagctaaatgtgaatgtctagtaggtcagaaaaatgtgtagtcgaatatggtttttgatgacaataaaatcgctaaaaaccaaaagcattcagagagtgtaagagaacaaacacatctcttcaaatatttaaataaccctatgggcaacttgatatgatgtcaatattatatgtcttacgcatctagtttataaaagtcatcaggaaaaaaatacaagattaatctccttgtggatcaatttgggaaacaaatgaataaaaccacagatctacacatagatagagggacattccaaggacaatcactacttcagcctttaatcttctggataactggtgaaagccttggcaggaagcactccaagctacttattaaaaaggtaagaggatgttcttatggatacaatcaagtatatatcaaaccatatgctgtcacttgccccatctacattttcccaactttacagttagaattaagtgatgcaaaacagcttaagagaggatctgatggaaagcaaagtgccctatatccctccacagctcatcactggtttgaagtcaggccataagttcatggtgacatgaaattctcttcaagaccaaattagtcttcgtcagcaagaaattccctacaattcagggtttaactcttaaagagattagctccattttttttctaatttcgaatttacttaacatgacaaattttatatatttatagtatacaatatatcttgataggcatatacatttaaaaatggctcaatcaagccaattgatatatccattacctcacatgcttgtgagaacatttaaagtctattctttttgaaattttcaagcatacaatacattgctattaactatagtcttgttatatacacccaacagttctcttgaatttccctctccaacctaactgaaattttgtgtaaccccattcttaacaagttatatgattcagggatataatagaaaatgttgagacatacacattctatctagttttagcccaactttcaaggctctccagaatttcctctactttgactttataatttttctttcgattctgatatggtttggttgtttcttcccccaaatcttgaattgtagctcccgtaattcccaccatgtcatgggagggacctggtaggaggtaactgaatcatggcggcaggtctttcccatgctgttctcgtgatagtgaatacgtctcacgagatctgatggttttatacaagaaagtttcccggaacatgctttctcttcttgcctgtctccatggaagatgtgactttgctgctcatttgccctccaccatgattgtgaggcctccccagccatgtagaactatgagtcaattaaacctttcctttataaattacctagtctttggtacgcctttattagcagcatgagaacagactaatacagattcctttataggtttattttgaacagtagatgcctctttgtattttgcactgtatcccatcaacccatctctcatttttgctgcagttcctgtttctgctgttagagggttaacaccctttcacttcctagctctagcaacaggaggaggaggaggaagaggagggaggaaaataaattgtccttcaaagggacatttctgaggacagttctataaggttctataatgtcccaggcaaggttgaggtacagttacctattatggtcatcagttcaacaatgttatctttattagcttttccttcttccttgtctcacttttccaggtcccacatgttcctgagttttcttactagtttctttgataatcagccaatcatggctttctgtcaggctttgctttgggggaaaactcaaactgacactcttgactattgctgtcacttaaactgaactcttagagagcagtggtgatacattttaattctttagctttaggggccagagagggaagatgatgcagacttctcaagctcacgcagctctagatggcagagactgcatttaaatccaggtctttctcctccctgcgtgttgctacatgccattttggtacctctctacaggcttgccttccataacctttcaaagttcagcattctcctactcatccaaatgaacacagtagtcatgttttattccatccacttgataaaataatgggtcacagcacagcacttgatccattgttattcaacgaccaagactcttgagttcctgtaattatgtaacaagccccttaactgtcagtggtcataaaggcaagaatctcagacttcggaatcaaaccccccatttactcttactgcaatttgccctcacacaggtattctcaagattacgagataacaaagtgtaagagcttagcacagtgcctgaaacacaggatgtgttcaataaagggtggctattattttcacctggagcaaaacgaccacaaataggggccatgtgctccgcagcatcccctgcctgtctcccaaagccagaacaatgagaccaaataggcgtccacaaacaaaacagacatgtaaaatgaaaaaaataaaaaagataaaatgccctcttttacttcatctgtatgtttttcctatgcccatccctcttctctatttcgaaacatgctctcacattgttttgcaactgggaatactcattttatcttatccaattctaactatctttaagtttcagctcaacttctacttctggatgtttcctattttccatcacagcccttgttgatttctctcatatatttctacagcattcatacactataaagtgaaatttactacttcacaaataattttacttcagacctattgaactattttggtcagtcctgactctcaagttacactgaaagttgctagaaggaaaggatcatttctaatttttctctggggtcctctggcacaatactaaacttatcaggcactgaatgcttaatcctgtagacaaaatgtggaagtaacaaagacaggactcaagaaaaacctaatttactcttctctttctcattcccccttagatgcatttctatattcaatgttcattctgatttccaggtagcactttccccactttctttcctagcttaatcctttcactgctcagcaatatgcggcacacctggcaacatgggagagatgagttagttactgcaaaattgtttgcttgttctcttaatgccttacctcaatttctctatggcaataaggctatcatatccaaacagaagaactaagctaaatggattcatcatttcacaaagtgattctttagcaattttcttattattttatatatttttggtttcatatataatgctacctcagaaattcagatatgcaaagtttaaaactccttttttaaagtttcagagagctacaactacagacgagataagctttagcttgatgaatttcatactgactactggatcttatgtttaaggcagatgcaggtttttcttggggggggggggggggcgggggaagacccaggcaggcccatgtgatacatttcttcaggattctaacaattttccactcagaaagtagtccctcaggaaattattaactgtaaaataagatagaggataaaaaaagaattctgaagcagaaaaatacatggaatcagaagcaaagatgctgaataaatctgcattgaaaaatggaaagttcctattttgtgtttatattatacttttgactcttgtaattattcttcttaaatgtcacaaaaatccccccaactattactattccactgctatgtatgtggagatgtacatacccaattattaggtaacgtacccaaggatcaattagataataaaagaaacattactgtaacacaggacttctttttacactaccttctattaaaaagaggagacataagtatgtgaaatggaatcagtatgccacatagtatttaacagcattattcaattgtcatatttgttagtacctcatgataaatgttaggcagaaagccttctctatctctcttcaccttccagggcaaatatctgccctactttgttgccacagagaataaattttccatgactgcaagctctattgaaaatagaagagaaatggaaaggtccagaatttaaaggaactgtatctctctcccattctactgtatgtcccttgagattagagacatttgtttccccagtgccaatcagagacatgatacatagtgttcaataaatgcttggtgaatgaattggtgaaaataacttatgaattatggttgcaggagggaagaacagagtgatataatgttaaacatattcaggtttacttgcaaggaatgggaaactgaatacttcatatattgatgttgcatataggcatcattatgatcatttggaaattagtcaaaatgtctttaatgcataccttttgatctagctatcctgggttcctagcatgatacctcatatataaatgcacactcgatagctttttgtacctcacataatgacatgattttctataccttgaatatgccttcctcttatttcttcttcattggtgcttttgccttgctatttcacctggaatgctattcttccctatttctacctatcaaggcctttctctaaaatatagcccaaatgtactctccgggcattatttctctctctctctcaagtgattgcaatgcctttttatttgaactctttggactacacttaaatgttatcaactcatgtccaagatgtttacaagtgtcatttgttcctgtgactttaataatgttgtctcctttttttgcagcgtctatttaattttatctcttaccataaacccacctggcctatccagggatttcttcaagaagcacagctactgtatggcacattctacactaaatccccagtatataatctgctcatttagtgataaatcggtgatgctcttcacaggagactgaagagagacactcagaagtcttagaattgtgtgcttctagaatacaaagaatttccacaatcatagagtctgaggacttttaatcattactattttcacagcttttggagtagacagactcagtccccagaaaaatggccaatgtaacttatacacacacatacacaatgatgatgatgattatctttaaatgtgacaggtccacccagtagatttccatgtggaatcaaagtcagatgccataaatgactggagtggcagagtctgtcagtggagttacataaactgtgtgtatggcgagtgcagctccagactgaacagtaatgtgcccgctttgagggaggagagtagcactcctcagtactaccaggatggtgccattgcagaatgttgccccagagctgctagatctgctaacagaaacccaaatctgtagtaaggtgtagatcaaacaaaacatatctctgggttccttccagactttccattaacagtttataacgtcttctgaactatctgttcacatacttaaacctgagtcctcgggctgggcatggtggctcatgcttgttatcccagcactttgggaggccgagatgggcagatcacaaggtaaggagatcgagaccattctggctaacacagtgaaacccagtctctactaaaaacacaaaaaattagccaggcatagttgcacgcgcctgtaatcccagctactcgggaggctgagacaggaggaatcatttgaacctaggaggcagaggttgcagtgaggccagatcgtaccactgcactccagtctaggtgacagagcaagactctgtctcaaaaaaagaaaaaaaaagaaaaaaaaaatcaaaaaaaacaaaaaaaccctgagtcctgactagctctcctgcaggagagtgttactgagttaagcaatcaggagaaatgaaactctatcaaccgatggtcacctattaacaaataagatggcatacttctgtactattgctattcatttatttatccattccacaaacatttttcacctaccatctcttcggcattctcctagctactggctatacagtactgaagccaacggacaaagtccttgacaccaaacattctagtaggggaagcagagaagaaataagctagataatcaaacaaggtaatttcagataatgatgatgattttaaagcaagaagtgtgaataggatacaggaatggctgggagggctcatcaggagagctcttttacatatggtagactgcaaaggattcttctgaagatgagacctttcggctcagactgaatggcaggaagttgtcagctatataaagagggagaagaagtatgttcttgcttgaccggagcctggtgaagtaagggaaccagtgtgaagtgagatcaagaagcaagcaggggacagatcacacagggtcttgctggctgctttcagactccagacatttttctaagtacaatgtagagtcttcagaaggtgttaaatagggaacacatgacctaattaatgtagtaaaaagataactttgtataatgcgaagaactgagagactgcttaggaagttactgcaatattaggaggctatggaatatgatggagtgtcagtggtgcttcctttgaataaaagcagcttttatttttcaattaaaatgtaacataattggtttcagtaaaaatgtctcagttgaccttatttctcctgcattaatggggtcatttatatgatatgtcaggagtgctaccgctgtacacaatgaacagcttttttcaattaaaacgtagcttaattgacttgaaccagaaatgactcttgacatctttgtattaataggaccatttctataatgatcatgctaattaatcttcttcattcaaaagtattgtttattcagaattatttaatacaatcgttatacttttaaatcattttaatgttattaaatattatctcaggatcttgaagtctattggattgttatgctgatttaaagagtgcaaaaatatttatagttatgttttagtttaaagcagtgattaaatataatttgcctgtgaccctgtaggccaaaataatgtatcacgataaactgtagatagtgtcagagatgaaaacagtgtttgtctgctttagtgtattcatatgtgaggatgaattttggcacttgtcagcctatgagaaattactactagactaatacttgtcagtacagtaacaactcatcatgctctaaacaccactaagggagaaaagtgatgaataacatacaaagtaaaaattttcacaatcacattaatgactctagttcaaagcacagtaatggtctaccaaccttattgtccaatctatatttcaagtgtctaccttgatatctttcagaatcaattttacgtcaaattccaattaacatagaaaaaaagcagtagcgataaaaacatgtctctattgacttttccaaaagcaatcgtgctctccaaaccccagcctcatttactattactgaagcaaaacgaaatactaagagtactgtgtgcaaataaaaaacgtttgttgattatctgttaaaaaagaccccaaattaaaaacagcctaaataatgagtattacccgcacacaacaacagtatgctatggatttataaaattatcattcttcctaaactgataacgaaaatctttaaaatgaataaaatgttactaatatatttcacagtatgcactgaatggactacataattccatttgggtttaagttgaggttttttttttttccaactaaatggttaaaaattatgtttagagaacaatctggaaaatatatactcacagacaataggcatacaattgacaattgagcacaactacattaaatttacactataaaactcaatcatccaacacttatgaatccaaacattttctaaaactttacaagaaagcttataggtttttatcatggtaaaatatatataacataaaacatataattctaatcatttataagcatacaatttatcagcattaagtatatttaccttgttgtgtcaccatccccaccatccacctccaaaaattatcttcccccaaaaaacttcatatccattaaataactccccataccttctctcccccagcttctagaggccaccattctactttatctatgcattttactgctctagatagctcatacaaatagaatcatatgttatccttttgtatctggctttttccccttagcatatcatcatcaagattcatccatgctataatgtgtgtcagaactttcttaaggctgaataatattctactgtatacatttaccacattttgtttatccattcatcttcagatggacatttgagttgctccatcttttgctactatgaataatgctgctataaacatgggtgtacaaatatattttgaaggtccttttttcaattcttttgagtatattcccagaagtggaattgctggatcacatggtaattctacgttctatattttgagaaaccaacatatttgtttccacagtgactgcaaggttttacattccctccagcagttcacaagtgttcaaatttttccacatcctcaaccatatttattttctgggtttttttttttttttttggtgttttaaaataatcatcatcctaatgggtgtgaagtgctatctcatttgggatttatctgcatttccctaatgatcagcgatatcgattatctactcatggtcttactggccaaactttagagaaatttctgatcaactcatttattcatttttttaattgctgtttttctgttgttgaattctacgatgatataatttaactgtgtccccactcaaatctcatgttgaattgtaatccccaatgttggagttggtgtctggtgggaggtgattggatcactggggcaaatttctgatgaatggtttagtactgtccgcttggtactattctcgtgatagagagttcttatgaaatctggtcgtttaaaagtgtatgacatctccctccacccctcttgctcctgttctgaccatatgacctgccaggtcacccttccctttctgctttatgtttcctgaggcctccccagaagccgagcagatgccagcatcatgcttcctgtacagcctacagaaatgtgagccaattaaacctcttttctttataatttacccagtttcagatatttctttagagcaatgcaagaatggactaacatataggagttcttggcacagtctggatattaattccctattgaatatatgattcgcaaacatcttctcccattccgtaagttgccttttcactctgatggtgttcattcatgcacagaagtttttaatgttgatgcatttcaatttacctaatttttctgttgtagcctgagcttttagtgtcatatccaagatatttaattgcccaatctaatgtttatgttttcttccaaatgtctacgctttcttctaaaagttctgtacttttggccacgtttacttcctgatccattttgacttaatttttgtgtattttataagagtccaacttcatttattttaaatgtatatattcagtttcttagcaacatttgtggcttcattaaaaaatcattaaaaaaccttggcaaccttatggaaaattgtttgacaatatatagtagagtttacttcagggctattatattctattgttctacattccctttttttaagccaataccacagtgttttgattatggtagctttgtagtaagttttgaaatcaggacgtatgacccttcaacttcattcttttttcaagatcgtttcaactattcctggatccatgagattacatgggaatttttgatagagttgtctatttctgcagaaaaactaattgggattttcttagagatggcactgaatgtgtagtttgttttgagtaactcggatacctcaacaacaatattgagtgttccatttcataaacctggggttccttttcatttatttataaaaataaatgtttaatttctttcaggattgttttgtagttgtcagtgtataagtcttccaccttcttggttaattcctaagtattttactctttttgttactattttaaataaaattgtttccttaatctcctttttggactgcatcactgttagtgcataaaatataacttatttctgtatattgattttatttactgcaattgtgcttaatttattagttctagcaggttttttgtgtggaaatctctagaattttctacatataagatcatatcatctgagaagcttataaaatttttgcatacactctttcaaagctgatttttctgatgaaaatttgaaatgcattgcacagcatgaatatagttaatagagtattgctcatttcgaagctgctaagagagtacacttcaaatgttctctccacaaaagtctttgaggtgatagatatgttaactagcttgatttaattactccacattgtattcataaattctaccatcactttgtatgccatatatttatacaattatatattgtcaatttacaataaaaagaggcatataaaatttgcattctcttaaagtctttaatgcttgccaacaccatttctctgattcaattcaagctgtccaatgccgcattaatacataccattaaacaaaactactccgcattataggcatagtaataggattacatttacctggcttccaaccaaaagcaacaccgctaacattaaaataaaatattctcatcatgaattagtaatttcatattaacagaagctaaaggcacctagtattttttgaggctcatttgcatatgggtatatactcagatttcttttccaaaaaagtagccatttaaagggaaccctggtgtaaaatttagaaaacagatgtagaaaaatcataaaatatccaaataagtttttacaaaattttcctatgctatttcctttatattttctttagtccatctccatttatgaattattcaggaaaaaaaaccccaaaatgattttccgtgttatagaagatcatactccaaaattgaccaaaaagcttcatttgttaagactgtaagttctatatgtgccattaaacatacttactttttctagacttatagtcccaattctgacgtttatatccaatttagagtgtcagactatttcttctctcctctattttagaggcagtctgaagtctttcaacaagaaaattttgtaatgaggtgggtttttttccacttagtgtttgatcaggaacaaagcatctaattacttggagcccattttctcatctggaatattaagctaatgctattttgtcaataggatttttgtaaggattataactagtctataaaacattatgcaagtatttgattctactgtcacaagaaccgatgctttcaaaaatacattaattcagacctcaacaccaattagatatataagcatttatgtgttatacctgatgctcatctatatatatacacaccctactatgtgtctgtaaatctctgtttgggagaaaggtgcaatacaccatgctaaagaatcaattattttcataaaggcttaactattgataagagatatagatataacattgagtgtttcacaggagttacacacacacataactttattcaatttccagcaatgtttcaactaaaaatattctgtcaaagtcaatttacataatggtgagattaaagtaaaactaagaaacgtcagtggataccagtagaatatgacagtttattaattttatttataacacacaaaagaaaaatatgttaaaaaatgaatatgctatcttgcaaacactgtctactatggcagacactaagaaaacttatttaataacaagactgaaattagatttccgtcagatgctgtctttagaatttggggaatagagctattcatccctggatgtgtttcttggagatgtgtcaatatcgtaacaatgaaaaacaaaattgctttataccgttagatatttctgatacaatctttgcccactcgtgggtttcataaagctttgtgccaattttgtcaccaagacaagtgtatctgatctaacacaaattgaacacttttcagcaaagcattgtgtatattatttaattccccattcatatgtcatgaagggaaccagcatggttaccacaataaatttatttaaatcaacaaaattcaatgtcagaatgtatcatttttttctatggtatacttaaggttccattaaatttactgacattccttcattttagaaattataatcccactgggaccacgattttcttaacatagaattgaatctaatggatattttcctcttattgacttgaggtaattaagctccccattgagaagaccaccagatagttttatttatgaagctgatagttcctaactatggcagagacaggctgtcaaacaaccatgtcctttctccagcttttaaagtatagatttttcacttagaagcagccactcagccagccactgcattatccttgtagacaggcatggctatatacatgtttcatgagcacacatccccttcatgtggaaagtgaagggagcacatatgcatcacctctaccacaaggcttctaagaagtcactgtggcttttctgtatttgcttccccctcttcaatggctatatgaaaaaacaaaaaaacaaaaaacatcatcatctgtgaagaaggtagagccacaacaaaggcagaaaaatatagaaaaatattagtcactgtaattagtccattttcacactgctgataaatacctgccgagactggacgatttacaaaagaaagacgtttaattcatttacggttccacgtggctggggtggcctcacaatcatggcagaatgcgaaaggcatgtctcacatggtggcagacgagaaggtaacttgtgcaaggagtctcccccttatgaagccatcagatctcacgagacttaccactatcaagaaaacagcacgggaaagacctgcccccatgattcaattacctcccactgggccactcccagaacacgtgggaattcaagatgcaatttgggtggggacacagccaaaccatatcagtcaccaataaggaacacctacattggacttatacctgggctacatataaactattgttttaagctcctttctattttggcacttatgtgttaaagcagcaaggttgtttagctaattcagtgacacgagatcacactttgtttctgatgatttaaataagaattaatagaattcagttgcaccaggccatcaagactaatcatgcccttggaaagatataagagcagatgaataatttttctgtgtcacctcaaattctgtggtactacagcttatagccaagtgatatattctagttttattagtaaattgagtaaacattactatccaggaaaaaccagaaaaaaaaaaaaacaggaggcttataataaatatgacattttatctttgaaatataaaccagcttcatggaatagtcatctttaagttctaggacagtggcaaagtttttaaaagattgaacacatagtcatcaccaataaacccttacttagtacagactatgcatgaagtactaaggtaagtgacttctgtaagataaaaacatggaggaaacccttttgtggttcaggaacatgtattcccaaggttggtgtaactgaaggttagtttaagaatgggtacagaacacatggtgggaagcaataaaaggcaggcatagaaagccggattttgtttagaaagaacatggggttgtattaacaagagaatgacatgcttagacctgtcatcttcaaacactaattgtggtggcatgtgaacaatgatttaaagtaggaggaaattagagactggaagacaagctaagagagggaactgtaattatctgggcagcagttttgggggatcatccagcagagaatgtagaatttaaagtaaattcctctagtattgctattcggaatagaaaactacatttacaatgatttaatacaatatacattaataccaaaagtatagtaagaccttagatgtaaaatgtttacgtgttcttggagttccttttctatgcttgatgatcaattgatgtattaattttagtttttctaacctaaatgtatttgagggcgctaattttgaaagcaatataaatatgtcgattactttatgagttgcataaaattatatacattagtacaataccaaatgtacatttggagagggaatacagattctattagtaatttaatcattcatttatgtttttcattaaacatttaagttcctactgttttaggaccaggagatatagcagtgaataaaatgtacaaagtccttaacttatgaagcttaaattctaggactagaaataaaaataaggacaaataaatatgctacacaaaatcaggtcatggcaagtcctataaagaaaaatagagcaaggtaaagagagggaacaaaaggcatggagaggttggctctacttaagagaggatttagagagggaaagcctttcaactacaggaacatttaaaaatagagttgaatgaaataagcagttgaatcctgtgatgactctctggagaaaacacatttccatattaaaggatcagcaagtacaaaggtcctgaggcaggacctctctggcacttgactcccaatgagcctggatctgactagaagtgaaggcatggagagcctatgattagcgcatgcaatattaattttgattacaaagttactttaaactggattagctttatctccagtgaaacacttttcagagaccacagacaaatcttttggactacatctaaacattttttggaaggattaatatttctataattttgaagccatgtgaaaattaagatgagtctattctcatttagtgatcatgccagccttagaaagactgaaactgattaagtaaatgaaagtttgtcacacttaaggtgtaactactacagatgaaaacagaagccactacaaacctagcaaactaagtagatttctaaagttttcagcaagtgaaaacataaatgtcatctcatcattgacaaattccctaatcccattttgttaatacacacacacacacacacacactctgccactactccttctgtgccccaatacggcttttttcaaactactattatatcaagggctgtgattatgtctttgcaatattttcagtgtctcacccctgaaagatgcataacaacaattggttaaatataactaaatagtattccctgtgatgactctccaaaatatacgagtttctgtaccacttttgctatttcagaggttgactattttaatgctagagccagagacacagtaatccaagtgacatgctcaaactaaaagcactgatcaagaatgagaggattttgttttatctttgaggtttatacattattcttctcaaggatgggctcaacatctaagtatcttacatgttaaatgaaaccattccaagtcaaaaagataaaaataccaatatatttatatagagcactaggaggtcctaactaagccagtgattttgatactctgactatgccatagccaattcaaggagtaatagaaggaaacacctgaaaccggtacagaagaagatagaactagaagaatgggctgtcaatgcctaactgatgagggcattggttggccattcataatttgaaatggtaaatcactagctatttcctaaagcagatactgctgtaaaagtttctgatttctccctgaggtcatttaaacaggtctttgcttcatttttgaatgccgttattaattcatgacatattctactatatgcacttacatcccacaagatgaatctcctttggagggcctattggcccaactactaatataagtcattgttagtagaattctacatctccctttcctaaccttttctttctacgtttacaagggggaacagcaattgaattaaaataaacatcatttaaaaatcagcaatagcatgagttacaataactagtctttactctgtactatatgaagtatttaacatacattaacccatttattattaaccacattgcacaaatgaggaaactgacgaactaattgcttgtgtaaagtttttaaggtcacacatctggtaggtagcagagctaggattcaaagacagtgcagctcaagagcctatgctctttactcttacatagaggtagacgttttaaagggacaaaaatattctgagttgatcatttctccctatgtaagtgaactaatatatcactccctaatcaatccctgtatcctaaagagttaatataggatgtaatataggatgatctaagaactcggatacaacagactcccccctatatcaagcaagagtcccttatgccaagcataattacccgtgatggctaacataaaatcgtttggggaaaataaacatatcaaattgtttaagctcaagtagatttacagaaactcgggcaaactcatgtgttccaagataacaccacagactgtcacagcaactcatctggtaagctaattctgaccaatctgtcgagagcatacttagaaccatccagctcagcgtgtaaaactcttaagtatccttccgtcatgctcctcttctgagaggctatgactattccctgaaggtggtgcttaccctttccctgtaaatttaacaagctcagctttgggtgatcaacacctttgactggaggacattacaggtgtttctatggtattcattcataaactaaaagtagagctgactgaaagcctggtatttatagctagcgagagaaatgtccaattattagatgaggttcattttcgttaattattttagttattatgactacataatagttgtacatttggggtgcatgggatattttgatacatgaatacaacatgtaatgataaatcagggaaattagggcatccatcacctcaagcatttatcatttatgttagctaaattccaatttaactattattttgaaatataaattattggtaactataatcactctagggtgctaccaaacactagatctgattccttctatctaactatatactttttatttttttttttttttttacctatttaccactccctccttatcctgtcctccccacttacccttctcagcatctggtaaccatcatcccactctctatctccatgagttcaatttactttagctcccacatatgagtgagaacttgcaatatttgtgtctctgtgcctggttgatttcacttaacaatgtcctccagttttattttctattatttttctttctctcgctctccttttttaaagctcctctggagtgctctttcttagttttcaatactatattttctgaacatgttttttaaaatctacatctggcatctgatctattcctacaacctatccatattctgtctgacctatatttttatttatactttaattccatttgaatttctgctctgggctttagtttacacttgcaatgtgtgatatctgatatctggcccatcctggaacagaagaaatatatcattaccaatggaaaaacacattaaatgataggaacataggaaagtcggtttaagataaatgggcccctagaaagatacactcgcacaacagtatgtacattatataaagatgttaagattagggatgtctgaaattccttaggagaaatggcctgctaaagggcaagggttccacgattgtaatataagagagttattcaattttactaaaaataagttaaaatatttttaataacgtaatcaacatttaccaagtaccccttctttcaagtaatgggactaagaccggagggaaagaaacaattcgtaagatgcaacttctccattaaagctgtttaagtccacagtcaattacactgaaacactgattccaagagcatcttaagttaatctggatttattctttctaggtagttctatcacttagtatacttatgtattagtccattttcacactgccataaggaatacctgagactgggtaatttagaaagaaagaggtttaattgattcacagttccgcatggctggggaagcctcaggaaagttaaaatcatggtgaaaggcaaaggggaagcaagcactctcttcactaggtggcaggagggggcagggaacagccagacacttaaaccatcagaacttgtgagaactatcatgagtgcagcataggggaaccacccatcccccatcccccaaatgatccaatatcccaccagttccctcccttgacacgtggggattacaatttgagacaaaatttgggtgggtacacatagccaaaccatatcattctgctcccggcccctcccaagcctcatgtcatcacatttcaaaacacagtcatgccttcccaacagtctcgcaaagtcttaactcatttcggcattaagtcaaaattccaagtccaaagtttcatctgagacaaggcaagttctctctgcctacaagcctgtaaaaccaaaagcaagctagttacttccaaggtacaatgcaggtataagtattgggtaaatgtttccattctaaatgggggaaactggtcaaagcaaagtagacacaggtcccacgcaagtttgaaatgcagccaggcaatcgttaaatcttaaagctcccaaatctgccttgactccatgtctcatatccagggcaggctgatgcaaggggtgggctcccatgaccttggacagctccacgcctgtggctctgcagagcacagcccccatggctttcacagtgcctgcagcttttctaagtgcatggtgcaagttgtcagtggatctaccattctggggtctagatggtgggcctcttctcatggctccactaggcagtgccccagtgaggactctgtggtggggggaagggctccaaccccacatttcccccctgcattgccctagtagaggttctccatgaggactccgcccctgcagcagacttctacctgaacatccaggtgtttccatacatcctctagacatctaggcagaggttcccaaacctcatttcttgccttctgcacagccgtaggcagaacaccacatggaagctgccaaggcttggggcttgcaccctctgaagcaatggtgcaagatgtaccttggccccttttagccaaggctggagctgaagcagctaggacacaggaagccaggtcccaaggctgcacagagcagtggggccttgggcctggcccaccaaaccatttttcccttctaggcctctgggcctgtgatggaaggggctggcacaaaggtctctgacataccctgaagacgttttccccattgtcttggctactaacattctgcttctctttacttatgcaaatttctgcagcaggcttgacttactccctagaaaatgggtttttcttttctgccgcatggacaggctgcaaattttccaaacttttatgctctgctttccttttaaagaaaagttcccatttcagataatctctctgtgaacgcatataaccgtatgttttcagaaaaagtcaagtcacatcttgaatgccttgctgcttacagatttctgccagataccctaaatcatctctcaagttcaaagttccacagatgtctagggaaggggcaaaatgccaccaatctctttgctaaagcatagcaagagtcacttttactccagttcccaacaagttcctcatctccatctgagactatctcagcctggacttcattgtccgtatcactatcaacattgtggtcaaagccattcaacaagtctctgggaaattccaaactctccctcatctttctgtcttcttctgaccccccccccaaattgttccaacctctgccagttacccagttccaaagtcacttctataattgctatatttatagcaatgccccactatctgggcaccaattttctgttttagtctgttttcacactgttataaagagtacctgtggttgggtaatttataagtaaaagaggattaatagactcacagttctacatgggtggggaggcccccaggaaacttacaatcatggtggaaggtgaaggggaagcaagtaccttcttcacagggcagtggggtcggggggaaggctgtcaaatacttttaaaccatcagatcacatgagcattcacacactatcacaagaagagcatggggacaaccgcctccctgatccaatcacctcccaccaggaccctccctctacacgtggggattacaatttgagatgagacttgggtaggggacacagagccaaattatatcaacttattaatgcagaataaattgtttccaatacaatgagaaattttccctaagtttttctatttgtgacacctcaaaactaaaccactgatgttctcaaatgcttaattaattaaacaaactcatccaaccaaaaatatgcttgtgcatgaaagctgatgttttatggttacaaaaagtaaaacaaaatagtatgaaataaggaaaacatactgcattctatgcactgataaaatgaatgaagctaaatgggtcataaaaaagtatatccagttttatagggcgtgaggcctatatagcagcataaatttgtcttttttttttgtttttacagtaattaagagtatgcaacacgctccacaattatctgagtaattagattttctcaattaaaaacgagcactgataagattagctggatttctaggtcactttgtttcgcagcattatcaatttatccaggtcagaatcttacatctagggatacagactggactggaagttcctagtttttaagtttggtttctggttggggggggaatcctaccaagctaggaaattaatgggaggatgcaattgaaataactaggatagtacttaatgtgttgtaaataataatggcagttattactttgtaaaaacatattttaagcaagtatggaatttctcagaaaacttaacctcaaagcaaaaattttaagattgtttatggtaagaatttaatatcattttccatgtattctcattcttactgttattatttcagtcattggggaaagttatgcttccttcagatggggtgattagaataaacaagaataagacctctgaattcaggacttcgcagttttccaaaagaaatcggtattttttaaacttttaacagattactcctttctattgagcaaatctttacctttccaattggtatttagacatgtaaatttaaaacaaagacattcttctgcaaggaaatttcagatgcttccataagcatttgaaacagcccaactgtttttgcatacttaaggaaagagctatcttaaggatggcaacagttactgtgtaaaaattttagaaatccttttaagtatcaagtatacattcttatgccctgtgcacatcgctgctcaattttggatgtccagcagtgtgcgcacgtccatgtgtgcatgcacataattatatacccatgcacatgagcacattcatttaaccatacaagaagcaatcccagcaagaattctaaaaaactgatatatgtctgaatattactggaaaagagactgtaggtgagacctgggcttcatatggttcaacatagatttgtcagttgatgctgttaattaaaaataatacagaatatataggacaaagtattgtgtgttgatgtaattgtcccatgactgtgccaggtaagaagcgtagaggataatattccctgaaaacagtagggatttctactgctaaacatcttttaaaatgtcagatcctcgcaaaaaaaaaaaaaaaaaatatggactttcgtctagggtgagggaaaaagtttttcccttcgtgccttttgtgattcaagtcccgaaccctatagaaatgagcactgctggacttctaccattgagggcagtttgtcaggccccaaagctgaacagccaagtacaacagaccagagctaagaaactgaacagaaaaaaaactacagagagtgcagtagtattcaattactgttgtaacatattcccaaaatcttaatggcttaaaacaagacaaatgttttatcttacagctgagtaggttagacatctgacatgagtcttattagactaaactcaagcaacagcagggctttgttcctttctggaaattctagaagagatcatgtttctttcccttttctagcttttatagacctccaatattccttaacccctggtcttcctccattcttcaaagcgaacaacagtaggtatagtctttctcaaattatatcactcaggcctactcttgtgcctctttcatttttaagcattccggtgactacatagtgtgcactcaggtaatccaggttaatctccctccctattttaagatcagctaattaacaaccttaattcccctgtgtcatgtatcatgtactatactcacaggttctagggatttcgacatgagtatccttggggagccagcatccaactaccaaaggagagtttaaatatgcaggtttaaacaaaaaagtcgtatcatattgagtatccagatttcactttgtctccgatatactctaattctggtattcccaagtattaaatatcttgggcaccaattatttttgtaaactggtgcctgtaataaatttgactaaattaagctgattatttaagctaattgttcatgtatgaattatttcatcattccactgataggtggcacagtagctcacacaattccaagagatttagtttcaaatgaaagtcgtcctattcatcccctttattattgattttactgcacacacacagagagtcattactagatgggaactgataacaatgttgctcggacacacaatgacacctaatatttatattaatatgctagcacattttttctgttcctattttttgatagctgcaaattagtcttttgtcgcacattccctttttcatgaggtttttaaaatgtttaataaatcatctacatatttaatttttaccactagcatttagacatttttaaagttatcttttgaaactaaattatttttagattttacagatgttcccccttcctgtgtccatgtgttctcattgttcaattcccacctatgagtgagaacatgcggtgtttggttttttatccttgcgatagtttgctgagaatgatggtttccagcttcatccatgtccctacaaaggacatgaactcatccttttttatggctgcatacggcctgtggtggggtggggtggggtggggtgggggtatgggggagggatagcattaggagatatacctaatgttaaatgacgagctaatgggtgcagcacaccaacatggcacatgtatacatatgtaacaaacctgcacgttatgcacatgtaccctaaaagtataataaaaaaatcaaaaaaagaaaaattttaaagattactattcaagatattcttgggaaaatatttaaattataataatcccaatttaaattatactttaattatgtggtcattttatattttaacttgtcatgtatcttctcccatacaagcctgatataaattttacatagaaatcatgatctgtgtatccatatacttctcccctcatagtacacacacttacccgatatgtagtgtgtattgctttagcatactcaataaaatccattgagacaaaatatgccttatgtttctaattgtaacagtcaatttttaccatataaattaccaagaggatttttctaaaattatacgatgaatgtagcaattacacaatctctctacaacttttgtaccatacatggaattctatactagaagccgacattcttatgcccgacagaactatttagttcattttatgagacgtgctattgagttttagataaagtttgaaattttataacagcttattctgtaagaatgcatacaattatcaattaccttgggaataaattgttttacatatttctgagaaccttctgcagcttcttgtatatcaaaccacaggtatatgttttagcatagttaatattttttgaaattaccttcaccactgttattttatttaaataaaggtaatcaggaaggcctttcttcagcttagacaacaaagtagccagtaagatcaaggaaaatattaggtaaaacccaaatacaacttcaatacttggatactgaccatttcattgcttgttaatgttaattccttggattaatcagttaatttaatctatcagcttgataacgtatctgatcagaactttaaaatcctaactggtcttcacacatattaatgaccctcacactttcatgtaatatgctaatgtaaaagccgtgtcttcaagaaacatttgttgtacattaaaaaacaggcactcgcactttcagaggccgaggcgggcagatcacgaggtcaggagatcgagaccatcctggctaacacagtgaaaccccgtctctactaaaaataaaaaaaaaataaaaaaaaataaaaaataaaaaaattagccgggcatggtggcaggcgcctgtagtcccagctactcgggaggctgaggcaggagaatagcgtgaacccgggaggcggagcttgcagtgagccgagatcgcgccactgcactccagcctgggcgacggagcgagcctctgtctcaaaaaaagaaaaaaaaaaaaaaaaaaggcactcttatgctctgggaattcagctgtgaataataaaggtcccagcacatgaggaagtcaccaccaataacaggactgaacaagtctacaactacctacagcattgtgataggccagcagtactatggtgggaacaaactccactggaacattaagtgagaattattttttgaaggttaggaattttacgttggattaaatatcaatgatacaatcaaagtgaaacatgagaaggactcatactgttgtttactctgttaatattgtactaaacagtattgaataaaacaaaatcaacgaaacatttgaaaaacagaagacattgtatctttaaactagtgatgtcattttcttgcattctcatatataactcaatataccgggaacactgtagattctaaataagtattatgtaattaagtaaataaattctcccttgcctctactccagtaatccctcttcccttgctgctgcttgtgaatgtgtcagcctctctcctgcaaccaaatttctaccccagacatactacattcgtcttattccatctctccatgtattgacaagatgggcacatgagtacgtgcacacacatacatccgcatactaaggcaaagtagcttactttacctatctcagagagaaaactagcctaaacataaggaagaatgctcactaaagattttaagatacagataaagaacatttgagtcacctttaagagacataaattacatgttcactccactttctctctatttccccaaatatatggtattctcctcaaactaagatagcaagatatctcagttgatatcttaatacactcagtattcatgtaggctcccaggtaagaaaaaaattattattgttgcttgtctaatcctagttgcatttaaatatgaaatagtaacatggtaattttttagaataaaaaccaattttgaatacaatctaatgaaaactttgaaaaatgttcatttccaaagataaattaaagacagataatttcacagatcatgctctcccttaacattaaaaaggttcttttctcatatatgtattaaatattatcattaaaaatcactagaatatcaaaaaaacagcctacagacttggtgtgtatagtatgtgataacataagcacaaaacaaaacaaaaaactaagaatagtttcaatatgtatgcagtaacagagacacatgctattctgagaagggttaaatcaacaaaggacataatctttctggggttcagctgtgaaatgcagagtggaagaacaacatcccagggagttggaacagcaagtgctaaggccttaaactatgtaaatatcatgctagatgattgtgtgtaaaagagaattaagttaaatccagaaagaaaatagggccagtcattgtcaagttcttcctgcagtcacagaaaaagatgagaataacttgaactatggtggtggttgtacaggtggagaggtatgaatgatttagtgatatacagtgggccctccgtatctgcgggttctgtatctgcaaattcaaataacctctgatttgatacaatagggtgaatatagtcaataattgtgcatttgaaaataacttcaagagtgtaattagtttataactcaaaggataaatgcttgaggtgacatgctattctcatgacgtgcttattccatattgtatgcctctatcaaaacatctcacgtaccatatatatatacacacacacgtatatatatacatatacacatatatatcatatatacacaaacaccccatgtacccacaaaaattatatacacacacacatacacacacacatatatatacctatatggtgtgtgtatatatacacacacacgtatatatacatatatggtgtgtttatatatatacacacacatatacatatatggtgtatatatacacacacatatacatatatggtgtatatatacacacacaccatatgtatatacatatatgtatatatatataccatatatatagatatatggcatatacacacatatataccatatatgtatacatatacacatatgtgtatatacgtgtatacgtatatacacatatgtgtatatacgtatatacacatatatggtatatatacaccatatatacacacatatatgtacacatatatggtatatatatacacacatatatatacacatatatggtatatatatacacacatatatatacacatatataccatatatatacacacacacccctagtatgtacccacaaaaatttccaaaaaaaataaattgtttcccaaataaaaaaatattcaggaaatacaataaaaattaacaggatagaaatctccctgttgggtactatgcttattacctgggtgacaaagtaatctgtactcagagcccctgtaacacataatttatctatataacaaaaatgcatgtgtaaccctgaacctagaaattaaacacaaagaataaaatgtaacaactatttacgtactatttatattgtattaggtattataagtaatctagagataatttaatgtaaacaggaggatgtgcataggttatatgcaaatatgacatcatttatataaggaacttaagcatccacagattttagtatctggagttcctagaaccagttctcagatagtgaggcacagtcgtattcttaaagtataatctataaggcatcatggattgaaatagttctaatacttcacttttttcatacttaaagctgcttaaatgaccaacttaaaagatagatttattattacagagatttcccgatccaagctattaatgtcagtgcagacatggttgattcatggagcgggggtgggggggggaaatacacacctggaactcatctgtgtgtttagaggacaaattaaatcatttttaaatagccccaggatgatctcagccattaaagagcagaaggctaataaaacaactgttcctattaaatcgttttctgagttttataagtagatgtcctcccttatgtattttattggcaatatatgttacctttatagagaagcagcgtttctatagctctcaaaaaggttaagaacccgaggtgtattataggccaatttctcttgtaaatgttgacttaaaatagtttaaagagcattttctcatgttggaggtgattaattgcactgagtttcacttgtaaaaatccattgctcaaacctaaggatggtggggggacacccatctgtgcaaacgtgtggacttacaatgacttttgcttatgttagctcaggtgtcagttctaatgaacaactttcaacaagagaaaataaatccagaactttttattagaaatcacacatgttaaacagaaatcattaactaaaccttactcaaaatagtggtggactttatcacttaagaaatcaattaacttccaaggaactatagaaaaagttaggttcccgctccaaaatcatcttatcgatttatgcatttatgtccaactaataaaattagggaagcagagtaagaactactgtatggatccgtggattttggtatatttaaaatcccatataagaattatgatgcagccacattttcatttgacataaatatttgtacatttattagaatgaaaaacatgctctgtactttaaaaaatattctctgaattagttcacattctgtcttatataacagttacctatatattgtttgttggcctatatgcaattttcaataccttggcagactgtatatcttttacttcctgacacacttggagtatatagcactattccttatgtaaagttatcaatagacatttgatgaattaacatgcatttctactgaacaaagtaagcctggggcacataactttaaaatgcttatgtagcatctgaaagaatttacaatgtcagactaagaataaaaagtaggggctccagaatttctactttattaatgatgtggtcaaatcaacccattggaaaaaatcttagtctactcagccacctgcacaaatgctcgtgctctataaaagcattaaaaaaaaaaaaccttttagactagtctatatgtactctgcagagtaaaagacacattagctaaaacaatagtgctcataatattaatgtatttggcttgtgtaagtaacaatatttaagctctgacaataattctaattttaaacattttcattccatctgcaagattaaagtttgaattattatgattattcaatgcctcttgatcaatctgaggaaagatttctttcaataagaacattccttcaagcactacctttgctatgttcttcactagtctatgttaagattaacgtgaagaaggctaggtaaggagtattatcatttctattataatgattttgcttaaaatgtacatttctgtttatgatgaatgcaaagatattatcatttaatggaaaatttatgtaagacagatctcgctacaactagctttagcagttttacttaggttataacaatttaaaaatttctcatcttatagtcccttaatattccatattttttaacttttttcgtatttcacatgcagtttgttggtgaaagcaaaattcgagatataatagagagaaaaaaatacattatttatttttatccaggagcttatgtctcatttttatatcgttgttatattttgcaatgggtgaaatttgtctttctcttcagtcttttaaaacctagttacttcaccaggttttttccaaatactcaaatgcccaatcgttatttttctatactagttttttccccacttctggctgtctcttttcagagtccctttgattaacaactacaacaatatcatagtctgctgtttaactacagtgaggtgaatttattaagggcttcaccatgtactcttgcctcttgaggaggaataagagtgtgtgtgtgtgtgtgtgtgtgtgtgtgtgtgtgtattccaattattaataaaaacagttttcaaatcacttttccaagagactcacttgcccaactgattctatacagaaaaacttagatattaaagcctaggtaaaatgtatctttttatttagactttctcagataatagcttttttttttaatccacatatgactcaaggtgggatttcaatctagataagagatgttcacatcacgacctcactgaggaaatatttgagatagtgagatgttttgatgcctttgccatctaattttagagttaactgagaaagagtagaggggaatattttcataactggtgagtgtctccctttgataactttagtgtggcttggatagaatgtcatacttgcaagatttgtaaacatccttctactttaattatttaatgattctctcaaggaaacatcatagtaaaaagaattcagtatccctcttattctggctctagtttataaaacttttccatttattttcaaaacatttggaatcaactgatggatgtgcatccaattaaaaacaaacccaattagccctgtaataaaatgagtaaccttttagttaatgcaaagaaaatattcatggaagaagagaggaatattctgccataagattatattctgtagtagttacaagtagggaatcttaactccaactcactagctgagtgatgtgggcaatttacataaactcttcagttgcaaatgaccaaaataatagtctctacctcctagagtttttgcagaaataaaacgaaattatacaatatcaagcaatgtgcccagcacttaatgtttaataaatatcacaccagattacatcaatattactatgtatgtattactcccagcttcagaagttgagtttttctgagagtctgggaaccaattcaaccacttttacgatgtcatatgacgtaatgactacaagagaaaacctagttatacttttgcaagtgtgctaactaatgtcttacaaatactatgacaattataaggtactatcatgaaccagccttcaggagacttgctagaaatctaccatgtatccatgacaactgtgaatcaatctctctgtcaagtgtgtgtgtgtgtgtgtgtgtgtgtgtgtgtgtgagagagagagagagagagagagagaaagagagagagaaccactctgaggaatttaagatatagtataaatcttttatgaaaactagattagactctggagctcaaggatatcaaagattaccacccagtacaccagctgtgagccagcagtattcctcagaccagaaaaccagaatgagtgggaaggtcacaggaagaccagcaagatttcaaatgggaaatgacagtagatcccccttttccacgggggatatgttccaagacctacagcagatgtctgaaaccacaaataggccctatatatactgtttttcccatacatatacatacctatgataaaatttaacttataaattaggcacagaaaaagattaataactaatagaacaattatagcaatatgcagtaataaaagttacgtgaatgtggactctcacctctccctgcccaccctccccaccatcatctaattgtactgtactcatcaatttaaggaccacggttgaccatgggtagcagaaactgtaatgaataagggaggactcctgtatttaatttggggagagtcagcatttattctagaggcaggcaaaataactggaaagatcagttttccctacaggagtataaagggaccatttaatttttacaacattccagttatttgacataactttagctactgtttctgggctcatattacgggccaaatacatacaggttttacttactccttgaagtagcagtgggaggtaaatatttttactttacacgtgagcaatactgagcctcaataattttccagtggcctaaaactaataaaggcaaaaatcagattttaacccaaaactagttggctctgtgtagaaaaagttaaatcaaccctaggttaatctgatgctgcctaggaaaatgaacatagaaacttattttcttaggattaagagttaagataatagtagaatttcttgtcactcttgtttgctaggtaggactactattaaattaactggggagtggggcagagaggcaatatatagtcttttgtcctatgtgacaacaatggtattaaatattggtgggaaattaatgctgcaatttcttcatgtcaagtaaaccacactgattttggccgttgtcctagcagctatatggagcacatttgggtgagaggcatgtggaaatctgtatgttggttgcttctgggccatccaatgatacaaagattctatgacagtgtatctcctgccttgtatccttctgtacagctaagtaaatgtcatagattaaattctattccatctgtgagtataattgccaattttatctccttacaactacactaacagtgcaggctccaaagttcattatgtcctgtcagtaaaagttgcatatctggctaaaatacaaactgtttagcaaaactaaccctggataaatggtaaataaattcaacctatttatggcattaatatcagagatcataaaattaagccatttgcttatttcaagtggatttatgggatcagacttctaatttgaaaactattattttaccatcattttaattgttttcccttattagcccttagttattattaaaaattcttctagttctttatcagctctgccaatgaaagacatttttattggctgcaaaaggcatcaacaaacctcagatagcagaacacagtgatgtcaattagtaacaagatgagagaggcaggcaaaagaagaaataaattaaagaacaaagagtcagggatcacctctgcaaacagctcctctcacctgggcaacccttgctggaaactgtttgagtcagagtaccattctatcacaaacatgtccgtgaagcaataaatagaagaaggaatgaagagagacaactgtgcagacaggagataaggcaagtttcttaatcctaaagagaatgttttgatggccagtcttatgtgacagctagtctatttttactttgtctgtggatgaacaatttctcattaacagaactgttagcaataagcagtactccagtaattgaagatgtgaacagcaggcttagtcattttttaaggaagaaaatgctagaagtctaaacaaatgctgggacaacagattctggatcttatcctataaaagggcatatctcacagaaacaattgttccattgtagttgtttctatcttagctgcaggatactctcacttactgagcttctaaaaattgctgatgtcacagcccgtcctcagtgaaataaaatactagtttcaatcccagtgttgccataaagcttccccaaccgattttattggacagtcttgtgagaaataacacggactttaagaagagataaaccctggatttgattatagctcagttatctattggctgtgtgatcttgattttaataaagctctctaagcctcagtttttccatttataaaagaaggataaacttacctggaattgttgtgtacaagacataagataaagtatggaaattatctagaacatgactgccctacttaaacatttgcactcttctaccaaaaggaacttgcaaatttgagtttatatcactgatgataaattagaaaaatctttgcaggggaaaaatgtgctttgatttgaagcaaaagtttattcagcaatattaacatctcacaagaatgatattacaggatatttcctaaaagtaaaaacactggtttcaaccaccttattaaattgtaataatatataaaattcctaataatttaatagttgtaacagttttctcacttttcaactggatatcatatgatccactaactccacacgattgccataagacaaaaaatctggggcttcaaaatggctgaattgatggatctgttactcacctcttccatggagaggaaccaaagtaccaagtagataatcatactttgaatacattaactaagagaaaacactgaaattcaacagagaagcaatgaaaaccactaaaaggaaaaagaaggaaatgaggcactctatccagctgagattggctaggagtctggagaggctccctaacatggggagagaattagagatgcacaaaggtacacattcttgtacaagattcctacaatcctagccaattgagagcccttcaacccgtgtgggcccccaaaccaacacacagctgtctagatactgtgcaaaggcattgcttcacggaagaagcccatgctgggttccacaaactctagagtcctaagcagctgcaacatggcctggttttgagagcccagcccccaccagtctatgtcctgacctaggactaaaaatcttccctatctccacattcctggagtctcagtgatatttcccacccatggctgcaactgctggggccaaggcaggaaccactggcagcaaaccctcccctgcccaacagaggggtggccactcaacttcatgcacactgaagactaattccactgcctgcaaatgctgtcactgtgaactgctgtggagttgagacacaagcgacgcacaggctacccaggcaactgcttatggctgctcccaaggaaagcaaccttaccctctccagtagcagggccacagtgtagccaacactgccttccacctgagcattgcacaagggacctggggagcaccttgcccctcgactacaataaccagtggttgcatgcaccaccaggagtcctgaggacaggtcttcccagctctgctcttccaaatcccccagtacataaaaatttgtatagagacctggggctctcccaccccagtttaccaccattggcatctgactagtcttcctggggcctgaatttgggcccactcaagcttccactaccaccaaagctggcgtcaacctacatgcaccatctgcaggcctaggaactggcttgcccaatctgttgcatccaccaccaacaccatcatggattgcttgcattccagagggttgcccccctcccactattgccattacccgcaccatgcttgctgcccctgggctgggaacctgtgtacccacccagcccacctatgcttttcctgacaaccaagcaagccacctataagccaaagggttagcctgcctggacacactaacatcaatgccaatgtacacagctctgaggcctgaggacaggcacgctcaaccaactgatgccaccactggggcctgaagactggaccacttggtgtcccagtcaccggcaaaacttcaccacagcttctgctaacaactgcaccctaagctactgaggaagttacagacaccattcatactgtttacatccaaagaaatcatacaggaagtatactactatatacattcagaatcaaaggcaaagactcaagaggagactagataaaacagaagaatctcagaacatgaaaacaggtcttttaaaataacctactcaaacaaaaaataacaaaaaattttaaaaaaatgagcaaagcctatgtgacatatacaacaccataaagccatgaaatgcttgcattttttatgtcctagaaggtaaaggagaaactaaaggtttagaaaccctatttaacaaaataatagatgaaatcttcccaagtctagcaagagatttagacatccagatacaggatgctgaaagatctcaaaaagggatacaattcaaaaatgtcttgtccatgacacattatagccaaactctcaaaagccaaagacaaaaagagaattctaaaaacagcaagagaaaagcaccttgtcacttataaagaaacctccatcagattaacagtgaatttctcagaagaaaccttacaggccagagaagaatgagatgttatattaaacttgctgaaagaaaacaaccaccagccaaggatactctacccagccaaggtagccttcataaatcaaggagaaataaaatagttcctagacgagtgaaagctgtggaaatttatcaccatgatactggccttacaagaaaggtttaagggagtcctatacctggaagtgaaagaatgacaactaccatcatgaaaacacataaaaatataaaaacaactagtagtgcaaacacacaaaaaaaatcaagaaaagttactcaaatgttaccactaaagaataccatcacactataatgataatgagggaaaaaaatgaagaaaaaatattcaaaacaaccataaatcaataaaatgaaagaaataagccctcacatatcagtaataatgttgaatgtaaattgattaaacattccacataaaagacataaactggctgaatggattaaaaaatatataacccaaaaatattctgcctaaaataaactcatttcacctgtaaagacacatatagatttgaagtaaagggatggaaaagtatattttatgcaaaccgaagccaaaggggagaagcagcagctatgcttacataaaacagactttcagtcaaaaacagtaaaaacaaacaataaggtcattatataatgataaagggataagtttagcaagagtatataaaaattctaaacatacatacacccaacacgagagctcccagatatataaagcaagtattagatctaaagggagagctagatgcaaatacagtaatatctgaggacttcaacaccccactctcagcattagatcacttagacaaaaaattaacaaagaaacattggcttgaaactgctccttagaccaaatagtcctaacagacacttataggacaattccttcaacagtcatacacatttttttctcataagcacacagaacattctccaggacagaccatatgttatgacagaatatgtcttaacaaatttataaaaaatcaaaatcatatctaatatcttcttaaaacacaaggaaataacaaaaagagaaactttggaacctgtacaaaaacatggaaattgaacaacatactcctgaatgaccattgggtcaaggaagaaaattgaggaaatgttttcaaaaaattattgaaacaaatgaatatcaaaatataataacacctacgggatatggcaaaagcagtgctaagggggatgtatatagcaaaaatgctcacatcaaaaatgttgaaatatttcaaacaatctaacaaagtacttcaaggagctagtcaaagaaaaaaaaacaaaccaaacccagaattagtagaaggatgaaaatcctaaaaattgagcaaaactcaagaaaatagagagcaaaaaatacaaagtatcaatgaaatgagaagtttgatttttaaaaagatgaaaataaagcacttgctagactaaccaagaaaaaaaaaagactcaaaatcataaatgaagacggagacattacaactgataccatagaaataaaaagttcagagactatactgaacaactattaaataataaactaaaaatctagaggaatgtataaattcccggacacatacaaccaaccgtggatcaagaagaaatagaaaatctgaacagatctataattagtaatgatcttgaatcagtaatcttaaaaaatttcccaacgaagacagtccaggaccagatgtctttactgctgaattctaccaaactttaccaattctcctgtaagtgttccaagaaaaattgaagaggaaggaattccccctatctcattctatgaagccagcattaccctgatgccaaacccagacaattatgcaacaaaaaatacaggacaacatccctgatgaacactgatgtagaaattctctacaaaatgctagcaatccaatagaacataaaaaatgtaatattatcaagtggaatttatcccaatgatacaaggatacatcatacacaaatcaataaatatgacatattacatcaaacagaatgaaaaacagaaaacatgatcctttcaatagacacaaaagaacatttcataaaatttaacatcccttcgagataaaaactccaacaaactaggcatacaaaaaaaattaacaaaataaagaccatatatgacaaatctacaagtagtatcaaactgaatggggaaaagctgaaaaatttctccctataaaactggaatggtcaggcgtggtggctcacgcctgtaatcccagcactttgggaggcagaggtgggtggatcaatagatcaggagatcgagatcatcctggctaacacggtgaaaccccatctctactaaaaatacaaaaaattagccgggcatggtggcagatgcctgtggtcccagctgctcgggaggctgaggcaagagaacggcatgaaccctggaggctgagcttgcaatgagccaagattgggccactgtactccagcctgggcaacagagcaagactccatctcaaaaacaaaaaaccaaaaacaaaaaaaagaacaagacaaggatgcccactttcaccactcattcaacatagtactggaggtcctagccagagcaatcaagagaaagaaatacaaggcgtcctaatagaagaaatcgttgtccaagtactgctctttgttaataacttatagctagaaaaagctaaaccctcaccagaaagctctcagatctgataaataaatttagtaaagttgcaggatacaaaaatcaacatacacaattcagtagcatttctatataccaataatgaactggctgagaaagaaatcaagaaggcaaacctatttacaacggctggaaataatacctaggagtaagtttagcccaggagggaaaggtccgtataaaatacagaacactgacaaaacaaattgaagagtacaccaacaaatggaaagtcatcccatgtttatcggtcagaagaattaatgttattaacatgatctttctactcaaagcattctacattgaataatgcagtccctatcagaatacagaaatggaataaaaagtgatcataaaatttgtacgatcaaagaccagcagagagcctgaatagccaaagcaatcctgagcaaaaagaacaaagacttatgaatcacactacttgacaaaacagcaaggtgttagaataaaaacagacatatagaacaatggaatagattagagaactcagaattaaatccatgtatttacatacaacttgtttttgacaaaagcaccaagaacatgcattagggggaaggacaccttcttcaaatggtgctgagaattggattgtcagatgcagaagtatgaaactggatccctgtctctcaccatattagaaaattcagctcaagatggattaaggatttaaaggtaagacctaaaactgaaactacatgaagcaaacatagggaaaacagacaggaccttggtctaggcaaagattttatggttatgacctcaaaagcgcaggcaacaaaaacataaatagataattgggactgtagaaaatgaaagagcttctgtaaaacaaaggaaggattcaacagagtgaagagacaacctgctgaatgggagaaaagatttgtaaactattcagacaagagactaatatctaggaaatacgaggatcccaaacaatttaacagtaaaaaaataatcacattaaaaatggacaaaggacaataataagtatttctcaaaagaagacaaatgaccaacgggtatatgaaaaaatgctcaacatcactaatcattagggaaatgcaaatcaagtcatgatgagccatcatcttgccccagttagaatggctattattaaaaagacaagaaaacaacagatgttgacgaggtgcaacgaaaagggaactcttaatacattgttgtagttcagaatataagtcagtatagccactattgaaaacagtatggagaagatttctcaaaaaactaaacatagaaatagagtatgtgtcagcaatgccactaataagtatatatgtaaagggaaagcaatcatatacttttctaactatcaggaaaagtatatgcatggcatacctgtacttgcatgcttattgaggcactatttataatagcaacttaagtgtccattagtgaacaaatggataaagaaaatgtggtacatatatacagtggaatactcttcatccataaaaaagaattacattttctgcaccaacatgaatgaaactgcaggttattaagtgagacaatcgaggcaaagataaatagattttacattttcttactcatatataggtgtaaaaaaagttgttctcatggaaatagagagtataataagataccagaggctaggaagggtaggaagggaatataaaaaggggttatttaatgggtacaaatatatagttggaaggtatatattctaatgttcaacagcagaaaggggtgactagagttagcaacaatatgatgtacatttcaaagtagatgagagaactcaaaatgttcacagaacataaaaatgataaatactcaaagtaatgaataccccaaatacactgacttgaccattacacattcagtgcgtttaacaaaatatcacatgtatgtacatatatgtaaaacgttatgcatcaataaaaataaaagttctaaaaagagaataaatctaagaggatagcttattgctttaaaataaaatgacaagacaactataaatcttcaggtttccctctgcaaggaataaatcctattgtatgacaattaaatttccctcttataagatttaaatgacatcaacaaagactttagttcatcattattttacccaaatattgttgtaaaatagtatattttcatcttatatttcatgttccagctgtaaaatgtcacatgcattttatatatagaaattatttaattggaaaacatatgtaccaacctaatatctatttttccagtgcccagctttaaggtttttggatattcatttgcaggttctgtgatgtctttttttgtttgtttttgtgggatggggggacagggcctcagttcttttgcctaggcttgagagtagtggcacaatcatagctcaccgcagccttgaactcctggcctaaagcaattctcctgccttggcctcccaatgtgctgggattacaggtgtcagccatcacacccagccctgtgatatcacttataattatgtataaaacacagttaactccattttgaagacagtgaagtaagttttccaactatcagcaaaatatacattacattcaaatattatcactgacttaaaaccacatagaaaattttaaactacttatgccattttattctcatttaccatcattagaatggtcaaaatgtttttgccaaggcaaaattctgtgacaagaaacacagatatcaactatagaacacttttctgaatcaaacctaatatctcatgtattccttcatagctgaaataaaattaacaaataccaatagatgtttttaatatatttctttagtctcatgaactcattgtgatgatatgactaggaaaaccatccacaaagtgtctattacatattatttagcattagaacctcatggctgcatttctcattattaatttattaatgtcttgtcaatcattcaaaaatcacttaatgtcactgtataggccaaggatattgttatttcacctgtaattaaaaaaaaaaagttgtgaaaataatcctggtaagctaattgaaaagagattctcagttatctaggtaagaattatatttaaatgtttctgaacaaatttggcatagaacctaatccataatgcacatcttcaatcgcatgattatacttcattatttaaattccccaactgagtaagaaactcttacttaactaaagcatactttaacaaatcagcccctaggggagatagaaattataaattgaccattttccataaagttaaaatggtgacaaatcatagaagaatgtgaaagattagtagaaaataccaaaatttgttataaagggtaaattcaagccaggctcccgcacacacaaatatcatatttaatgtttttcaagtctctgttgtctaagtaggtgaatttgggacagttacatgcaattatttgtcatccaaacaactgaaatggataaggagaacaaaaattgctttcatttattagtgactggttccaactgcccagaaaatactcagtttttttatggtatctgaactgagaaagatgtacaacacataacatcaagagaacacactggaatactctcatgcctcttctaacttttaggccactgggaaataacatttacgtcttaatttttgtcatgaagagcaatttcaagatttcccatcagggaagaggaaattgctacaataatatctgaatgttaatataatcatctgtatcatacctatttggtatatattactttgtcatcaaaaaggcaatggccatttttcattcatgtaagtgccagtgaaatattttcttaaatattttcttaaatatattttcaactgcagagtttgactctaaattgtctgaaatatttacagtaaggatttctagttgaaataccgtatatagagaaggaacacctataatattgcaatcgcattagattttctgaaaacaaggtactctataatgagttctagacaaaaatcaatctaaatgatataaaattagtgtttatgttcacaaaaatatttatttatttaaattaactctaatcctcctgagaattaaccctctcaattttaacctgtgtaaacttataaacatttcttgccattatggtatcaaaatgtgatgattacagcagaggcggaaaaaagttaaaacagcccttgttcagccaattgatatcaaacccaacataagaggccttaaaaatattcttctcttttatagcaaattctatgtatctttccatgattatttttgtaggttaaaatcctgcatgcatacaaagccaagtctgaaagcattcactccaggagtaaaactttccaacaggcagagctaattcttggaaaagaaggctataaaaacaactcaagagtgatgcagggattagccaagcagaaaatagaatccgtgtcaccattctcaggaagtcaaaataaaggggattaaaaccaaaccctaacgggtttgtaaatgtcattttgaggatacaaaaatttctctcgagtcctagtgtccttccttttttggtcaaatttgactgtcattattcatttttgttctaaagttaccctggtaaataagtaagaacatttccatatcatatttcatatcctaaatggaaatggctttctacactaatattcaaaagacatctagaacaggcgcaatcttttatccctgattttttgttttattcctttaaagagaacatcctcactttgttattcacaggggaaagctgacaaagcactctcttaatatagggaggattttttttttttttttggactggcaaacaaaccaatctgtttgaaactcagagaaacaatgtatatgaaacccacgaccaacgcatgtagaatgtactgtcttacagagaaatcataacgggaagagaattgtctgattcacaaaaggatatttttaaagagatatacctattatctatgagcataaacatacataatttattaagtttaccctagatgtacttatttttgcatatgttagcatctaaacacactagaaacagctcctgaaatcgcttatgctaatgcctactgctactcattttaaaaggcaattccacttaaaactaaacctcaggcctcaaaacaccagttaaggccaaagcatatcaaattctatatatgaaatcctacaaggtttcaatgacttcctaattttataaagcaattctatcaacaaagcttatgtttaaaattgtcaaagcattatttggcaggtatttcttaaaccaaatatagcttcaatcccccaataataaaattctccccaaatgtttcattattctcctaaggggcataactaatttaaaatgaaatttctttggagagtagccaacatcatgcataagctacagaaccaatatctggttaaataaaaatatgaacatcacaaaagcaattactatacaggcatgaatcacgaattttgctggtaaatctatcgaagagagtgttctaagtctgagacttcaagagatggtgttctgtcttttgtgactaagcagtcagtaaataaaaattcttatgagttattatttttttctttgaatcatcattgagattatctcctgaaaaatgctgagcaaaaatgtataaatgtgtacttggtggtttccctaacacaatggcaagaattgacatattttaaaaatatatgacttatgctgaatcctcatcttatttgcagccataagtaaactttaagaaactttttattattatactttaagttttgggatacatgtgcagaacgtgcaggtttgttacataggtatacacatgccatggtggtttgctgtaccaatccgtcatctatgttaggtatttcccctaatgctatcactcccctagccccacacaccccaaaaggccccagtgtgtgatgctccactgcatccatgtcttctggttgttcaactccgatttatgagtgagaacatgccgagtttgattttctgttcctatgttagtttgctgagaatgatgttttccagcttcatccacatccctgcaaaggacatgaaactcatccttttttgttgctgcatagtattccatggtgtatatgtgccaaattttctttatccagtctatcattgatgggcatttgggttggtttcaagtctttgctattgtgaatagtgctgaaataagcacagaataatttataatcctttgggtatatacccagtgatgggattgcttggtcaaatggtatttctggctctagatccttgagcaatcaccacactgtcttccacaatgtttgaactaatttacactcccaacagtgtaaaatcattcctatttctccatattctctccagcatctgttgtttcctgactttttgatgatcaccattctaactagcatgagatggtatctcattgtggttttgattttcatttctctaatgaccagtgatgatgaacttttttttcacatacttgttggccacataaatgtcttctttgagaagggtctgttcataccctttgcctactttttgatggggttattttcctgtaaatttgtttcttgtagattctggatattagccctttgtcagatagatagattgcaaaaattttctcccatcctataggctgcctgttcactctgatgatagttttcttttgctgtgcaggagctatttagtaagatctcatttgtcaattttggcttttcttgccattgcttttggtgtttcagtcatgaagtctttgcccatgcctatgtcctgaaaggtattgcctaggttttcttctagggtttttatggttttaggtattacatttaagtctttaatccatcttgagttaatttttgtataaggggtaaggaaggggtccagtttcagtcttctgcatatggctagccagttttcccatcatcatttattaaatagggaatgctttccccattgcttgtttttggcaggtttgtcaaagatcagatggttgtagatgtgtggtgttatttctgaggcctctgttctgttccattcgtctatgtatctgttctggtaccagtatcatgctgttttggttactgtagccttgtagtgtagtttcaagtaaggtagcatgatgcctccagctttgttatttttgcttaggatggttttggcaatgcaggctcttttttagttccacatgaaatttaaagtagtttttttctaattctgtgaagaaagtgaattgtagcttaatgaggtaacattgaatctataaattacttcgggcagtatggccattttcatgatattgattcttcctatccataagcatggaatgttttttcatttgtttgcgtcctctcttacttccttgagcagtggtttgtagttctccttgaagaggtccttcacatcccttataagttggattgctaggaattctattctccttgtagcaattgtaaatgggagttcactcatgatttggctgtttattatcggtgtataggaatgcttgttatttttccacatcgattttgtatcctgagactttgttgacactgcctatcagcttaaggagattttcggctgagatgatggggttttctaaatatacaatcatgtcatctgcaaacagagaatttgaataccctttctttctcctgcctgattgtgctggccagaacttccaatactatgttgaataggagtgatgagagagggaatttttgtcttgtgccagtttttaaagggagtgcttccagcttttgcccattcagtatgatattggctgtgggtatgtcataaatagctcttattttgagacacattccatcaatacctagtttattgaaaatttttagcatgaagggtagtgaattttatcaaaggccttttctgcatctattgagataatcatgtggtttttgtcattggttctgtttatgtgatggattacgtttgttggtttctgtatgttaaactaatcttgcatcccagggatgaagccaacttgatcatggtggataacctttttgatgtgctgctggattcggtttgccagtattttattgagcctttcacattgatgttcatcagggatattgacctgaaattttttttattgtgtctctgccaggttttggtatcaggatgatgttggcctcataaaatgagttagggaggagtccttatttttctattgtttggaatagtttcagaaggaatggtactagctcctctttgtacctctggtagaattcggctgtgaatctgtctggtcctgggctttttttggtttgtaggctattaattactgcctcaatttcagaacttgttattgttctattcagggatttgacttcttcctggtttaatcttggaagagtgtatatgtacaggaatttttccatttcttctagattttctagtttatttgcgtggagatgtttatagtattctctgatggtagtttgtatttctgtgggatcagtggtgatatcccctttatcattttttactgtgtctatttgattcttctctcttttcttcttttttagtctggctagccatctattttgttaatcttttcaaaaaaacagctcctgaattgagttttttttttttaagggtttttcgtgtctctatctccttcagttctgctcttagttatttgtcttctgatagcttttgaatttgtttgctcttgctgctctagttcatttaattgtgatgttaggatgtcgattatagatctttcccactttctcctgtgggcatttagtgctataaatttccctcttctaaacacttctttagctgtgtcccacagattctgctacattgtgtgtttgttctcattggtttcaaagaacttatttatttctgccttaatttcattatttacccagtagtcacccaggagcaggtttgttcagcttccatgtagttgtgcacttttgagtttcttaatcccgcattctaattagattgcactgtgatctgagaggctgttatgattttcattcttttgcatttgctgaggagtattttacttccaattatgtcgtcaattttagaataagtgcaatgtggtgctgagaagaatgtatattctgttgatttggggtggagagttctgtagatgtctattaggtctgcttggtccagagctgagctcaagtactgaatatcctttttaattttctgtctcgttgatctgtctaatattgacagtggggtgtgttcaagtctcccactattattgtgtgggagtctaatacccagtggtgcctggaacgccagcgagacagaaccgttcactcccctggaaagggggctgaaaccagggagccaagtggtcaagttcagcagatccaacgcccacggagcccagcaagctgagatccactggcttgtaattctcgctgccagcacagcagtctgaagtggacctgaggctccagcttggtggagggaggggcgtccgccattactgaggcttgagtaggcggttttccctcacagtgtaaacaaagtcgctgggaagttcaaactgggcagagcccactgtagctcagcaaagccactgtagccagactgcctctctagattcttcctctctgggcagggcatctctgaaagaaaggcagcagccccagtcagcggcttacagataaaactcccatctccctgagacagagcacgtgagggaaggggcagctgtgggtgcagcatcagcagactaaacgttcttgcctgccggctctgaagagagcagcagatctcccagcacagcactggagctctgctaagggacagattgccttctcaagtggggccctgacccccgtgcctcctgcctaggagatgcctcccagcaggggtcgacagacacatcatacaggagagctctggctggcaactggtgggtgcccctctgggacgaagcttccagaggatggaacaggcagcaatctttgctgttctgcagtctctgctggtgatacccaggcaaatagggtctagagtggacctccagtaaactccagcaaacctgcagcagaggggcctgtttgaaggaaaactaaaacagaaaggaatagcatcaacaaaaaggacatccactcagaaaccccatctgaaggtcaccaatgtcaaagatcaaaggtagataaatccacaaagatgaggaaaaaccagcacaaaaagggtgaaaattccaaaacccagaacacctcttctcctccaaaggatcacaactcctcaccaaacaagagaacaaaactggatggagaatgagtatgacgaattgacataagtaggcttcagaaggtgggtaataaactcctccaagctaaaggagcatgttctaacccaatggaaggaagctaagaaccttgaaaaaaggttagaggagttgctaactacaataaccagtttaggcaaaacaataaatgacctgatggaactgaaaaacacagcacaacaacttcatgaagcatacacaagtatcaatagctcaatcgatccagcagaagaaaagatatcagagattgaagatcaacttaatgaaataaagtgtgaagacaagattagagaaaaaagaatgaaaaggaatgaacaaagcctccacgaaatatgggactatgtgaaaagacaaaacctaagtttgattagtatacctgggaaaacattcttcaggatattatcccggcgaactttcccaaactagcaagacagcccaccattcaaatttaggaaatacagagaacatccacaaaaatactcctcaaaaagagcaaccccaagacacataattgtcagattcaccaaggttgaaatgaaggaaaaaatgttcaggacagtcaaagagaaaggtcggcttacccacaaagggaagcccatcagactaacagcagatctttctgcagaaaccctacaagccagaagagagtaggggccaatattcaacattcttaaaataatttttaactcagaatttcatagccagtcaaactaagcttcataagcgaaggagaaatagaatgctttaaagacgagcaaatgctgagagattttgtcaccaccaggcctgtcttacaagagctccttcaggaagcactaaatatggcaaggacaaaccagtaccagccactgcagaagcataccaaattgtaaacaccatcgacaccatgaagaaactgcatcaactaacaagcaaaataaccagctagcatcataatgacaggatcaaatttacacataacaatattaaccttaaatgtaaatgggctaaatgccccaattaaaagacacagactggcaaattggatgaagagtcaagaccaaatggtgtgctgtagtcaggagagcaatctcacgtgcaaagacacacataggctcaaaataaaaggatagaggaatatttaccaagcaaatggaaagcaaaaaaaataaaagcaggggttgcaattctattctctgataaaatagactttaaactaacaaagatttaaaaaaaacaaaaaaagacaaagaagggcattacataatggtaaagggatcaatgcaataagaagtcctaactatcctaaatatatatgcacccaatacaggagcacccagattcataaagcaagttcttagagacctacatagagacagactcccaaacaataatagtgggagactttaacaccccactgccaacattagatcaacgagacagaaaattaacaaggatgttcagtacttgaactcagctctggaccaagtggacctcacagacatctacagaactctccaccccaaatcaacagaatatacattcttctcagcaccacatcatacttattctaaaattgatcacataattagaagtaaaacactcctcagcaaatgcaaaagaatgaaaatcataacaaccaacctctcagaccacagtgcaaacaaattagaactcaggattaagaaactcactcaaaaccatacaactacatggaaactaacaatctgcttctgaataactactgggtaaataacagaattctgacagaaataaagaagttctttgaaaccaatgagaacaaagatacaatgtgccagaatctctgggacacagctaaagcagtgttgagagggaaatttacagcactaaatgcccacaggagaaagcgggaaagatctaaaatcaacaccctaacatcacaactgaaagaactagagaagccagagcaagcaaatcaaaagctagcagaagacaagaaataactaagatcagagcagaactgaaggagacggaaacatttaaaaaaaaaaaaaaaaaaaaaaaaaaacatcaacaaatccaggaggtgtttttttttgaagagattaacaaaatagactgctagatagactaataaagaaaaatagagaagaatcaaatagacacaataaaaaatgataaaggggatatcaccactgatcccacagaaatacaaactaccatcagagaatactacaaacacctctacgcaaataaacaggaaacctgtttaagcgataagatgctctttcaattggaagagtctatatatagaaaggctttacagatatgagattttattgggaaaacgagaccataagcagtggctggatcttcattaatcagcctgtatttcatattacattttgttgattttaaattgttgaagtttgagacagtaaaatggtgatcttataggatatacaatgtacctttctacatatacttcccacttaggagagcatatggagttaggtataccaggctcttttagctataaaatacactattcatgtacctgcctttttctgattacaggctcgtcaacctactttttaaaattgtttttattcatttaaattttttgtggatatatacataggtgtatatatttacctattttctgattatgatgtggatgcccatttaggcactcctattctgtaagttcaaaggagcactagaggtcaaaagccattttgtcacttaataagaaaaatatctatttttaaatcttctcttactgttttatgaaaggataggacacacacaagaataactagagcatacaccccaataatgggaactgaccatatgtgattcaataaaaaacaaacatattaacagccttatctttcaaattcatacagtatagctctttatcctcagaggttgaagtccgtattttcattatgtctgccctttctacctcactgaactaagagaaaacatacaaatgtgtactacgagtcaatagtaaagtaatcctcccctatactgcaaactaaggacgtaggattaatagtttctcccttagagctaaaaacaggggtaggagggatactatcgtgtatagaagcaataaaaaggggttacagtattcagtgttcagccatgcattatccaaaggagaagaaacatttcaagtcaacttaatctgatcccaacttcacaaactaacatttttgttgtaatttgctttcccaagtacatgtgcttatcaagagcaatatatttgtcaattgtatgtgaatattctgctgcttgttatatctcatttaagattactgaatttccatttttatttatatatcactttttaaacttaaagttaactcctcccaccccaatgtggatctgctagatgatctgaggcaatcaggcttctgcgtctgcaaaactgagtactagattctggttgataataaattcactggcaaaaggctgtcttctgggtcatttttgagttttcttgatgggacctaccatccatattgaaagatctcctgttttggaattgatgaaatcgatttaatattcccaaaagcatttaattatcagcttctattgtagaacagcttctacccaaatatcatcttcaatcccaccgatttcacttttccaactcctgattttagagtgtagtaaagccttgagaattgagaacagaggctaccatttcaaaattggcatggcaaaaagtgtacttcataggctagaagaagagtagaggtcacagtgttattatctctgtaatctctacgtctggaaggtatgactatgtagcaccagagataagagtcaaagttattgaagtgtaatgtaataaaaatataaatacacttctgcctatcaactaaagaagcagaaaatgagtaaccatccaacagaggatctccccagagtgaaaaattacaacagaagtagtggcaggaatagatttcctgatttaaatagtaaaccatgttgccttttatagagtatatgaatgaaattggcaagagtagctaattaattatagctgattactctatcaaatctcttggtagcataagcaaaacattaactttttataattatttggagtcaatgcactccaaatgcagtatgctccatccatagggcatacacattttaaaggcttttttcctaaaagtcttcactgcaattttagatactggtattttgagaactagaattaaataagacaattcataatatagtgcaagaaggctgaacattttaaatatatctacagtattggaaaacttaagatatgtagttttgtattttgtgtagaaatgacaagtctcagatgaaaacattaaactctaccatactaaaagcagtggtagtccagaaatttaccaaccttcaggatcgagtagtttctctatgcctaattgatatctggcgatgttgaatgcatgttccagtcgttgtgtggctgactgctggcaaaccacactattccagtcaaataggtctggcctaaaacacatacacatacacacatacacaaagacaaatataaatcaatctagaatgttccatgagatttacttccatgcttaattttcattgacaaccaatgcccatagtccttaagtcttgagtgtaattcatttaccctttaaaatatttctatttaaacaagtaataattttaatggaagatctcattgggtgtggtggctcatgcctgtaatctcaacaatttgggagacggaggtgggcagatcctttgagcccagaagttcaagaccagcctagacaatttggtgaaaccttgtttctaccaaaaaaaaaaaaaaaaaaaaaaaaaaagaaagaaagaaagaaagaaagaaaaactagctgggtgtggtgtcacatgcctacagttccaactactcagaaggctgaggtgggaggatcacctgagcccagggaggttgagggttcagtgaaccataatcgtgccactgtactctagcctgggcaacagagtgagaccctgtatcaaaaaagaatgctgaggatgtataccttaaatacatacaacgtttatttgtcaattatacagcaataaagatgtggggaaaaaagaaaatcctgaagatgacaaataatctacgctagcttatccaagcaacaaaaatttatctatctcatccagtctcgtggatttcaataccagccatttactggtaatgcccagttttatatgtctaacccagacctcttccctaaacttcaaattatagattcttctaaacactcattatctccatttagtaatcacaagcttcaagtgtcctgaactgagcttctgatgtttatcctcatcatactcccccaaacctacctacttttcttgctgttctcccttcctcaataatgaacaatgtgtttaaaattgcagttgctcagataaaaacccttggagtcatccttaatgactattttactctcacacaacatttaattcaaaatgtattcagaatttgactgcttctgactatcctcactgccatcactctagtccaaaatccattttatcttgcatgaattatcacaatagcctcataactcttctctcactcttgcctgcgttaattagtgcatagcagagttgccagagtgatctgttaacatgtttcatcatatccgtcttctcaaatctctgctttaggggaagtacaaattacgtatttcatgtgatctacgaagtccaacagggtccaggtccctattaactctctgattttatttcttgtctctttcctcatattccataaacaggatccatagtttcctgcacttggatttggaattcgcttttcgaagacataaacatggctcactcctttacttccattgggtctttactcgaaaatcacatcactgataagttcttccctgcccaagccctatctaaaattgcatgctggccaggcaccttggctcacacctgtaaaccaagcactttgggaggctgaggctgaaggatttgcttgaggccaggagttagagaccaacctgaaccacatagtgagacctggtctctacaacttattaaaaaaaaaaaaaaaaaatagccaagtgtgctggcatgcccctgtggtcccagctactcaggaggctgaggttggagaatcacttgagcctgggtggctatagtgagccatgattgtaccactgcactccagcctgggtgactgaggaagaaccagtctcctaaatagataaatgaaagaaaactgcatgcctcaaatcaaactcacatatacttattttctttctccttatctgctttatactattctcattaacacttactatttaacgtattatataatttaattaaatttctctgtgtatctttctcttccactagaatgtacaatcttttattgcctattttgttcactgctggaaacctagcctgacacaaaataaaggctcaacaaatatttatcaactacacgagagaatggatgagcacatgaaacttacataccatgttacttgataatagagaaaatgcaaaggagtgtaagaggcagttcttgtcttataaggattttaaatttaatgagcaagaaaaatgaagaagccatatgaattaattaaactctaaatgtgaaaaaacacagacaataagaaaatgttttgtaaaatctgaagcggtcaagaaagttttctgaggctgaaagacagattaaatagacgtttcgacttgcattaaaaaaaatgtattgataatagaattctaagttgtgtgagcgttagagaattaaagttcttagggaaggaaaaaagcaaaacatgctcagataatcaagacctcacaggcctggctccattggaagattctaagtatcaagtggtgggagataggtttaaaagaaagaaactggctgagtttgcataaggtgttggctgttaacgtattataatttatcccaacagcactggaagtcattagtcaagtggttcttcacctattctgaatcacagacacctttgagaatctgttgagagctatgaaacttctactcctacaaaaaaactctccatatctgtgaacagagtctacatacagttttagaatatttgaatctattaatggactcctgtttaagagctcatgctatgcaaaaacaaaaaaacaaaataacgaaaaaaacaaaaaaaaagttacaaaggtagtttagctgttatttttctaaaactgtaattcaaaattggccaggcgcagtggctcccgcctatactcccagcactttgggaggccgagacgggtcaatcacctgaggccaggatttcgagaccagcctggacaacatggtaaaaccccgacactactaaaaatacaaaaattagcagggcatggtggctcgtgcctatagtcccagctactcaggaggctgaggcagtagaatcgcttgaacctgggaagtggaggttgcagtgagccaaggttggcccactgcgctctagcctgtgcaacagagcgagactccgtctcaaaaaaatacataaataaaggtataggtttattggtttcttcttaattgcttctactctagttaatacaccagaatttttacaattattaggaaatcgaatccctccatattttccaatacccctaacagctaacaagcttatggaaactagcttatttacaaattggataatgcctttgttatgaaaaatatataaaaaaatttaaaaattgtagaatatttaggggacttttaagttcactatgcgcactctgccttatcttcatttttttctgtaggcaatgggagtaaaaaaaggacataggtgggaacatatgagaaactagttttctcatctatggcatagtatacaaggttaaattgagtatgatgagaaaaaagagcattgcttatgcattcgtgctgtattcccttgtcttaccttccccatttccttggccactaactaaccaactgagtgtgtggatatcttatctaagtcatataatttatttgagctttggcattctcattcaaaaagcattgaaccaaaaggcctttgaggtcacgtctagcattaaaaatgaattgaattcttttatactattaaaattaattaacattttaaatatctatgactttcaaatgcataaaaattgtaaaactaaccaactatgaaggaaacccacacagcatttaatgttaacctggaccataatttattgacttgcaaccaaggatcaccagatttttaattaaatcaacaccatgattaggatagtgtaaatttaaatcctagctctaccacatgttagccaaacagttttaggtaaattacgtaacctctctatgactcaatttatctatttgtgagatgggtaaaatgacagcatctacgtcatggaacttgattgaatattttacctagaacggtgtctacaaaataataattgtttaaaaacattcgtttctattattttgctgtaatgttaattacatttatataagaagagtgatgtattttcaatttacagactcaagccaaaaacacctatctttacagaactgatataaatgttacaaatactactgatgcaaacagaatgtaatccgaaatgggaggtggagaagaggcgagagtaagaatgtgtgatgattttctcgtttttcatattggtcaaaagttcctttctaaacttggtaaaaatttaaaatgaggtatactcataccatttaatgtaataaaagcaaaaattacaactataaaatgattataagtaataaaattaggaaatacctggggatgaaacataatatggctggttttcatactatggagtaaatacctatactgttagaaattagtttgtcaacaagtagaaacattatcacacatattattataaccagcaggaaccaaagtacaagtagctgacagtgactgcatctaagaattgaaataaggtaagttaagattggggtcatgaagacacattgtgtttctgttttccctttgctcctgattctagtgttcatttgcttctaatttgctgtggtaatacactaaaataaggatttaggaagacaattgtaactttatagttattgtaattttatctgcatcttttgtacatatttctaagcaattatcattgggttttaacacaaaaagtagaaatctggcttcctttgaagggtattgtagtggactttgcgttttatcacacaacttttaactgccatgacacttagtcaatccttatgctctatattaactacatgtctttgttctgtatagttgaaccactcaattattgaaatgagggcacctcatgacattcctaattgtgccaacgacaatcgctatggaacagagagttcaaccatttttttctttagataaagaatatgaacatctgccaaatacaaaaagaagggggagatgattcatgaaagaacattaaacaactgtgaagaacctcttgaaaagtaaccatgtaatacataaagagagttactgatgattcatccaatatgacaggagagagtatataaatgaggatattttgacagagaaagagtgggtcagggacagataaaacagggcaatttgggtatgtttactgtattacctacaaatgtattcagaaatcattaaatagaatattaacaaatatagagtgggaacatgcttgcaggattgaagtcttccacttgaagggaaaaacgttagagagccaacaaggaccacataacctgatccttgatatttttattcatctgcaaatgtgtacatgaacagcaaaatcaatattttcgggcccttagtgttaagcatgtggctgcataaatgagcattgacttaaaacacagacagaatgtctctatcccttctcatctaactgtattgaggctgtggaaacattttcttctgtcatacgagaaacaatgtgttaacgctgcttaacgtgacatttgaatgcatgtctgcctctgttctaaatcaggttgctgagtaattcacctggaaacccagtcgggatggggttaattaaatccagctggagcaagacacctgacaaagatgcttatttgaaatgtgtttgctcttggactgagctttaccttagagaaaattaatattcttagcttttctagaagcaggattggcataggaaaatggtagagtggtcaaaaaaaaaaaaaaatcaaagtgagaaaacataacttgcactgaaaattaggcaagatgcagtccagtgacattttaaacagttaattaggcaatgcatttagccctgggttgggtaaatgaaacgggtaacaggaagaccaaaataaagtgactgtagtccctctctctcaaatacacacacacaagcatatatatatatatatatatatatatacacacacacacacacatatatatacatatatagagtataaatggtgtagtatatatggcatatagtatatattgtatctctaagtgtatgtgtacatatacatatgtatttcctacactgctttgctttttcttgaactgttattaattcatttactgaactttacacaagaaaagcaaaaaaaatctttttcatcttaagaaatataatgttgaatggaatatagttaaggactttggttcactgtattacagtgaattctttttattaaaatccacaaaagatctctctcttgctttatagcaattgatttgctgttccagtgcaattgtttctgttggtattcaaaacattgtgtcatataattaattgtgttctgctctttgtcttggttactaaaaatgctctgagcatcttatgaccctgaactagaacaaagtatacagggctttatggtgtttgatatcaaagtgtgtatctgataagacagatgtttctttctccacactacgtatctgatgatggtaattaatttaactacaactactcacatgagatctagtatcatttttacctgtatagtttaggcttatacaaacacattatctgtataaaaagaccaacaccattctcggcaaagttagaatacaacctggatttactgggattcccagtgtcaaacatattgatactctccccctccactataaccactttcacgctccgctaatgttaatgtttcaacaactgaattatatgtatcccatagaacactggaaaatattcttaattagttcattccaatggaacgttagatcaatgtggtcaatgtacataacatgttgtaaagtaggacatgatctggaaccatactggggaaaaatatgtcatcagagtctaaatcaccacttttacaagttatttaatgtctcagtaatcttcttacctatgactatggatgagagcattcaaagccaggccatcagaccagctggtggtgaagttgattacattaacctgtggataattacgagttgattgtcggacccagctcaggagaatcttttcactgttggtttgttgcaatccagccatgatatttttcattacatttttgacctacatgtggaaataaattttcataagaaaatgcattccttgagcaagaaccatgcaaacttaaatatgaatgtccttgatcttcagtgataaatagaaattttagggccaattagtaatgagacataatagattctaccagaagttaagtctattctcaaaggctaggagtctattctgattcattggtatctatgccataccatttactgaatgtgttcactattactcctggattctgccatattagacccaacatttactgtttatagaattgctcaccttctagctttcaatgaacaagctagagaagacagtgtataaaacattagacttattgttaaccaaggacttaagatataaaagcgctttttggataggaggaatactatagataattgttttttaaagtatatgttcaaattttgcctttgctattaattgtggtaattggacaagttgcttaacctcttctaggcctcatttctgtgtatcttacatgcaaggttagtgtaagatcaaagtacaaaatatggtcagataaaacccctgatttcataccatcatttaacgcaagctatatttattggctgaactgaaaagaagacagaaatgtttgcctacctaaaataaagaaaaaaaacaacaaaggaaggaaatatttatccctaagaggtgtacatatgtagccttggttctattttcattacttggtttccatgtatttgattgtctcataggcttcgtgcatgtgcagatgttattcaacagattatcaagtttaattcttctgagtcatctgatgcagaaatccattctaagcattttttctaagtttcatgaatgcagtgacgcttcatagaaaaaactgtctacatcttttattaaagaattattatttattaaagactgctttttaaatataagccccttatgagatgctggaagaagacatctatgtaaaagtgatcagtctgtaccactaagcactttccttctgggaaggttaaggttcatatactatcaacatttgatcagatgatgaatatttattgtgcattctaaatatgacaattttattttttcatccatatagaagttaacaaatgcctttggggtaaatgcatattttaacatctccaatgttagtcatctttttattaaaaagtaaatgcaaattttaggatatactactaaatctcattttaacatacttttaaaagatttgagatgatgctttgtaaacacagtaacgattcggagatatgaaatctttgcatgtatctgtcacaatcccttgataactaagcctattatttaggagtggattatccaagttttcctaattccttcttgacctacttatttagtcagttactcagtgaatacaggtcaaataattacgtaatttgtctcatattctaaaattataaattgctcaacctttatgtacagtgactgcaggaggtgtattttgtgtcctgtgctaaattacggttggaatcagcagatagtggcttaatggtggtaatggatttgcaataatcaagcaatcctccaatgatgaatgtgattcatttgtgaaatgcttggccagtctgccctctatgtgcataacgttaaaggacaacaaagtattcaatccaaaactcctttatagcatcattatgtcactaattcagcttatcagcctcagcctcgctgttattgcttctacttaggtgcaaatgttgctcagacaaaaaaaaataataaagggcaatgtatgataatcatgtctccttttcctacataaaaggcagttatcaaaaaatcattgagctggtccccaaaggtgagcctgtaaacagaaaactgtcccgtcctcaggtctcactgtctctaaaggaggctcaatttaaacagatgtatttgtgtgtgtgcgcgcatacaactataaatcaatttttaaaaggaaaaaagttgaaatgtctttgagcagtgatttttaaaaatgactaggagttaactgggccaagaaggcatgatggacatggaggtgcaccaccaagattgaccttcaaggaagggcttgttgctccagctgtggtcaggcagcttctagttgttagttctctcaggtaccacctgagttgcagagtcctgccagccaatgtcacaccctctctagggcaacccactactattgactgatgaaggggcagagtataaacactcagccattttaaccccatttgagacaactctgaggggtcatcctagctgcaagttgtctatggggtttgaataagcgtgtcatagggtctacgtcacagctctagttcttcctctttccactcctgtcacctctgcccttctacaggtgtttttttttttttttttttttccagggcatggcttaataaacatgctgcctgccaaactcaactccgaagtctactccccagaacccagactgtgattaaaagaagttgcagcagaggaatagaaatgaagagggtaggaataatcttatatggtaaggatagtttctgtgaagctctgcagaagagcagagcaagaactgtcttgcacagaagtgacttggtaggcaggaatttacagggatggctttcagcagtgcgaacgtcatcattctcctgtaattgcaaattgtatcaataatatgaacattctaaagtgaattagcgttgccattaagtacatcccttgaattgtccagtaaaagtatggacctgacttctgatagctcaccactgttagcaagatttgttattacaaccagctggttgccagagccaagtttagcactccgaaaaaaaaagaattgcacttaagaaggaagaaaaagatgccaaacacatgttatatgctttgcaattttgttcaaacctgcctatgttacaaaatatgcgttactgttttaggctagcaattttatttgagatggacagtagaaaaacagtaataggaaaacagagtttgcattcctgagttttcacaagttcaatgagaagtcctccatggcactattaataacatagtatgttgcattagaaaaaggggccaacatggttctatctgtaaatgccgctcgttatctgatagatctagaatgtacattaagttgaccaaaatgtcctttaatctttgctgaaattcaagggcttctaccatttaataggaagaaaatatgtaatgttggtgtaaaaaaaaaaaaaaaaaagaaaaacacatttttagattcactggattatgatgaacactgagcaagataatttttcaaagtgtgcttaatagttttagaacagggcagtgtgatataagagagatgagataagtaagcagaggctgggaagagtctacagtcttgcagtctcaaggatatggtgattcaagggcataaatgaaaaacaacaggctataagagaggtctcagacaaagaaagatttaaaaagcattccttctgatattcctcattgcaaaagcgcctccacatgctaataatgaaaaatgggctgggtgcggtggctcacgcctgtaatccaaacactttgggaggccgagacgggcggatcacaaggtcaggagatcgagaccatcctggctaacacggtgaaaccccatctctactgaacaaaatacaaaaaattagccgggcgtggtggcgggcgcctgtagtcccagctacttgggaggctgaggcaagagaatggcatgaacccaggaggcggagcttgcagtgagcagagatcgcgccactgcactccagcctgggtgacagagcgagactctgtctcaaaaataaaaaataaaaaaataataataaatgaacaacttgcaagcaagtgaagaaattatcagacataatagtcttgaaagcttatcttggactagttcagatggagttggaaagggcttcaggatatttttaaaaatggtaagatcatataagaagtagtataaacaataaatacagttcagagtgccttttggagctctgtgcatgcttgagttcttctgctggctttgtcaaaacttacatctgtcttacgcaaagcgggatctgcaaactggattcactctaggaattatttgttactatgccataagataaagtcaacaattcagagtgcatcaagaaacttatgtagcgattttacagagtaccatttatgtctaatgtatttaataataaaggaggaagcatgggtgttgggcatcttatttttgtaacgctttggttttattctatcttacatacaatggattaggggaaaagtgttccttcctcaagatattttgagaagtactgagcaacatatgaaaagcagtttggggagagatgcggtatgttgcttgctggttctatttgacaccatcactatatggaacgggctgaaaatcggccaacttgggctcacttaaggctcctatgagctattctttgttgccagcacatattaattcccgctctttctcttcccctctccccgcttactgttgtgaagtagcattaagcctgttcagagaatttggaataaaaatatatgggggccaattaggagagcaacatggctgctgaatttaataggtactctttgtgtctactcactatttgactctgagcaagagcaatctacaattcaagttaaaattcaagccgggcgcagtggctcatgcctgcaatcccagcactttgggaggccgaggcaggaggatcacgaggtcaggagatcgagaccatcctggctaacacggtgaaaccccgtctctactaaaaatacaaaaaaaaattagccgggcgtggtgggggggcgcctgtagtcccagctactcgggaggctgaggcaggagaatggcgtgaatccgggaggcggagcttgcagtgagccgagatcgcgccactgcactccagcctgggcgacagagcaagactctgtctcaaaataaaaataaaaaaaaataaaaataaaaaataaaaaaattcaagtttaccgaatgaagccatgatatctgctacaatagggctggatctgaactattaccctcattgcaagaagccagacacaaaagaacatgtattatattgatataaaatatccaaaaaggcaaatacatatggacagaaatagattgacaattgcctagggctggggtgggagtgaaaaatgactgtaaatggagaagaaacttctttttaaggtggtggaaaagtgccaaaattagatcgctatgatggctatataactctgtaaatatcctgcaaattttaatgaacgtggtgggggggagttattcatccctcaaaatagtttgagaggctaccaagaaccagaactaaaccagattgatgcaaattgaattttacacttagaatgagtacattgatggtctaacaattacatttcaaaaacgctgatttataaaaaagtaatcccgaccagtaaaaacagcagtcatttctcagcctccaaattttttaaatgagtggaaaactttaagcaatcaatacaagtcatatgatacacctcaaataaaagtggtatactacactgagtgccttgcagatattctcccacttaatcgtgataagaaatacatacacatttatttttatttttactcttttgatagtgaagggaccatggcccagaacaggggtggcaatataccaaatgccactaagatggtaaccgtggaagtttaaattcaagttcatgttggtatatatatatacacatacatatttatacatatgtgtataacgagttactattacgtatatatatacaatgagtggaaaatattagtggatataagttcatgtatgattatgtatacatattatgattatactattatgtatatgtatacaatgagtggataatattagtggatataagttcatgttggtcttatatatacatatataatgtgtggatatgagtgtgtatatatatacatatataatgtgtggatatgagtgtgtgtatatacacacatgcatattgtatatatgtgtgtatatatagacacattatatatatacgcatatatactacacacacacacacacgggtgtgtgtctgtatcttttccacaaatccttcaacccattttgcagaggtcaaatagacagtcggaagaccctatgctcaggtgacttaaaaataatttccaaatcacattatggagtttgtatgtattacacacatttattgatagagatacccatattctactaatcttttattggcaataatttatgttaagaatacccaagactgagaaagcctcattcctttggtagtgattaaaataaaacatactaaattaacttatagacaagttatagaacatacatttgtgaaaaaaattactcacctatgattgggactttgtatttttaccttatacttactcaatgaaataaaattttgaaaaatattcctgtaaatgtaccagaacctattttataccgtgatgatccttaacatttcagacgacatggtagtgtcaatttaaaaagcagcactatggagcagggtttgttattgttagaaatacacatttgtttcacacgtcaagggtaaaaattaaaaaacaagattaatgttacccaaaaggaaaccattcatcaggattcttacctgccagtggaggattatattccaaatcaaaccaagagtcagtttatgatttccatctacgatgtcagtacttccaatattcactaaatcaacctgttaaagaaaggggtaaaacatttgaaggtaagagaccaaatgcctagttgcaataataataataataaaaacgtgaaggtaattgcatttagctattttcagagacttagcattgaagctttttgaaaataatctaaaaattaaacaaaatgcatgtgtaaaatcactttccataacaaacaagcaccccaaatatatttactttcagcacatgaatagattactgcagattaaagaggtcaactggagtatctccaaataaaatgtcataaagtatgtttaaaattaagatatgctttctagtatggaattacaactcagaaaaattcaccagtacttccacctagctccaaggagtgccattataattaaggctgactgcattttagtaaaacgcctctgttttagaatgaatgttaggtctctaataaacaatggagcaaactgccagctctcttatctctgtctaggactgtgtttggaaatgaaaatctggcagggttttatttgccttaatcaaggcaaatctctgtgtctcctgtccttcacactcctcaaatgtttaaggtggagtaaagttaaacacaagcatctgaaaagcaagcatatgaaaagatgttcaatgtttttagccaatagaggaatgcaaattgtaaccacaataatgtatcactgcacatttatcataatggttaaaattaaaaaatagtgccataaaatgctggtgagggtgtggagaaactggatgactcaacccctgctagtggaaactcaaatgatatagccactttggaaaacagtctggcagtttctcacaaaactgaacatgtacttattatacaatctggtaattgggctcttgagcatttatctcaaggaaatgaaaacacatgtgtacacaaaaacctgcacctaagtgttcatactacgtttatttgtaatagccccaaactgggaacccagatgccctcaggggtagataaacaaaccatagtacagccacaccatggaataacactcatcaatgaaaagaacaaactattgatacatgcagcaaattggatgaatttcatgggcattatgctaagtggggaaaaagtcattctgaaagggtagcatactgtatgaatccgtatctatgagagtcttgaaaagacaaagttacagaaatagagaacagaatagcagttggcagaggtcaggaatgggagtaagatgtggggtagctgaatgttcttataaaagggcaatatgagggacccttgtaatggtggaactgttctgcatattgactctgatggtggatttacaaacctacacacgtaataatgttgcatagaactaaatacacacatatgcatgcacacatacacataaatatgagtaaagctgggaaaatctgaatactattggtggttttatgaatgttgacatcttggtcatgatatcgtattttagttttataagatgttactacatcgaaggggagattgatcattcaagaataagaaagcatcatcatctgcatcatcatctggggattcctcatatggcagtagaggagagaaattcctccataaggaaaagccactatgaatttatctattgattcattgattcactaactcaacaagtaccttttggctatctgccaggcaatgaagtaataagagcatgtaaaagtaaaaaccttctgctttcatgaaacttaattctagtgatagtgacaatcagatgatatagcactaaagactcaagcagttaagcagagaatatgctatttttaggaaacatactcactcatactgcgggaagcactgctggtagatacgttttgggttgccatggacctgactctggggagacttagatcaagtaataggaacttagattccagtaaccccttatccactgtcataagacttgtcactgtgtaagcaggaagatagttcctccatttccttgtcctcataaaaggtctcataaggtccaatttccactatattcaggtactgggctcagacctgataaaggaaagtaaggtactacccccccagtgtcaaaaagttcacaacagaaggtcacataataaaaaagtatctaccattaggctctagcaattctacctctatgtttataaccaaaataattaaaaacagagattaagatattggtagaccaattatcatagtaacattattcacaatagccaaaatgtgagaacacccaaatgtccatctacagataaatggataaacaaaatgtggtatgtacatacaacggaatattttcagccttaaaaaggaatgaaattctgatacaaactacaacataaatgaaccttggaaacatatgctaagtgaaataagcaagacataaaatgacaaatattgtatgattctacttatatgaggtacctaaaatagccaaattcatagagaaaaaatggaagttattaaaggctaggggaggtgaaaatggagagtaatcgtttaatcagtatgaattcaacttgggatgatgaaatcattctagagatggatagcggtgatgactacccaacaacagaaatatacttaaagccactgaattatacactaaaaaaatagaaaaaatgatacctcaaaccctatctagggcaatgaacctgaatagacatttctcaaaagaagacaaaccaacggccagcacataaatgaaataatgttgaacatcactaatcatcagagaaatgcaaattaaaactacaatgaaatattacatcacacagaatggctattatcaaaaagacaaaaggtaagttgtggcaaagatgtggagaaaaaggaatctttgcacagtgttggtggaaatgtaaattattgtagtcatgaaaaacagtatggaggtttctcaaaaaattacaaataaaactaccatataattcaggaattctactgctgggtatatattccaaaggaaacaaatcaatatgtcaaagaaataactgcacttcaatgtatattgtagtgctactcaaaatagcgaagataggaaatcaacttaagtgtccatcagtagatgaaagaataaagaaaatgcaggtatacagacctacacacacacacactggaatactactcggacttaaaaagcagagaatcctctcatttgcaatgaaattaatgaatctagagtacgttacgtcaaatgacataagccaggcacagaaagacaaacattacatcatgtcacttgtatatgaaattttaaaatgttgagctcatagaattgagagtaaaatgttggttagcaggggatagagcttggaggaggagggttaggcagatgttggtcaaatgatactaaattacatttaataggaataaattcaagagatctactgtacaacatgctgactttggttaataacaatattgtattttgaaaattgctaagagaatagattttaagtgtcctcaaccccaaatgataaacatataagttaatgtatatgtttattagcttgaagcattccacaacatctagatattttaaaaaatcatatgctacatggtatatacaattttttttgctaattaaaaaataaaaaatagttatatggtaaattttacatcatttgtattttaccacaataaaaaataagtcattggaacacacatcgcaccccccccccacacacacacacacacagcagcagccacagataatacctaaataaatgttcatggtttttttccaataaaatttatctatatccacaggaaaaacaattaggtaggcaactgtgtctcacggaagcccaaggggtaagaaaaaggaagtaacattgtgaaaagataagcaaaagacataagatatattcatgtactcagtattgattaaatctgtaaagaaaaaatagattggaatgaagaaaagtatcaggtggagaaagcatgccagaaagcattcagatcactagggggtaattaactgattgggaattggagatattatattcagggacagaattgtattcagtggcagacagctactcttttttaacttttatattaggttcaggagtacatgtgcaggtttgttacataggtaaattgcgtgtcatgggggtttaatgtacacattatttcatcgcccaggtaataagtatggtgcctgataggtagtttttctgatcctctccctcctcccaccttttactcttgagtaggctccagtgtctgttgttccccactttatatccatgtgttcttgttattaactcccctttttttttttttttttgaggtggagtttcgctcttgttgcccagactggagtgcagtggcacgatctcggctcaccacaacctccgcctcccgagtttcaagcgattctcctgcctcagcctcccaagtagctgggattacaggcatgcgccaccacgcctggctaattttgtatttttagtagagacggggtttctccatgttggtcaggctggtctcgaactcccgacctcaggtgatcccgctcgcctcggcctcccaaagtactaggttacaggtataagccactgcgcccagcctaactcccacttataagtgagaacatgtgatatttggttttctgttcatgcactagtttgctaaggataacggctccagctgcatccatgttgctacaatcttatttttgtctgggttgtattccatggtgtatatgtagcatattttcttaatcagtctactgttgatggacatttatgttgattccccatctttgctactgtgaatagtgctgcaataaacatatatgtgcatgtgtctttatcgtagaacaatttatattcctttgggtatataccaaataatgaggttgctgggttgaatggtatttctgttttaacttctttgaggaatcaccacactgctttccacaatggcagaattgattaacattcccaccagcagtcaccacacctggccaatatcttatgcatacattttcagatactgatgcttctactgttattataacaattcacaggatgtatatactggatcagagtgtgtgtatacacacacacacacacacacactctgctctagtagatacatctatacatatatatatacgcatcatttcagggagatatagacatatctatacaagtatatgtgtatctacacatatacacatatatatctatacatctatacacatatatacatatgtatacatctatacacatatatacatatgtatacatctatatacatatatacatacacacacatatatacacatatatatgtaattttagtaggtgtttccacctgccttcctagaaacaatttagaattacatattttaaccagaatgtataagaataggctcttctctcaccaggaaatttttgttttgtttttgattcttttagttttgtttgtatgatcaaatacatcactttgttaacttttatttccatgattccttgtgcatttgaatatatttttgtatcactgacctattacaattccatgtgtgaattgtctgttaatatgttttgctcattaatttctatatggtagttttcttttccttcttgaattttaagagctcttggtaaataagagataacatttgtagaatgcttaccacttgcaaaatgtgattatatttcttataattcaacaaaattttgtatttcattcaaaagtaaaactgtcttacagatttatgatctttgctttttgactgttaagtacaaaggttaacctgacatcacaaaaggaattgtggagtttttttcttttcatatgctttggaatagcttaaagtatataaattattctttaagggttacgttaaattcatttgtaaagaatcctactacactcttcaacagtacacctttaataacctactaaatgttttctgaagtaatcagtctaattttccacttattcttatctcaattttagtgatttgtattgtacgagaaaatcaagttttccagaattttgcaaaattgttataaaattgcttttagtttccacttcatttcttctgtatctgctgtcatgcgtcttttctcatttatctcgtctagtttttattctaagttttctttgttatgactgggataggtttacctattttgttaatcttttcaagagctcacttttgaatggattattcttattcaattttctacgttgaatacaatttttatttttgtttctatttttacaatttcttaagatgcatacttcttttatttccatcttttaaaaatcttatggctatacagttctctctgaatacagatttcactatgcctacatcattagagtatgtatgagctatataaattttaccaagagttcatgaacattttacatttatgtgcattttaccaagagggaaacagagtatcaaagataaatgaagcttccacaaggtctgatttaaaactatgtctggatagaagatatttcattaattacatctagtgaattctccacaaaaagctttaagaggctctctctccaagttaataaacatttcacaccatgatacagacaaggattattatttattttggttgtgttttgtctcttgtacatgtcttcttcaaactaccaaggagtgtaagaaatgctaattgataaccatgaagactctagaggagggaggtatttgtcatgcctgaaagggtattgttcatggcatttatattactcttcaatgcctcacattgacggtctggtctgttttggccatgaattctcataagcttgttgctcttataatgctgtatttcttactattagctgtaagtcataacatttttctgaattcagtactatttcctcttaaataatcatcaccctgccatacagtaacttctcttttatgtttttttttctaatacacattccagaattatgtctttcaagaattatcagtctaattgctaaataactgaatggtaaaaatattaaaaccttttaaaatctgtgtgaagtgaatgattacatctgtctactaagcaaaacagaaaacattaatatgacatgtatgttaatgtacgagcctactgtgtgtatcagtgttgtgacaagcactctatggttggaaattaaatagtagggtcactgtggttacccaaagttctgctttcctgttttgcacaatgaaaacatctgataccaaaataggtgtgaaaattgatattctgtgtgaaaatgtaataacatgccttgagtttttgcagaaataagttaaactacgcagcacaattggcttttgtagttcctgtcaacaggcctaagattttactcataaagtaacatgggatgctgtctcagagttttacactgttatcttcggaagttgctttattcaaatgtaattttggaggatagaaaacctccatggtttgctttgacataatggaaacttattgtgactccagtagaatattaaaatgtgaactctttagaaacacctcaagttacaataagcagtctgtaagaattgcacatagaaaacctaatacattaaattattctttagtatggagtagtctcctgctgtctattttaaaggcataggacaagaacttaagggggtccctcttctatcgccagactagtacttacaatacataattttgtataacaatatatatttagtaattctaagattaatatataatcatttcagggagcatttacttccaggtactctacctcctaaatgactgggctatgaggaacaattctcgtcatttgcttgttcgagacaggcaaaaaacctcgctgttttcttttatcccactttccttcaggaacatggatgtaatttctaccatcgtcaatattttattcaagctaagattagatatcccatgatggtttacagtaaaaggatttatacttattatattgatatattcaagatttaagaatacttaagaaaaacttaagatgaaagtaaacctgaaatatgatggttttctgaaagattattgacaggaacaagttagtgttatttttgatttgctttacagaaagaagaatagcagactagggttcatcaaacagaaaatagtaaataagacgtcagaatgaggggcatgtaacttgaaaataatttcaataaccaagtcaaataatgaaaatggaagttcttagggcagagcagaaggagagagagaagggaaaatgatgaataaaactaagagttacattcctgtaagatatttacgtgtgtgtgtgtgtgtgtgtgtgtgtgtgtgtgtgtgtgtgtgtgtgtgatgtgtggtttgtgtatgagagagagaaaaagacaggtgacaaagttctgacaaagctttaatgaattttttcatacaattttatttttgttagatgcagagagagatggatgtttagagttttgtgtatcatttaagcatttgcggttttaacttggaagttgcagaaagttatatctcattcacaggggaaccatcatctttataatatatggtgtctgcctcttcttgcctttttagacaaccagtgacaaggacatttcagagctacaggctctaatgaaaacacgtcctgcgtcattcagccaattgaaattagactaaagcaggtcgtttctcacatttgtttcaaaggaattggttctcccagatcatttcagagtttgatatttgtcctaagaaggagtcacttttgttccctcatatgcagtgtaaaatacaagcatttttaaaattagctaagggagggggataagggtaagctaccttttcactcagtcttggtgattttaactagatatgaaatggtacaaactattataaaataatttcacaaaaagattctgaaaggaaccctgaaatatccttaaaagtttgagttgatttccttaaacagaatcttaaacaataactaaaagggaaatcccatgcattgaaaattattatgtaaatatccttcctgacactgaaacctcaagcatgtacttccaccatctatttggttctttcatttcttttcatttcatttcgttctcataaaatatatataaaccgagaagttccttccaacattctagataaacagaatttgctttttaaacatgttaaatgtcttttataagatgtctgccatcatgtagccaagctaaagacttctccatattcaagagaaacttctcaagtattcatacaatccttctaaatataatgcattttaaaaagataaaaaatacaggaaaggcaaagtagtttcattgccctgcagcatgtgcttttacaccacatttaagatttacactgtttaaaatttcaagacttatgggcataaatcatacctattttcttccattgagagatgcatgtattgaatctttttcttattaaatcataaatacgtcgatatatacaacctaaacggtgggccatattgccactgtggacctggatttccaatgacagctttttattcccttccttatctccgtatttcaagaattatttttgattcagatatagaaatttacattagataatttttgaagcacattttgacctcaactatattacaagatttaattctgggtactcactacaaagatactatctctaccttcaatgattaagttttacatatttagtcattctttaactatttttgaccactcactatatgccacgcatagaatgttaagaataaatttaaaaaatagactttcaacaaattgcttatggacaagtgaaatgttaaatttcctctatatttcagatatgtttatgatcactctgatacattgcaggagaattatttttaatggagtcatgttttcatttgtttatatactgcctctttgacaataaagaattgaggcagttaatacaagtgtctcataatcctaagaaaatatgaacatttaatggcatgaaagacattaaaacaaatttatcaaaatagaagttttgatacaggtaatctggttgaacgtattaataaaatgcaaactaaactttttgggaaagtagctcttttaactaaactcaacaaaattccttatatagaatatatattagagggcattgcctgagtaaatggacactgtcctcaatactttcacaatttagtatgaaagatatatatactttcagtatattatttaatttgaatttttgtaattacgtatcttttatctggcaatataggatgtaactttaacgacaaaaatcaacccatatagccccaactttttaagctcaagtcacgtatactaatttcaagtaaaaaaaaaaaaaaaaaagcaatagctacaataaaaatcttaaaagatacttgagtgacattataagaaatatttttaaacagtactatttatagttatataattattatcccagcagacctccatatgtgaacataataggtaactggctatctcaatttgaagttgaatatacaagaaatgtgtcaatactaatttcccttaaagcaagaggtatactaagggggatgggaagaataaacaactcacccagaaaattattttaaatgagaacatgctgcaatttaagagtagttatattaccttgcaactgaatgtgagtttaatgaatacgagattatgtttgtatatttgtatcttccataacaagtattttgaaagaagtgaacatttactattaatgcatttcgcagatgataaagtgagtcaaagtcacggaatcatttggcaaagaccctatagttgataagttacagagttaacaagatctacctcttctgcaaacttgagaattaatacatataaagtgcaaatattttacaggcctattgtgtggactgacaattttgtgtaagaaatacttgtctaacaaattaaatttggaatttgtacttaaatactagattttatgagtaataaatagaagtagtttatagtcaaatatattctgacatgctccaaaatatgtattatatggctatttaagtttctgaatacttaaaggacacataaaatactagttttaaagaacattttagaatcctctttatctaacattatatgccagcatgtgaacagtatatcatttttcagatcagtgacatctgacaaccattcaatctaattcagtgactattttcaatgatggggttaagtgaatatttgaacatagctgtcatctgaatttccaccctaggctttttaaatactcaccttggatttgtgatttaatgtatagcaatgactatttgctttgtagtatcccacattgtagatttgaagttacttggtaaaaacttaccaccttgtgatagacaattgatgagctggtacaatgaacataattattagatctacaactgtgtcagttaatattaaattatattaagtcagcgaagtcttggtaatgttcctagggtatatttcaacactataccttttgtatgaatctttataaaagggatcggaattcataaaatgtaagcaaggaaatcataagagggaagacgaggacacaagcttggagaaaggaagacagatcataatacatcttggggagcggggggtagtttaaagcaccacagttaaatctctatcaaatttgtaatttctaagttcctttaccagacaaaaaattaatcattaaactagacacaaaattattaaaagtgcaaatatctaatagagaatactcactgattagaacttagttatatccaaggaaagtttaaattacccattaaatatctttgagagaatagagttaagtgtagaactgaatttaaaatgcctaatgaaaggcactacttacaaacaaaagtgggacagggcaaagaaataatagaatggctgtataagagatgtttcatcctagctgggatttgctttaccttcaaaaacttgtaaataaaaagaagctgtggatacatttttacctagagctgatgtagagacaagaataaccacttagtagcatagtctcccatttctcaggattttgtattttgttcgctttttaaaatcacaaccaactattacaaatgagctttgctctcagcaaataccgcaataaagttatcactgcacttagaagtactttcttctcaataagtggctttccaaaatacattattgacagcagggataacttcatgctaaaacagccaccacaaagaatgcaaattggaacacagacgtagtgtctgagctctacagatataagctgagtggcattcaagtgaggataacaggttaaacgccaggacagggaaaggaaagaaactgaggaacagggttaaactgaggagctagtttagaactacagaatatgctagaactagtgatttatggcagagggacaggctaaaatggaggagaccctaaggaaaagagagaagacaaaatgaccttgacttaatgatccagaaattaccaaaaagtatcattttgaaaagacacttctaatattcctttaaaaatcagagggctaaattttgagtgatttttttaaaccagggtttcttttcataggtttatagaattaggaggctgttcatatgattttctattagcaattatcaatttcttggtgtgtggacaaacttatcactggtattcaaaaaaaaatttttttttttggagacaagtcttgctcgatcccccagactagagtgcagtggtatgatcacctctcagtgcaacctccgcctcatgggttcaagtgattctcatgcctcagcctccccagtagctggaattacaggcgccagccaccacacccgtctaatttttttttttttagtagagacggggttttgccatgttggccaggatggtctcgaactcctgacctcaggtgatctgcccgccccagcctcccaaagtgctgggattacaggtgtgagccaccacgctcggcctcaacttcattttttataataaacatatatgtatttctgtgtaaaacccgtttttggtttctatatctcatacttaatatttcccttccatttttaaactgcatacatttgtttttctccctccttgtctggatcacattcataagatattaatctatttcatattataaggaactagctgtatattttatctagtgtttcttctatttctttatctttagttcctgctttccttaaagcatttttgtaacatttttatttgaaagcttgattcaatttatctttttaatgaagatcaaaatcaaagacaaaaattcaaactctcagtacagcctgagccatttctcatgggttttcatatggaatgctttttccttcacaaatgtagttttatactcttggtttaacaaaccttaatcaaacttaatttataagtatattattagtttctactgttattaaataacatgaattttgaaagtttgtgtgtatttaatgacattttcactgcattcaaatatattgcccgtttataatttgtgtatgtggcaggaaattttttttactattttcctaagcctttaacaagtttacgacgaagagcagatatccgaagtgactctcagcgtgtctttcttttctggctctggttgtctccagaagaataggaaggagtccttagtccccaaattagccagaaaccacgtctactctctgtcatcaaatagaagtggtatggcctcaaaggtgactggcttcctgatgcatccaacaagactgggccctagccaacatcagagttctcggcatgcagattctcaagtcctcatttcgcacagaaacaaaacagaactagatacctggaatgccgattataccgttttccactcctacttcactaacccaccaaacttcttcacctcttctttgtatgtgatgactacatcacctggaatctcttaaccttggacttctggttagactaaactaaggagcggcactggcaaaacactggaggattctatggagagactaaggtatcacttctctcaacttcaccaggcaatgatttgaaactaacagcattctttagatacctaggggctcagttcacagttgtgtccagtggcgctctcccaacatgagggattttatcaaattaatagccctctccccttgactgcttaggtttagatgtagtaaaggttattaactcatgtgaatccctgcattcttcaccatagtttcttcctttaatcctccccacgtttctataaatattcccctgattacactctcttcaactttttctgtatgccacgtgtttaatatcaggacagttaatacacttgacttcacaagataccttaaaattgtatagtgaatgtatcacttggttgcctcaatgaactgaaaatgaaaatgcttttgccctatgaaagacaccatgtggatctactgagctctggccattccataggctcaggggagagcattcccaataatgacagacatacgattttctgaatgccttgttgagagttcagacttgaatttagttaatgtaactgaaatttttaaactattgctcttcttgcacatccaacttcatagggagatttattgataatgctcatattttatagaagtatctactatgctttagtgttgagatacagaaaatcactattaaacctacagttatttgtactctcaatcttttgctgttaaatatgtcataaacttgacagtggtgaattaatggctctaaaaatatatttccatcaatttttcttcatggatttagcagcatttctactgtgcgatacgttttcgttattgactgtaactttcttgaataaaatgacactctaagtttgttagtattctatcactgatttttcattttgtctgatttttcctgttttatattttttattattctttaagttctggggtacatgtgcaggtttgttacatagttatacacctgcgatagtggtttgctgtacccatagacccgtcacctacattaggtatttctcctaattctatccctcccctagccccccaccctctgacaggccatggtgtgtgacgttcccctcctaatgtccatatgttctcattgttcagctaccacttatgagtcagaacatgcggtgtttggttttctgttcttgtgttagtttgctgagaatgatggtttccagcttcatccatgtccctgcaaaggacatgaactcattctttttttatggctgcatagtattccatggtgtatatgtaccacattttcttaatccagtctatcactgatggacatttggccaacatacatacgaaaaaatgcttatcacttgtcattagaaaaatgcaaatcaaaaccacaatgagataccatttaacaacagttagaatggcaatcattaaaaagtcagcaaaagatgctggagagaatatggagaaataggaatgcttttacactgttggtgggaatgtaaattagttcaaccattgtggaagacagtgtggtgattcctcaaggatctggaactagaaataccatttgacccagcaatcctgttactgggtatatatccaaaggattataaatcattctactatgaagacacatgcacacatctgttcattgtggcactattcacaatagcaaagacttggaactattactgatttttaaaataacctgacttatgacccatttaatttctagtagtgtttttttagtcattgtcatctcatttagacctgagtccaaatgccaacaatggctcaccatgctttcttcttctcacccccaccttactacctctctgctcccctatctctgctatgtttcctttatctctaaactcactctactccacttgctgaggcctcattccaaatgctttttcaccttaaggtctttattaccgtgcctaacccaccttcctatagacaattccaaggctcactccctttctccaggtctctgctcatataggaactgaaccaaaaggtcttctcagacctcttattctatgtatctcttttttattcacttaactgttcctaagtatatatgcttcatattgcctaccatgtggctgtaatctctgacacacaaagggttgtgtttgctctgacaccaatcaatcaacttatatacctgtgaattttaaaaggaaatttggataggacttcttcaatgtgattatttatatcctgcacaggcttattgatatagaacacacccaagctcaactttagaaaaaaaatcctgcttgagcattttgatttattcttcctaataagcaaactaaagttgtacttatggatgttttccatttttgtttatacttatgacaaaatggagaattataagataatgcattttttttttttcactctgtggccaggctggagtgcagtggcacgatctccactcactgcaacctctgctcccaggttcacgtgattctcctgcctcagcctcatgagtagctgggactacagatgcacaccaccacgctcagctaatttttgtgtttttagtagagatggggtttcaccatgttggccaggatggtctcaatttcttgacatcatgatccacccgcctggaccacccaaagtgctggtattacaggcatgagccaccgcgcccagcctagatttacttttgaaaatccatgtgttattgttcagccacaggctaaggtaaaggttcctttgttccaagtttggtttctgcatgagaatgtcttgaggttttgtcctctaacgcataggccagcatcttatgcagctccccattaaagctctagctcagatgaaagcattgttaatatctgcttttgaacaactccttctcaaatttaagccattattttggggccttttccctactaaaacattaggaggttctatattttctgtaagaaatgtggccttccctgaagagattcatatgacatcatattctaattttatattcacttatattcatttaataatttcattagaaaacatggggtctatgatcagatttctatatatggcccgtggagtttcggaggttttaagttcccttcataagttcctcttttaattgaagtggaatatgcatatagaaaaatatacataagtgtacaacttgatgcgttttcttacagtaaatacacatgtgtaacagctatcaggtcaaaacatggaacagtgagcaccgcagaagattctcttatgcgttttactgacttactccttccaaaagttaaccactctcttcaattttaaacccatggaaacattttgcccgtttttgaaatttaattgaaagaaatcatagtaggtataatttgtctgatttatttcactcaaatacattttaacgacttcatcttgtatattgtgtgtagctatcatttggtcattttcattgctctgtaatatcccatcatgagaatgtatcatagtcacttccagtttgggctatcacaaatgaaactgctatgaacattctcacatatatatgtgtttttggcaaactgggaaatgtatttctgtaacttgtatgtctacaatagaattgctgggtggtaagaaatgtgcattttcacatttagtagatcatgcccaactctttaattagttgcctgaattatatttccagaagttaattgtgagatttccagttgatccatgtcctcatcaacatttggcattagtagtctagttcagtcattttggtaattttgtactggtatctcattacagctctaatttaaatttcctcaagttactgctgaggttaaacatttcttaaatatgattcttgaatttgtgaacaccttttgtgttcctgttcaatttcagtttctcattctagaaaacctaaaatttaaaaaaaaaatcaagaaaaacagaagactgggatactccatatgtaaatgtgtcagttattctctatagatttaactcaatgttaatcatacttaaaatgaatgtacatgtaaatggaaaagattacaaaacaaatacaaaaatagaaagggccaataaccaataaaatctcgaacaaagtgggagaacctagttcaccagatactaggctgtattataaaactacattactccacattacatgatatttgtgtgtgtagagagagagagaacaatgcaagagaattgaagtgcaaaaacagacccacatatgtacggacaaatttttaatgacacacttagtactgtgaagcaatgaggaagcattatttttaataaatggtgtgttaattagacttcaaataaaataaatactgagtcttaacctattcctcacaccatatgcaataatcaatttcaggtaaaacagatccaaaaacaaaatggtaaaacgataatggttctatagataataacctaatatagtatcataatggctttgggtaggccagtatttcttcaacaggtcataaaaatataaagttttaaagaataaactatatccaagtggagaacttgtttttattaatattaaccattgaagtgagtaaaaaggtaatccacagaaaaggaaaatacatttgcaactcaaaacaaagggctcatatccagaatatagcaataactcaattttgatgaagtccaagttaacttttctctttttgaaacatgctttggattcaggtatcataaatacttgcctatcccaaagtcatataaatttccttctatatgttttattgccaggatttttctggttcccttggagtaggcagatagccagaaatgagcaggcaagggagccccattgagaaaagaagtcctgaagatgctgtttcactgagtcagtgctgcctgttgacaatcagcgaaacggacaatgaatacacacactgtccacactgattatgtctagccttgtggttgggctcctctagccccaaaggggacttctcaggccctcgccagagataaccacgctagggattttccccactgacaagcatgcacacactcctccaaaaacttgccctattcttttgctcattgtaatagtgtaaacaaacaaacaaacaaaaaaacccacacacccctgggtggagattttagatgccaatgagatgtggtatgtgtgctagcatgtacaaccagagcatgtgtgcccaaaaaacctcccaaaacatacttgcaagtaagaccccccccatacaccctttcatgatttatcacgtaggagtctcaaagttccccagcactagctgctgctggctctttgttcccttgtgttcgtgtgcattcagtgtttagctcgtacttattgagaatatgtgttattcggttttctgtttctgtgttagtttacttaggataatgacctccagactcatccatgttgctgcaaaggacatgatctaattcttttctgtggctgcatagtattgtatttcatgctgtatatgtaccaaattattattatttttttttttgatatggaatctcgctctgcctcccaggctggagtgcagtggcacgatctccactcactgcaacctcagcctctgggttcaagcaattctcctacctcagcctcccgagtagctgggattacaggcatgcaccagcatactcagctaatttttgtattttttagtagagacggggtttcgccatggtggccaggctggtctcgaactcctgacctctggtgatctgccagcctcggcctcccacagtgctgggattacaggcatgagcaccgcgcccgacctgtaccgcattttctttatgcaggattgagttttacaggatatcccaaagtttgtttttttaaatgacattttcttgctggggacagtcaagctacaaataaattaaatctaataattctgtgttccgctcttttcttcactgctacattttgaaacagaatatgatattttgatatttcaaagacattttctttgtgtaactttaatattgttaacaattctcataatgtcaatgacactgatatttccaaagagtccatcggactaataaacaagaaaatcagctcatagattattctggctgcggagtgaaaaatctagttaatttcttcctaagacaaacatctctgtaaaataactttcataggttaaaggtgacaatgaccctgaattcataaaatcagccaattaattgctgcacagtttccatttccatatcttatgtaatgtcatctccctgccagataagctgagcaacatttgggggagtacatgttattattaatctatccctgcttatggttattttaagagtaagtgatcaacgtactcaatgtacttgagtttatctttgaaagagagaggtaatgtaattagggagctactaagtgcctggtgaaatgtattggtcgattagacagattttaggatgttaataagaaaggaaggctgcctccaatgccatgacacaggggaagagtcaccaagtggttcagaggagattagaattcctctgacctgcctacttggtttagctgtgactgtttacttcttctaatgcaacacacgtattttaatccagttaaatctaaaccaaaaaaacaaatctgccattcataccccaagtaaaaatagtgatgtttctgtataatttatatgcttggagacagcgtttaataagtgttggcttgatttaaacaaacatcattatcaggtttgaacacatttagtacataaatatttggtatagaaaaatccgtttgttgcacaaaacactgccgtaagaaacagagttcaccgggcacggtggctcacgcctgtaatctcagcacttcgggaggctgaggcaggtggatcacctgaggtcaggagttcgagactagccttggccaacatggtgaaaccctgtctctactaaaaatacaaaaattagctggccatagtggcatgtgcctgtaatcccagctactcgggaggctgagacaggagaatagcttaaacctggaaggcagagtttgcagtgagccgagatcacgccactgcactccagcctgggacagaagagcgagactccatctcaaaaaaaaaaaaaaagaaaagaaaagaaaagaaaagaaaaaagaaaaagaaaagcaaagtaagaaaagaaaccgagttgactgcaggactttgtccaccaaacacagcttcatgaagtaaaatctgaaaacagggagcagcctatcaggtcaggtctatgtcttttcccttccctctgtggcagcatgcatttgcttcctgaattatattagccacaatcaggcatacacgaattacaacatgtgctctcagtaagaactggtctgatttacaagagaatttgaaatactttctctgcatttggggccaaagccctcactcaaacatgaagcatgctgtgtcacagcatccagaccttgtccagggtactacttacattattgttctgcaaaacccgcagtgccttgttgacattgttcagggcatgaactcttgtggatcctttttcttttggctgagaacaaaacaaaagagtgttcactgaccagcagagagaccgacaatctactagaaatgaaaccatttataatttcactattaagcttgaatattgtaaacgaacagagcctgtgaggcattaatataatgaatctaaatactttgcgctaattgtccttggcctggtacgtttttagcataaaccaaccactctaagaatggcaacactttttctttacaaagcctattttggtatgattgtttcttcattctatagcccagttggggattactgcatgaccaccaatgacagaaacatcagcatgcataaaaacattttctagtaagatagaaaaacaattcccaaactttttagaaaaatctaaaggagatttgactctagcaaaattatataatgccaaatagggttaaaggaaaccttttctgtgaagattaccttaattgtccttgtcactgaagctctaaacctcaatcactttggttccctaattttattctcaatcccaaaagttgtatcttatcctgtaatttttaaaccaacatctgcatagttcattgtaatatacaaattaactcatttattaagttgtagagttttagaaattctaccattatgataacctgttttatttactctcattttcatttcttttaccttactacaagcccttattagctattgcccagagaaatctaacctctttcccttctccactcactcaccatttttttcatccttccttcataccatcaacaatgacgttcctgaagtaagcccactgccaatgcaaaccacttgcaaagttctcacctaaacatttgggtgattataggtaacagttaagggcaagagctacaaagctgactgcctgggttcaattgtcagctctgctgtttttgtgctgtctggcctacataaaaaatttaatctccctgtataccagttttctcatctgttaaaaatggacttaatgaaaatattagcaagaggcatacacaagttacaacatgtgctctcaataacaactgctctgatttacaagagaattcgacatactttcttctctgcatttgaggtcaaagccctcactcaaacatgaagcatgctgtctcacaggatccagaccttgtccagggcactacttattgttcatattgctcaaaccattgtacatatggtttctggcagaattcagtgtgtcgatatgcataaagcactaagattggtgcttgtcacatagttggtccaacataaatattattgacttcgtagtatgtgccaagtactttgaatgcactacctttaatccccgccttgcaaggcagttagtttcatccctattgtacagaagtgaacctcaggttaaaatatctaatatatagattaccatataactaataattggtggagccaggacccaaacttttgtctgtgtctgtagagccccagtcttgcaaatttatttccttcttctctaactaccttgtgcatgcaccaaacaaatatctatatttctgtgtcttgcatttaactcctatactttccagcaaagctcctggtctttctcaagtagttcctcaccctagaactccttatcatttgcactgcctgctgaacaacccaaattaagctaaagccatcttactctccaaggtaacttgcctgatatcctttataacacagtattgacatcttgttcctttgatttcacaaaacattaaggctaaccttatgaaccagaatctccatttttacctcttagattttcctccaagaatgtcagaatgatgttggtttacattctgatatttctcccactttccaccaaaaagaggaaaaaaataagactttagatttaaaaaaaaaaaaaaaaaaaaaaaagcaacagccagacatttggggaggctgaggcaggtggctcattgagatcaggagctcaagaccagcctggccaacatggtgaaaccccatgtctactaaaaatacaaaacttagccaggcatgatggaacatgcctgtagtctcagctacttgggaggccgaggcaggaaaattgcttgaacccaggaggcagaggttgcagtgagccaagatcatgtcgctgactccagcctgggcgacagagtaagattccatcaaaataaaaaaaaaatacatgaaagaaaaacagcaaataaccaatcttcttgtgtatatatagattgacagtatacaagtttaatggtaattataggactttaaagttttgaaaataattactcaaatcagttctctgcctagtagttagaccaaagccacatatttcctttcaattatgtaattatatagtcacaagatttagcaaaattttcctttgtatcatattcaaacattaaatgtacacatgtgcatatgtattagaaccaaacatagtctactcttttaaaaagctgcagtttctgatcctgaagtgggaacttaaaatctgcccctattagagtctccttggggagtatttcttattttatgattgtaaggcaagtaccttccttttaaccctggggatgtcctgagccaataatccaaatgcagatgcttctgagtagaatactaaaatttctgttctatagtatacatgcctcccattaggagtagaagatatatctctacagaaactattagaattcaagacaaggcatagcgaattggagttctgggatcgggagcatttgttagaggtgattctgctttatgagaaaggcaaaatcctcagaccagggctgacagatctgtgattaggacaaacaatggtgaatggattctgttagtagcagtatctgaaattatgtaatctacactgccatgtgtaaatgtttggtgatttttccctaccactagcttaccttatactggccaatctcatggatattttgtttgatatttttttctttaatgctattactaattaggttcattttgtcttagcgtctatgtatgtatatgcataaatgcaaatcatgtggattttttaattttgccgaaattagtggttttttctttatatcaaatgggtagtgtgccaacatcataagtttagagaaaggcttatctcatatctgagtataaacacccaaatcatgcttatgaattacgaaaggatctgaaattcattatcttaaacattatgtatgaaatttgttaaccctgactaaattgctttgggtgatagatggattgactcagtcagggaaatgaccagaggattgcaacacaggagaagtgatcacgcagatacctggaagtgaagagacaacagcctcctaacagagggccaggacaagatgagtaagccataatctttgaaagatttttcacgaacatttggaagacactgggacttctgtattcggtaacaaagtaggactgacttcagaatacaggagaaacgagatacacagacacactgatttctgtacatatgctacgtatccatatatatgtaaattgttcacagtcataggagatgaattacacacaaatctatctctaactagtgaaattaagaccaagtttacatgatgacctcaaattggcgcccagcaaacagttcagctataaggtattaaatctgattttcccccttgactaaagttattatttcaatatgtcatcaagttgttcttctattagtacaagttcagacttcttgaaaaaaatggatccgttttagtattaatctcacatagctgaagataaaaaatgaaagcataggtatgtctcttctgtataggacttcagaatttaattgaggagggatgtcagtcatacatacactaaaaacaagacaaaaatgggccttctgtggaatttgggagggaaaaattagcaaaggtaatttgggaaaagctttactgaggtgaaatcaaggtttctggcagacagttggggtagacagaagtacaaaaagaaatacaggcaagtaaaataatacaggcaaaaacccagagatatctgacaatatataccgagaaaagagtggcttagcgttaagtgttacaggaggcaggctggggtagataggatttttgctaactgactttgaacgacagcttcagtttgtataatatgacaaaatctgtgtgtgtctgtgtgtgtatgtgcatgtgctggggagttgtaatgaagggcaaagataagagacgaaggctatgatttagcagaatttgataggtagaacagttatttatgactatagactgggggcttaaactctactttttagaatagcaatctaagacgattatttcagtcaggggatttcaatttgagttctttccccccccagtgtaagaccttgatcaacatgacttcactgatctgtaatcatgtatatcaatcatgtatcttcacaggaatgctctgaagttagacaagataatagttcaagaggaagtgatattttcatcacatatgctatcacgtattacactataatgcctgtaccttattttgctatcccacatgtataaactcatacaggttccttgtaaaataacttcaaaaatacacaaaagtacaaagataatttctcaagtcattatgtataaaagccttcattaagatatttgataagatagataccaagtagtaaaactgaataatatctattaatataaattgtattactgaaatttttactttttctgcaggcggtagagtatgccaaatgaaaatcatacgaggttgctttactaaggaataggtattgctgtttcaatcagtacctagtcattctactagatgtcataaaactatgttgtcagtttctggtctgaaattctactaagtttaaagttaactttcttaaaaataagtcacataccagtttttgccctgtcaggccttcgaggaggtctaggaggcgcctcccatcctgtaggtcactgaagaggttctcaatatgctgcttcccaaactgaaattaaaaaaaatacactcaatttaacaaagcacacttccaatgatacattttcacgattatccccttttgaaaactaaagctatatttaaggataattagtgtgcataattaatctgccgaagatgacggatgaaaaaaggaaagttcaaatgacaaaaaaaatttaaaaattttatcataggtcaagtctatttgaattagtttgaatagcaagagtaagagatttataccctaaatgatctaattaattcactgaaatgaatatagattctatgaaggagagaaaaaatacaggcatgatcaaggcagttacgggtaaagggaaaagtaaatacacaaagaagcaaaagaccacaatctacctgggtgggtacataaagtttaaccattcttggaatataccagtcagagtggttcgacatccttatcactcaaaacatgcttgctgtgcatacacattttgcatgctatgacctattctcatactggataactcaaattttaggaatatcgggtttaattaggtttgaaacaaccctgtgagagcttttcatctattttactcagttctttgctcaggaattatactaaggaaaaataatagtcaataaataatatttaacatttttaacgtaaatactcatgagacacactattaaatgagtggatttcataaccgttgtggcatttctgagattagcagtaacatacttaacctctaagtatctcatgtaagatgagtatgtggctctttgtcatgaaactagaatggggtaaagccaaaattatggctcagatctgtctaattctgggttcttgttctttcaatcttatgttgcttccttgtccttttataacctactatttgattatctttctaacatttgtctttcttttgtcatacttcaccaaatcgttttctgcttaaaaccctacaatcccctcatgaggtaattcccagctttttcatcacctatctggaaatccctaatttaatcagtcaaagacatattgagcatgaataaacctgagctaggtactgaatcatatgctagtacatcagacataggcccagaccctatagaacttagagtccagcaaagaaaatattcctaaaaggtactattacatagaagcattagaaaggactaaagaacatgtaacagtgggagctctcacaagccttgggatcaacaaatactttccaaaaaacgtcaggtgatgggtctaacattagcctttgggtgactgtgctctttacatacactccttggatcacatataaactttgaatttcacacaagtcaagaaaatccctggtttccaggcaaaagacatcccttaaacttccacgattaaaaacataggatttagactattcctacaaccaggtagccatgtcaatgacaagacctgtaaatgcccgggtacttcaagcagggaacaatgatacctgcggcaaccaaccagtccctgtgtgcccagctttgtgaatccagccacatatatacttagacaaaaattatgagttattcttttgaaattctactcaaatagatccattttcaaattccatgggaaaaagaacataacacaaaaccctaacatgctagaatttttaaagaatagctttactaggagggaggcagaacaagacggtcaaatacatggaaccttccagcaatcatctttcccgctaccgctgctatagaaacaccaaactgaacagatagccacacaagcaagcacctacataaaaaccaaaaatcaagtgagcaatcacagtacttgattttaatatcatatcaaggaaagaggcactgaagatggtaggaaagacagttacgaattgccaacaccacccctcccccatcccctggcagaggccatgtctcatgtagacgatctgtgtgcttgcaggagggagggcgcaggattgtgaaacgttgcattggaacccagtgctgccctgtcacagtgggaagcaacacagggcagaattcatcaagcgcacatagagggcacatttagaccagccctatccagggaggtatcacccatctcagcagttagaagctgagttccagctagtctcaccagtgtgagctcaagcactttggggtcctaaataaacttcaaagggagtctaggctacaaaaactgcaattcctgggcaagtcttggtgtcgtgctggactcgaagtcaggggacttggtgggcacacaacccagtaagacaccagtgcttgtaccaccccatcctctaacccctaacagtgcagctgacagctttgagagagactgcttcttccacttgaggagaggatagggacagtaaagatgacattgtcttgcaacttggacacaagctcaaccacagtaggataaggcatcaggcagagtcctgagaccccccattccaggccctggctcctgagtgacattcttaaatacacccagggccagaagggaacttgctaccttgaagagaagaatccagtcctggtagaattcgtcacctgctgactaaagagtccctgggtcctgaataagcagcagtagtagccaggcagtattcaccaagtcttgggtaagactcagagccatgctgtctttgggtgtggcccaatgcattcccaagtgtggtggccatggggatatactccttgtgcttttggaaaggagaggcaatagagtggactttgtcttgcagcttgggtactagctcaaccacagtcaggtagaccatcaagcaagctcctgggttctctgattgcaggccttggctcctggatggcatttctggactcacctggggcctgaggagaacccactgcacagaacggagagacccaggcctcgcagcgtttactcctagttaactaaaaagctcttgggccttgagtgaacatcagtggtagccaggcagtactcaccatgagcctgaggcagtggtagccatggggaaaaattcctctgcttatgaaatgggaaaggaagaatgggacaaactttgtattgtggcttgggtgccagctctgccacaatagaagagagcaccagatagattcataaagatgcaacttcaggccttggctcctagatggcaagcatcaaaagtcaaggataaagacaggatcctaaaagcagcaagagaaaagatacattccaaaaagcttaacaacaactagtaacaggcttctcagcagaaaacttacaggctaagacatgtcatgccatatttaaagtgctgaaggaaaagaccctttatgctaggatagtgcatccagtgaaaatctccttccaacaagaaagataaagaccttccaagacagaagctgtgggatttcatcaacaccagacctgttctacaagaaatgctaaagagaatttatcaactggaaagaagaggaccttaactagccagaaaaaccatctgaaggcacaaaactcagtaagtacagacaaacacaaactattgtaatactgtaattgtgatgtatgaactactcatatcttgaataagaagagtaaaaaaaggaagctttcagttaacaaataactctaataactttaagacatagacagtataatgagatataaacaaacaacaaaaagattaaaagagacgaagtttgagtttttaattagttttctctttgctttcttgtttatgcaaccagtgttgtctgtttgaaataatgggttatagtgtttgtaaacctcatggtagcctcaaataagaagatatactaagattcacaaaatttaaaaagcaagaaataaaagcatgccactagagaaaaatcgccttcactaaaaaggaagacaggatggaagagaaagccacaaaacaaccagaaaacaaaatggtaggaataagttcttaataataaaactgaacataaatgaaataaactctccaatcaaaacacagtgacagaaaaaaaaaaaaaaaaacaaacaacaacaacaacaacaaacaccaagactcaatctgttgcctacaagaaacacgcttcacctacaaagccagacttaaaattaagggatgtaaaaagatattccatgtcgatagcaaccaaaaaagaacaggagtagctattcttacatcaaacaaaatatatttcaagacaaactgtaagaagagacaaagatcaacatataataaaggaatcatttcagcaataagatataccaattgtaaatatatacgtaccgaacaccggagcacccagatatataaagcaacattattagacctaaagagagctggaaacctcaataccccactttcagccttggacgtcatcaggcaaaaagtcaactaggaaacattgaacttaatctgtactacagactaaatgtacctaataaatatttacagaacatttcaaccaacagctgcagagtgtacattcctctcatcaccacatggaggattctcaaggatgggccatatgttaggccacaaaacaagccttaaattcaaaaaattgaaatataaagtatcttatctgaccacagttgaatgaactgagaaatcagtaatgaggaattttgaaaattatacaaaacacaagggaattaatctatattctcttgaatgatcagtgggtcaatgaagaaattcataaggaagttataaaatttcttgaaacaaaactgtaaacacagcatactaaaacttgtgggctacagataaatcagtactagcaaagtttacagcaataagcacttgtatcaaaaaaaaaaaaaaaagagaaacaatacatcttaaagaactagaatagcaaaccaaactcaaaattagattgtgtcatgaagacatgcaaaacccgaacagaccaacaacaagtaatgagatcaaagatgtaaaaagtctcccagtgaagaaaagcccgagacctgatggcttcactgctgaatgttaccaaacattgaaacacctaatactcaaactattgtgaaaaagaggaggaggaagtacttctgaactcattctgtgaggccaatattagcctgacacgaaaaccagacagatatccagaaaacaaaactgcaggctattatctctgacaaatactgatacaaaaatcctcaacaaaatactagcaaaccaaattcaacacaacattaaaaaggtcattcgttataaccaagtggtatttgtcctagggatgccaagatgggtcaccatatgcaaaaaatcaatgtgatagatcgtatgaacagaatgaaggacaaaaaccatatcatttcaatagatgctgaaaaagcatttgataaaaattcaacatgccttcatgataaaaactctcaaaactgggtatagaagcagcataccttaacacagtaaaagccacatatgagaaacccacagctaatttcatactgaatggggaaaaactacaagacttttctctaagatctgtaacaaggatgcccactttcactactgttgtttaacatattactacaagtcctagctagatcaaagaaagaaacaaagggcatccagattgaaaaggaagaatcaaatgatccttgtttacaaaactaggaatcccattacctgacttcaaattatactacagagctatactaaccaaaaatgcatgctaatggcataaaaacagacacatagaccaatggaacagaatagagcccagacacaactccacagacctaaagtaaactcatttttaacaaaggtgccaagaacatacactgaagaaaagaccatcttttcaataaatggtgctgagaaaactggatatggatatgcaaaagaatgaaattagacccttatctctcgccatatacaaaagtatcaatctaagtggaacaaagacttaaatctaaggcctcaaactatgaaactactacaagaaatcattgggataaaatctccaagacactggtctaggcaaatatttcttgagcaataccctaccaagcacaagcaatcaaagcaaacatgcacaaatgagacatcaagttaaaaagcttctacacagcaaggaatacaatcaacaaagtgaagacacaacacacagagtaggagagaatactggccaactacccacctgacaaggaataaccaaaatctataaggggctcaaacaactccatagaaaaaaatatatataatcatctgattgaaagaagggcaaaaatttgaatagagatttctcaagagatgacacaaatgtcaaagaggaatatgaaaaggttgtcactatcattgatcagagaaatgtaaatcaaaactacaatgaggtatcatctcaccccagttaaaatggcttatatccaacagacaggcaacatcaatgctgatgcggctgtgtggaaaagggaaccttggtacatcgttgttggggatgtaaagtagtagaaccactgtgaagaactgtttgaggttcttcaaaaaaactgaaaacagaactaccatataatccagcaatcctactgccgggtatatacccaaaagaaaggaaatcagtttgtcaaagaaatatctgcaccctcatgtttattgcaaccctattcacaatagccaagatttggaagcaatccaagtatccattaacaaatgaatggataaagaaaatgtggtacatatatacgtagtggagtactactcagtcataaaaaaaaatgagacgctgtcatttgcaacaacgtggatggaactggaatacattgtattaagtgaaataagccaggcacaaaaacaaactttgcatgggctcactcatatgcagtaactaaaaattaaagcaattgaactcatggagacagagagtagaatgatgtttaccagagtgtagtatgggtagttggggacaggaggagtgggaatgtttagtgggtacaaaaatctagttagaatgagtaagatctatttggcaacacaagagggtgattacagtcaacaatttactgtacatttaagaatttgggccaggcacggtggctcacgcctgtaatcccaacactttgggaggccgaggcaggcggatcatgaggtcaggagatcgagaccatcctggctaacacagtgaaaccccgtctctactaaaaatacaaaaaattaggtgggcttggtggcgggcacctgcagtcccagctacttgggaggctgaggcaggagaacggcgtgaacccgggaggcggagcttgcaatgagcccagatagcatcactgcactccaccctgggtgacagagcaagactgcgtctcaaaaaaaaaaaaaaatttgaagtggaatgtttgtggcacaaagaaaggatacattcttgaggtgacagatacttcacttaccctgatatgattatgcttcgcatgcctgtatcaatatatctatttaccccctaaatatactatgtatccataaatttaatctaaaacaaagcaactttactatacataatatacacataaatcttaaaacagtgccattttaatgaaactttaaggaaagctctctagtaataagaaaataaatttacactttctaatagtgctgccaagaacttcatatctaacctggaataatttggtattttgagtgtaataatttgtttttcaaattgaatgaaggtatacaatgccattaaaatgatgtgtttttttccctcctttggccaggagcaaaatttcacacttatctgagcaaagcatgacttttaaactcatcaaaaaataatcttatgcactgcaatgtgtccattgttgaagaaaatatagttaactgttaactgacagagatacttgtttttatgaaaagaaaaaatccagggtagaaagttgaagtctgtcagaccaagaagtatgtgcgtgataaactgctgtttattcaaaaagaggagcagagactgggaaaggtgagagaagtcttggagtacagaataaaacatgaatcccaaagccatcaggatcatatagcatccaagacacaaggactacgtttgggtttggagacaaagtctaggcaaaggtcaaaaacgcagacagaatcttgctttgtgggccaaacttaaatacatagaccaaggtcttttataagtcttcttttaaaactggaggtaaccaaaatggagagggagtaaaggattataggtcaggtaggggattccatgtacacctagctggggcaccgagagagagaaagcagtgaggtgatagagaaacagttcctgctatcgtattattttcgaaactcacagagtcaatgatatattaaagtatcacaattgaaatccaatttctattagtcatattcaccatattctctaatagagtgcttctcagaatattctaccagagcatccttccaggaaatgaaattgaaggaatttaccctggagtctggcagtataaattacacagtgcctgcaggttttaaatttctttgaaagcatatactttatgctaaaaattcctagagattttgccttcttcttttaatatatgcttgtttcaacgtaaaactatttatttatcatttattttttgagacagagtctcgctctgttgccaggctggagtgcagtggcgcaatcttggctcactgcaacctccgcctcccaggttcaagtgattctcctgcctcagcctcccaagtagctgggactacaggcatgtgtcatcacgtccagctcagttttgtatttttagtagagacggggtttcactatgttggtcaggcttgtctccatctcttgaccttgtgatccgcctccctcagcttcccaaagtactgggattacaggcatgagccatcacacctggacttatgtaaaagtaattttaagtacttttgagtaaaaatctcccccacccccgttcccacggtctgatgtggttttttttttagtgaaatgtgctacatttagcctgtaactttatagacctttcggtgctcagttttattctccctgtagtatgaataccccaggtaaaatctaacatactatttctcttggatggttctaattttcctgcctgcaacttactctatagaattatagatactatagcaaaagtaacccaagtttcagaagcagaaatagctaacttctgaactcaggtctctcactcactcactagctgtgttatcttgggcaagtgacagcctttctgaggcacaatttattcactattagaatggggctcaaattattactccagagcactcccgtgaggttcaactgcaacacataggaacgttatacagatttggcaaatcgtatgcactcaataaatatagattgatttttatgtttcattttaacactatttgtctgcatctctttctttgaccaaattctaggtgtaaaaacgtttaactcggccaggtgcagtggctcacacctgtaatcctagcactttgggacgctgaggcaggtggctcacttaaggtcaggagttcgagaccagcctggccaacatggtcaaaccatgtctctactaaaaatacaagaattagctgggcgtggtggcacacacctgtgatcccaactactcgagaggctgaggcaggagaatcgctagaactaggaaggtggaggttgcagtgagccgagatcgtgccactgcactccggcctttgtgacgaagcaagatctcacacacacacacacacacacacacacacacacacacacacacacacacaagttaaagtcttttcgataatataaaaatattatattagaaagtgcagaatacatgtaaaatgttttctattagtttggcatccctgtgggagtgcaagtcaataggggaaggcattattccctatacaattactaaaactggtgaatgcagatggtacagaggatgcacttagaaacttgctttttcctcccttttcttgttcttttgactatttttaagtattcttttgttgttctcccctttcatcttcaacatacaccatgtctttgttgcaggtggcattttatatcctaagaacaatattttttctttaaaattcaacctttaatggcttccttttcaagtgtatgagaactattttgtgaagcacacaaaacatgaattcctccttgggccaggcgaccctgtagctctctgtcttcagttcattttatgactaagatttcccttatcaagtgaactgagtggatatctgatattactcagtttaatgtatctgcatatatattgtctttgttaacccaaaccacaacacgaaaggacctaaaaacgagacagtattccttccaaatcctttttagtatgaaataaagaaatacggaagcacaaacagtgttcaaaaagaaacacagataggtaggttgacaagtggcataaataaagtgaaccaaatcaaagtggaacaaatcaaagtaaaaaaatttgagaaaggaaatgcatttgtgaaggtgtttaagtggtttctgattcttcagagttgtattggtcttttaacctgaaaatccaaagggatcaatacgtttcagtagaaagtaaagaacacagggataatttagcatgaccttctgattacaaaaaggacaagccatggacataactgtcgctaagaaagtcaagatacttctgcaattacaaatccctagacattggaaacaccaaaaatatcgcaaataccacaaagaattgcaaaactggggattcaaaacttactgaagaacgctgctgaccagctcccagaaaaataaggcaacccattttcatgtaaataggaagctttccgagttgattttttttttgttttcttaaatatgagttggaaaaggtattgtataataaagcagtattctgttgcggaataatatacatagaggaaagtacacgtcttaagtgtacagctcaatgaattgtcacaaaccgaacatatttatattaccagcatcgagatttaagaaacagaatatgatcaacaccctagcagcttcctcacaccccctatgtggaagctcccctcaagaatggccactatgacgacttgtggcatcataggttagttttctcttgaaaggagtcacctaaagatagaaaaatgctggttttgtattttgagttagaatactagtgactgaaatacattagatttatgcagagggaatttagaaaaaagtcacactgataaaatatgctttggaaaacacgggggaatggtatgatgccatgaataagaatgttgactgtacacccagaatgccttgggttcaactcccagctctgcagtgtgatcttgggcaagtaacttctccgtgccttactcttttcatctatagaaagagcatgtatcattacctatgttgtggtgatattgcaaagatttaagtgaacttagtatggcactttgtaagatatattctgtaagtgttagctatcacacgtttattccaaactttctaagccaaataatccatatcgtctataactttccttgtaatgttggcctcaaagtaacagaagggaccaacttcaaaatatgagaattaaaagggttaataaatgtaagatgtctggtatggtacctagcatagaaaatgctcaataaaaacattaaataaattacattccctcctgttaaatgttatcacctggaggtggagaatgacactctcctttgaaatttatatggccatagcaggactttggtaatctgagaagagtttaataagggactgtttataaaaatgagggaaggtataatgaaaccactggaactagtaatagagaagtgtcactactactcttagactcctaagaatgaaaagaaggagagtggtttctagttactacatagagagagaactgagaagagaagattatctgacaggagctttgatattgggtgatggaatttctttcctctctccctctcttaccaaggctctcattggccaaatccaactagtagccagagggcaaaggagcctgttgatgtagtccacagacatcagcctcccaaggaagacaaaagtggagagtagggccaaagaaataagccaaagacattcaccaccctagacatggaagcaaatttcctttgagccaaggagatcaatgccagggatgtccatatcagaaaataaatgaaggcctacgtgttacttcccatgcctcatatttctatctctggtgatgtcattgtaaggaatcatatgtatcactggaacaccgtcgtcttctttaatagtgatatcaaaatactggaatgttttgtggaccttagcagataaaatcagtaggtatttattcattattccttagcgtcaaatacttgtagagacttctctctaccaaaaaaagcacgaaaatctggctatgaagatcatcaagaaaaagccaagttattccttgcagctagcaagtgttcaagagcaaagctacaaaatacaagtttttataatctctccagatataaaatgttatttggcattttataaagcatcttaactagaacccaatatgtatgttactctattaagtacactagaaatgattcaaacagatgtgcattcgaactttaaataggaaaccacaccatcgttaatggaaatcaagttgttatatgtaagtgggatgttatgaacccagaagtatgcttaacaaaaagtcagcatgattcattgtctgatcaggtctatccttaacatgttttgtaataaaactaacttctaaagctaggtctcaattgttttatctttaagttaggtcagtactcattcattttaccaggtattctaaaggaaatattaataaaattatggtaaatgctttatcttatatttttatgtattaatgtaattcacaaagttattttaaaatttgtggaatgattacaatccatgattatactaattacaccacctttaaatatcccctataaaattgaacattctgaaagttaaacccagttttttgttgttgttgagactctgtcaccttggctggagtgtagtggcgtgatcttggctcactgcaacctccgcctcccaggttcaagcgattctcctgcctccgcgtccctagtagctgggattacaggcgcgagccactacgcttggctaatttttttatatttttagtagagacggggtttcaccttgttagccaggctggtctcgacctcctgacctcgtgatccacctgcctcagcctcccaaagtgctgagatttacaggcatgagccactgcaccaggcctaaatccagtttttcttttgattcacatagatacatgatttgcatttgagatagccagtgatggaaatgaaggctaattacaatctatcccaatggttgcttttctgacagaaacggtatggtacaaggttggcaagatgaagcactttgtttcaaagcatgcaaataacactgattcttcaaaaaagaaatctataggctaggcgcagtggctcatgcctgtaaccccagtactttgggaggccgagaagggcagatcacttgaagccaggagtttgagaccagcctggccaacgtggcgaaactccacctttactaaaaatacaaaagttagctgggcatggtggcacgcgcctgaagtcccagctacttgggaggctaaggtgggagagaatctgggaggcagaggttgcagtgagccaagattgcaccactgcactccagcctgggtggcagagtgagactccgtctcaaaaaaaaaaaaaaaagattgtgtttatacacacacacacacacacacacacacacacacacacaaatacacacatataccatgacataatggaatggctcactagacaaacatctatgagtactcagttccagggaaattgcagagaagaaaagtgatatttaggcttcagatctagtagaggaaacattatggacaaagggcatccaaagatgactttaattaatgaatgtaaaacgtatttattaccattcttataatttctcaattaccctacggtgcagttgtgtatggacaatataggtgacaagacacagcttcttcctaattattcccatcctccacctactgggaagtcatccttggtttattcattctttcttcttccatgcctgtaagggtctgtctacaggaagttccaaatcaaagaaattggaaacacagaaaagataaatgtcacataggatacaatatttaaagaagatcttctgtcaaaagtcacagaggataaaatatttaaaggagaacgtctgtcactgctatgctttatttccttttagtggtccaactttatgcaatttccaattctgaagtcaaatattgtcaaatattacaatttttatatgactctacctcatgtatcagaaagatgcgagttacacacatcgactggtttatgtcagcgctacttctgtgtactttttgtgggttgttttaatgttcacagtcacccccattttacaactgatgaaacagacacaatataagtaacttgaataaggtcacacagcaagtaagtgctagatactaatttggacttaggcagtgtatctacagatctctacaccattctttactttgcaactgctgtttaagctgggcttgactatcatcacattcaggggcaagggttaggtgagttttacttgagcctttacgtcatcttttctacaaagatagtttaatatatcttttctttcttctatcatttccaaaaggtcagatacagttatatagcctgccaataaaattgctcctaattgtaggtcccatttgtaatggaaagatagtaacagtgataattctacatatatacattaggaaaattcttcaaagtcccaaattcctattgttatatcatttgacatcgggggtttcattaactcctcaggactccagtgtgctcagcagactcaattactaaatactattttagagcacactgcaaattgttcgaatgtataattcactctaatgtatttgaaaaatgtggctttttatattaactaaagaagaaatatcattcaacaaaaacttaaggctatataaatcaaaatataagaaatataatccttgaagttgataaggattaaatgaggtagtagtaaacagaagaaaaagtttaactagggcatttagtgtagccatttcttaagatccactgaaaagtgccagttccttacttgaaagtcttccatgtgagattcggtgtagttgtaagttaaataatatagtatctggaagcaaataggcctttatttattacagttctataatttaaattttgccagttgtgtgaacactgataaattacatagcacttggcttattttccttatgtgtcagacgagggggatagtcattcaactaaatgtaaccagtattatgcatcatactgtcctaagaaaaatgggaagataaaagataaaaacatactgccactgttttcacagcttttgtaatagcctaggaaggaaatatacatttaagcgaatataattatagcatggtgttataatcctattaatagtgatttttttgtcgtaagtatggtgctggcacaaataaaagatatcttcactggagagaacaacagagtgaaaatccctgaatagaatatacaaggttgaacaggttatcaacaggtagaagtgtaaagggaagataaagtcaagcagaggaaacttcacatgctaaggatcagatgaaatagacgcactgttcaaggaactataagccacttcttggaacgtaagtggacggatggaacatgagactagagaggtacaagacaccccatccgagtgtaccgacttgattaaccacccaaagctgcttaggcaaatgtctgcttgtcttttcttttcaccctttcaaacataactaattttgagaagctcttaccatgttttgcattttttaattcatattttgactgacactttaacatagtattgtttaggaaaaaccaatattggcactgtttaccaattatttgcatgcaaaaatatttggcaaggaagccatactgtccaggagcaactgctgtaaatggtaagttaactacaaaattgggcctagtatttcatcctttcctgaatccataccctttgcaatgtagcattgctgttcttctcatgaaaagttggtatctatttccctgcttcttaaatctgggttggcatttgactcattttgaccaacagagtgcaattgaagtgctggcatttcctctcccaaatgtagacctcaaaagggcttgaacacttttgctctcttgttcatgcctctgcatttaccgtaagagcacatcagagctagacagcaggaggatgagacaagtggaaccgagtcaagttgccctagttgtcccagatgaagttttcccagactagcagacagccagacatttcgcagagctgagctgagatcagcaaagccccttagccaacccccagctaactagagacacacgagtaatcctagcagtaaggtgaagaacttcctggctaacatatgtatttgaaatagtatgttggttgttttaacctactgagtttcaaggtggcttattacacagcaatagctaatatgtgtacatacatatgaatatttgtttctacacagaagatgtctgaaaaattaagccacattataaagatatttataaaatatttttaaaagagccctaggagtttttatgagaaatatcaagctagaaattattttactgctgaaattgaatatgggcaaaagtcagtttctagagatctgactcatgtgctattagaaaagaacacagtcattatattccatgcagttcctccaatgcaatcttgcaaaaaagaattaacgaagcaatagttttgtcagtttcatagaaattttttaaatacagtgtcaaccttaatatatacatacacacacttttttttgggggggggtgggggggtggggggggggggacagagtttcactctttcgcccagcctgcagcgcagtggtgtggtctcagctcactgcaacctccgtctcccagtgtcaagcgattctcctgcctcagccttccaagtagctgggattacaggcgcatgccaccacgcccagctgatttttgtatttttttagtagaaacagggtttcaccacattggccaggccagtctcaaactcctgacctcgtgatccgcccacctcggcctcccaaagtgctgggattataggcctgaaccaccgtacccggccaactttcaaatatttctaaagctacctttcgtaagacttagtgtttaactcttctgttgtagccactgtattgtaaatgcaactaaggttgtattccttgcccaatatgttcatttgacgttcaattggagaagttaaaaaaaaaaaaaagttgactttatttttctcccatttgctagatttttactgtcactttagataaaaagtgtgtttatcttgttttcttcattataagctataatttccagtggtttattcagacatttccaaaacaaaaatagtaaatcaaaaatagttccctgtgaactaaaactgtcacctttagttagtgtttctagaaaaatgcattttaaaataaagttgaataagagccaaaggaaagtagagttgacaatttttttcttacaaagctcaaagaaaaaatttaaaattgccctatgagaaaatcttaataggtacctgacatttcaataggaaaaattagttataactgcttaaatagaagtttttaccaagagctttattacataactacaaaaggtacctaattcagtgattcatctttatcagcaaacatttgctaattgtaaacaatcctgtacaaaatatttttatttcaaagaggtagcaactttccaaaaatattgaaccaaaaggaaattgaaatgaccttggtttaaaatatcattatcagcttgaaaagtggaaactatcaaatagttaaccaactttttaaaagattggtgctcactcacctggctgaatgacctacctctttgaaccttaaatttaaataatggctcggtccacattaaccttctcttgattttagactgtaatatccaatatgggaatttaagcaaaaacttaaagttacatcaaaaatggaaaaatatggagagaggccaagatgaccaactaggaacagctgcagtcagaggctcccactgagaagaaccaaaaccgtgagtgaatcctgcaccagcaacagaggtgtccaggttctctcactgggactgactaggcagttggcatgagagcgcaaggaaaagcagggtggtgccatggcccacctgggagccaaacgcgacaagggaagctcccactcccagccaagggaggtagtgagtgattgtcctaccctgcctgggaaatctttctttttccacagatctgtgcaacccgcagatcaggagatcccacttgcgagcccatgccaacagggccttgggtctcaaaacacagctgtgcagattctcgcaggccactcggatggagacgactccttaagactgctcagtttccgggggcgggggcggccatcatcactgcagctgcctgttacagcaaatgactgagctctcccggggaggggcggcatctaagagaactgccacctaagagaactgagctgctgtggggaggggcagcagccatcacggtggctaccggcttactgagaggactgagctcctgtagggagggcagcagccatcactgcagctccagtccaccatttttccccttcaggtttgagggagactggacagtttgaacccaggaggaattccctgcagtacagcacaccagctatggcaaataatggccagattgcctcattaggccggactctgacccatccctcctcactgggcagggcctgcttgcaggaattccagtaactccagccaggggtttagggaaagaactccgattcccctggacctgagcccctagggggaggggtggccatggtctccgcagatcagcggacttagtctttaccctgctggctctaaagaatccgggaagcccagacaagtgggattcccccaggacagcaaaccccctcgaccaaggggcagccagagtgcttccttaagtgggtcctggatcccgtgcaccctgactgggtgagacccacccccaacagcagtcgctagacaccttatacaggaaggttcctgctggcatctggtcagtgaccctcagggacagagatactagaggaaggagcaggcagccatctttgctgttctgcagcctccttaggtgacatttccaagtgcagaagggacccaggtgaatggggtctggagcgaacccccaacaaactgcagcagccctatagaagagggacctgttaaaaaagcaaacagaaagcaacaacaacagcatcaacaaaaaaaatcccaattaaaaccccatccaaaggtcagcagcctccaagattgaaactagacaaactcatgaagatgagaatcaaaaaacaaaaacactgaaaactcaaaaagccagagtgcctcttctcctgcaagtgattgcaactcctctccagcaagggcacagaagtggacagaggctgagacggctgaattgacagaagtaggcttcagaagatgagtaataacgaactttactgagctaaaggagcatggtctaacccaatgcaaagaagttaagagccatgataaaacattacaggagctgttaacaagaattatcagtctagagagtaacataaatgacccaagggagctgaaaaaacacaagaacttcacaatgctaccgcaagtatcaataaccaaatagaccaagcagaagaatgaatttcagagcttgaagattatcttgctgaaataacaccagcagacaagattagagaaaaaagaatgcaaaggaatgaatagacgcagaaaagtcttgataaaattcaacatcctttcatgttaaaaaccttcagtagattaggtattgatggaacatgtctctaaataagagctatttatgacaaacctacagccaatatcatactagatgggcaaaaactggctgtaggttttggtatgacaaacccttgaaaaccagcacaagacaaggatgccctctcttaccattcctattcaacactgtattggaatttctggccagggcaatcaggcaagagaaagaaatcaaggataaataggaagagaggaagtcaaactgtctcttctgtgtatctagaaaactccatcgtctcaccccaaaatctccttaagctggcaagcaaattcagcaaagtctcaggatacaaaaatcaatgtgtaaaaatcacaagcattcctacaacaatagacagagagccaaatcatgtatgaactcccatttacaatggctacaaagagaataaagtaagtaggaatacagctaacaggctaagtgcaccacctcttcaaggagagctacaaaccactgctcaaggaactaagaggacacaaacaaatggaagaacattccatgctcatggatagaatcaatactgtgaaaatggccatactgtataatttatagattcaatgctattcccatttatctaccattgacattattcacagaattagaaaaaaagaaaactgttttaaaattcatacagaaccaaaaaggagcccatatagccaagacaatcctaagcaaaaataacaaagctagaagcctaatgctacctgacttcagactatactacccaaaacatcatggtactggtagaaaaacagacacatagaccaatggaacagaaccaacatcttggaaataagatcacacatctaatacccaaccaactgatgtttgacaaacctgacaaaaacaagcaatggggaaaggattccctatttaataaatggtgctgggaagactggctagccatattcagaaaactgaaactggacaccttccttacaccttatacaaaaattaactcaagatggattaaagacttaaacacaaaacccactaactataaaaaccctgtaagaaaatctaagcaataccattcaggatatatgcacaggcaaagattttgatttcctgacaaaaacatcagtcaattgcaacaaaactaaaaattaacaactgagatagaactaaaaggcttctgtacagcaaaaaaaaaaaaaaaaaaaaaaaaaaaaaaccacaaaacccatcatcagaatgaacaggcaaactacagaatttttgcaatctatttaccattaacaaaacattcttcccctgcatccttgccgtaagcttcgacctcagccttggatagacccaccctcctccaacctgcaatcttttcccgtgttttttttctcttaatcttggtctatttttcctctctgcttcaccaacagttcatctccctattctttcttcagtgtcttctgaaaccctagaataatttgaatggttgtctttatgccctcagtctcagctattccataacaaactctccttacttagaatttgatcttcatgtttgtttacctgcaatggtaaacaggcttaaggcttgtctccttcccccgccctccccatacttaagatcaagtgggaggtttctattttaacatattaactgatgccttccctcattcttggaagctatatatgtgtacttcctcaagcgtgctactataaaaatacaaggaaagagacatcaaggatcaaataatgtgtttctcagtaattccctggaatctattgataagattagagccctgcattgaaaaatccttagtatattgagcaccaatgacattatctatctcgtaaataagagctgggaagattgtgtaagatacagtttgactcattccaaaggaaatgtttttcaacttccagctgttcaactggaacaagaacagtattgtaatggattatggtaagacacagtcgttgttatgagcttctgacaaagtactgtatcattccactcccactctgagactaagtttcagaaaccctatataggtttagaagaattccagagttaagatgtaccttgcttgctagaatatggtttgggaggtcaaatccactcagtcaccccctccctccccatcataacactagcacagtaggttaaggcatgaatgagtcaggtgtcaaagcaggcgagactgaaagtatgcttctgggcactccaggcatgattaaattggtatgaaaaggacacgagagaggacatgatatccaagggcttgactggatcccagtcatcgttggtggtgacatggggatagagaccaacagactgaatgattacttgtatcagcagaagacttcaagagaggatgactataggcttgtcatccccgatttctggatgtgacttaagtccctttaaatttaaaggttgctaatgccatcatgaccaactaccattgaacattttaactgatgctctgacctcacagctttttgacctgctaagctgcaatgactttgatcaatttgcgtccatgttcatggccagttcatgctttctcacctacctcgaaccatcctaccccatggatcacacacagtgaattgctcacttaaaccacagtatactgttcttgaaacttctgtcccctttttaaaattcaagtattatctacaatgtgacagatatcacatgaggttagattgaataatgatttagtttctgcatttctggagcttactgtctcaagaagatgaacaacaaataagagatgacaacattttacatgctaaggtagaaataaagtcaactgaaaaagaattttaaggctaagctataggaagccctttctgaagagatacaattcaaggtatgatcttaaaaaggagattttataaaaagggaagaattacagatagcaggcacaagatgcacaaagggaagtaggggaagtggatgctaaatgaagttagtgggcaaagaaggataaggggtaagccacagtagagatgttaaactaaatgtaatagagatgcttttacaggctttgggtaggagagatatgatctagtttgtgttttataaagatctctatggctcctgtcagaagacatcaaggagggcaagagaagcaatggaagactccagtgcctcatgcattcattttaaaactcttagtggtggctaatcttatttaaactaatcttagtggtggctaccacctcaccatcaggtaaatctccttctctcactcactgttgatcataattgctttatcaattgttagtcctgattttacccagcctccgattcttttagttccctttttgattgctatgcaattcctgaagtggtcatataacccaggcctgtaggtcctcaggacacatggcatttcatcaccgaccctttcctgctttgctcaaatgtcaggggaataagcccccctcctccttttaaaagctgacccctaaatatgtgcttttgagataattggctaccaacatctctaggatttaattctcttccctcctcgttcacatacacacaggcatctagatatggcaggcagtaggcattagagtgagagagcagacattgaagctacactcaggcctgtttctcagactttagtatatattagaaccacctggatgagcccgttatgacatgcattgcctgttaattctgatccaagtgtacagaggactacaattttgaggaaataattctaggctcagctttaccactgattaagtagccatgagtacatcaaggcacatttctgagcattcatttcttatatgaaaatgaagtaggttacagtggttattctctaaggatactctcagcactcacagtcccctattctgtgtctagaatctaaataaggctaggaaaaaatgcaaacataaaatgataacattgtaaaagctaagaatagttactaaaaattagccaaaaccctttgcttctccaaagtcgaataaaaatcaagtaatgacatgttatgtataattgccatcaaataaaaggaaaggaattttatcttagcctaagctaagggtaagattttcaatctgaagtccacagggacaagaccaagaacaggaacctaacaagtcctttgcaatgatctgaataatgaaacatcccttagatcagagtttctcaacatttgtttgcacatgaaacctctgaagatgttagtcaagtgcagactcgtgtgaggtctaggatagcgcctgaaaatgtacatttctaacaaaacctcaactggtgctcctagattgcagaccataatttgagttgcaaggccttaagtctatccctcacagcagctgtcataccaaattttcactttaacaacaatgaaaaccttaacagaaagtgtttggcactttcacaaaagaacagataagcttttcatgtctttttcttaaatctgtgttcacccattgttgagggtagaacattgcgacaagttcatttttacagagagccaaagtaagattccccaaggaagttttctgatattctctattgatacaaagattgagcttagaaaatgtagaagaatgaacggtcagcatgagccttgaactctggctaccatcaattgtttcctgccaagatgcatctcttttctttcctaaaaactgccagttttctctctcgcctggcttgtttgtgcaaggatcttctttcttctgcccttctcagctagagtcactgacacactctcctcctgtgagatatgcatcactcaataccatggtaggaggaggaaatttacagcagttatgatggactagaaatggccacaaaattatttgacacttctttcatcaagaggcagcatctaattctccccttaaagctcggatttgtcttagcaacttgtctgccaagtagaatgcaacgaatatgatgttataggtcttccaagattagatcattattagtaacttttagcctctttatgggtttcttagaatactcactctgggagccctaagatgccatgcataaaaactgactaccctgaaaccaccatgctgtagaagacatctacaagtcctctggttgacagtccctgctgaactgagcctttcagccattctcacaatggcattaagcattaagtgaatctgtcttgaaccctccagaccagcacatccactagctgaattctgccaagtgatgtcaactgacaccacacagagtagaaaaatcaataagctgaacacggctgaattcctgattcacaaaatcagataaaaagataaaagagatgttattttaagccactgtacttggggtgttttgttacatagtaatagaaaaccagaagagtatcctaagctccctctggaatggaggctctgccttgaatcacagccctctcgatcgagaccttgatacatgtccctcttcatcgactcttgaactctttctggttccctgatttactattgcctatgtttctatttaacagattacaccctgtctcccagcactcagtctcttcttagttacacctgaatttccccagtgcctgtcctgcctagtctgtattttctccttttcctccagcctacactgctataaccttaggatactttcaacctgctgtgagaaactctatgcaaagtgtttccatgataattttctgctcttttcccttctgtagggagatatgttttggctatctctaccagtttatctacttctaatttcactttaatccagtgccaggcccggttgtaagcaccgaagaataaatgaatgactattggataagtgaattagtgagtgaatgaataaataaatacatcaatgcatttataggttatggtctactactccactgaaattgttactttaaaattagtcaaagcaaccagaaaaccgaatggtcttttctcagaccccaagtaaatttcaattcaatcactgcctttggtcaatgtagtcacctccttaaaaactgtttttcttgctgcttctgtgaccagacactttacagtttcctgtgacttctcctaacacttctttgctggcttctctatatctgcacgtatttaaatgtgaattctccaagacttggttttgggttcctttttaactgtgtataatatccttttgccgtatcatctgcccccatggcttaaactccatattgattacccccaaaccattttctttagttgtggtatcttgcctatgatactttctcactgctacacctatcaaacacacactgatttccctcctcagatccagacatattttccggagattattggatatcccatcaatacatcaaagacaatatatcccaaatacaaatcacttccccatcatagttttgcttatttctatttctaaccatatccaatgataccaccatcctctcaatttttcagccctaagacataagttattttcacctcattcttgccacatcctttaattacatcaatactgatatccctgttgtctctagatacaaaatgtcagttataataaactctaaaatggtttcttcacctataatcctcaaatcttgacagttatccaatttagtctatgtagtacaactagttattttcctaaaccgttcttgtaagtactccaaccacagttgccccctagtgctttcttattctgtagattgtatttttgtgttctagccttccactccaccaacacctttcttcaaggctctgtttgaatgaattcttgattcccatgtgccttgccattcctttataaccaactccaaaaaaagtccctcctgatcttgcggtctctcggtcatttgttcatgtcccttaatgacatattgtcattatctgacttgaagttgttgtaggtttcctcactactttatgagcccctggctgaaagatatttttttttaatcccctactaaaactagcattgtctattgcacatagtgaatgttccgtgtttcttaaatttggagctgttgaacagtttcagttttcagctacattcactttttgactgagttgtaccataggtgacactaatctgtgccaaatggggcacatttaaactacttacactattactttaatgttttcattgaacgcaggaatctttgtagcctctaggtacatttaaactttaagataaaaattatattctgtcaaatgatttataatcaataccattgccaattaaaatcaaataatagacacagaagtgcctcaaagcttcaactaagatagacacaaaggggtgccagtggataacagtgttatttcataatcacagcttcccttttccctctagcaattattctgatgcagaatcagtcttaagaggtttctgcagctagatgtaaacaaagaagtatcattacaaaactcacttgactacacttctgacaccctggttggggaaatgtatatggattgatatgtctgactgacaagaactcaaaatttaaatgatcccttgtccaagagccctgtggttatcatttagaattcatctgcacaagtcattaagtatactctttggaaaactattttgttccggaaaaatgtaaagtcaagaagcaggaatgctaacatttgaaaaaagcttctttaataatgctataattctgaactttttgtttatattagaaaatattttttcttttaactctagctatagtacaattagagatgtttcaaaattattcaggtaagtgcttaattgggtccacgtaatcttctgaaagttagccctttagaggttatagccaaaaaatcgtgttttatccagatccactaagattccattaacacttctgcgtgcccacctccttggcttttgtggtctttgcttctcaaaacttctgtatctacatctctttagatgactgtcttcaggctagtaaagctgctttgccaacaaaaacagagatccggaagtgccttggtgtttatgtcaccttagggtagtcttaaggcaatgactggtgactactggaatacaaaagcccagctccttctgtatcaagttgcaacaagctgaagcatagtttaggcccaggttttcctgcagaaccagactgaggctggcactttgcctgcgattgctccttgcatgatttcttccccattcctattctacttctcttgctcacctacttgccatccctgagaacatttccttaattaaactactttcatgcaaattctcctctccacatgggctttaccaaaacccaacctgaaacataagcattcctctaattacagtaataaaggcatcagatttctatttgaaaatactaggaatgggccgggcgcggtggctcacgcctgtaatcccagcactttgggaggccgaggagggcggatcacgaggtcaggagatcaagaccatcctggctaacacggtgaaaccccatctctctctaataaaaagacaaaaattagccgggtgtagtggcgggcgcctgtagtcccagctactcgggaggctaaggcaggagaatggcatgaacctgggaggcggagcttgcagtgagccgagattgctccactgcaccccagcctgggcgacagagtgagactacgtctcaaaaataataaaaataatatggtgttaaactgattaatctttaacttcgacagaatgttagagttcaaacctgtagctctatggaggttttgattaccattataatccattaacacaatatgttactaagatagcatttcagagcacagtatgattttcttgtagctatactacaaaactacaatactacagtatctgtattactttagaaaatctctaaaaaagttgtgaattatactgccaatggtttgattagatagaatcttactgatttttaaataatatcaaatttttccatctctaatcatgaaaagagtggtgaggtagggcaggataaatcgtaatattggggccaggtgcaatggctcatgcctgtaagcccaacactttgggaggctgaggcaggtggatcacgaggtcaggagttcgagaccagcctgaccgagatggagaaaccccatctctattaaaaacacaaaaattagccgggcacagtggcaggtacctgtaatcccagctactggggaggctgaggcaggagagttgcttgaacccgggaggcggaggttgcattgagttgagacagcaccactgcactctagcctaggcgacagaccaagactacgtctcaaaaaaaaaacaaaaaacaaaaaacaaacaaaaaaaaaacaactaatatttgtatattaatataaactcctgaatccctcatgacataatatccatgtgtatcaagcctttttattcctgcatctgttaccgttattctccctatgcctctcacagccagaaggaaaactgaaagtctactatcttccttttggtaaaaatttgaaaagaagggcattcaggtagagatggcatttattaatgccagtgactgcggcagactgttcttgggccgctgggaagcctgtggtgataaacagcattggaggaagaaagagtcaccatttacatatggcacatgactctcatcacagcttgtgttgcttattcaccagtttgactttgcccttgccaaaaggttagacaacctctgctatgccctcctcatcctactggcaaattaccactttgttcccattttatgaaattattgaataaagatcaccattaatatttgtcttttttaataccagttattgacaagtgatcgtcgttcattcaaaaaatatttattgaatgacagttaaagagcctttactgtattttaatttccaataaacatatatgtgtcacatatttttaaaaatatggagaagttcagcgtttttgttttgctttactttggtaggttaatgcctgatgttcataatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccacacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccattacggtcatgtcaaactacttactggttcctgaactcaattggtttgtgacttcatactcctcagcatttttttttttttttaatcagccaataggctgaaagctccaacagggccaaaaaaaaaaaagcctttttcagcttagtcttcttagcaactaactgattgtctgcctataaaagatgtttaatcaatgtttggaagagatggacttgaatggcctgttgtactcttgttggcatgaaaatccctttaagtttctagtctatagttgatatcaatttcaaccccaatacaaccctagccaagcaaaattcgtctcttcttccttctgctcccatgcatacccccgtggtaggacatactatatagtcttgtaattgcttttgattgcttttgaaatacctatttttcccatttatatgccatctcttaactacagtgccaggtatatggcagaatctcaaaactgagttaaaaagactaagatttctgggctaggcgcagtggctcacgcctgtaatcccagcactttagacggccgaggtgggaagaccacctgaggtcgggagttcgagaccagcctgaccaacatggagaaacctcatctctactacaaatacaaaattagccaggtgtggtgacgcatgcctgtaatcccagctactcaggaggctgaggcaggagaatcgcttgaacccagaaggcggaggttgcggtgagccgatattgcgccatcgcactccagcctgggcaacgacagcaaaactccatctcaaaaaaaagaaaaagaaaaaaactaagatttctttcaaacctgtaatctgatgatgattgtatgcaattctttttaaaaagctaaaaatcttagattgagttatttatgaatacaaacaggtatgaagcagaaaccacgaaggcagctggcaaaaaataccagagtaagtacagctaggaactgtagatgccagtgtcagtctacatctttgaactgtatgaaagagcctattggacactaagtatttatcaaattctttctctttgaagctagttctaaaaacaatagaaacaaaaggaattttagctaacttgctttaccttggctacagaatattttaaatctaacattccaaatagttcttaaagtattctgaactggtttctttctgtgaagacaattatgatttctgagtctatgaataattgtatacttacgcaatgttaggacagtattatctgtaaaatgatttgatgttcaatatttctactattaatcttggaaaagtaaaaaatatcttctatcagaggaaatctaacactctcaaaaataagttaaatatgatacaatggcagttctacaacatccagatattcaatagtaggcagcaattattacttgccataattcacatctttgaaaaattcaagagggcaaactaattttgccaatgtgaaggagctgtaagaaaaattatgctttaatggaaatataagatgtttttgttgccttaagtattgctttttaatccttgaaattcagtcaaatacttaataattattttccatatatcttattagacatattagcactcatgctggttagagattttatcttcctcagagccataccaacacacccttctaaaccctactttgcaacgctgaggcaaagactctgcaaaccgtacttctggctttactgactgactctcagaatctaaaggtagggagcaatagagggagactgcaagcctggaggagggacaaaggatttactcattcacactagcttcccatgcacttactgtccttattagcagttccctagacgtgcttcttcatgcctgcagcagcactttttagtaacaagctattcaatttagcttgtgttttgtttttcaaaagcttagagaatcagcttcatcgcccctgctgcagaaataccagcaccacctggctggcagaggtccgggcctcagtcccattgggcccttcctgctatcccagagagggtagcaccagccacgtagcagccccctactcagacctgagctcagctttgtagagtccttcctcaagggttctaagtgttagtaattctaaccttttgtcttcccagccctaggagcggtagctactttgtgcacttgctacctcttctctttgtcaatttttcaatacctagatcccaattcctcttgttacattattttctgctacagtcactcaagtggtttctgtctgttaactgaccctggctgacacatcatcccaaacccaaaacttgtcactatcaaaatggaaatacattaagtgttgggtctgtgtttaatgggtaaggatgatttctcattcttccaaagaccacatattatattccactattgttttctactacttttataaaataatgactaaatatagatatacttcagtacaaggatatttgatcttctggacagccgtatccatatgtgcattctttctgtagatggaactcagttgtattagagtcaaaaacttttttaaaaattctaaccatggacagttgaatcaaatctagccctgtagttatttttcaaagtcaacatgaatagtaaaaaataaaatattgtcaaaaatccacctggaaaattgctataccatccatactatacacataatatggattagattttaaatactgcgtagtcacctcctgcacaccaaagtttaggaagacattgagctaaactcaaagagcaaaaagccagagtgtatgcagctttcttaacatgcaattcttcctgcctctaaggtaagccctagattgttttctttacctgcagggctttctgcagtatgtcttaatagtaaagataatccagcacagcatttgtaatatgcttgtgatcaagaatggatggaaacaggatggtatagtcctaacttaagcatgtaaattaattgcatctcataatgtcagccaatccacactcttagtcatacagattaaagaaccaaaaggaacccaaggaaatcagaaagggtaattctgcttagaaagttgctcttacatttcatatacatggttgaagtttgacctcaaaaaaagaaaaatcaatttcaggcactgaacggcaattgtgtaacttatttattaaatttataatacaatgaaatctgagttttctattactctcatttcttatttggacactggtaattgcttctttcttatgcatttttaaagtataaatcctgatactagctggcactaccccaatattttttccctttaactttggaattttccttttaaaaaattgtcattctagagttaacatgctaccagcttttcacaaattaaatttgttgttagaaaatggcttccatggccaggcgcggtggctcacgcctgtaatccccgcactttgggaggccgagccaggtggatcacgaggtcaggagttcgagaccaccctggctaacacggtgaaaccccgtctctactaaaaatacaaaaaattagccgggcatggtggcgggcacctgtagtcccagctacttgggaggctgaggcaggagaatggcgtgaacccgggaggcagaggttgcagtgagccgagatcatgccactgcactccagcctgggtgacagagcaagactctgtttcaaaaaaaaaaaaaaaaaaaaaaaaaaaagaaaatgacttccattttatccaaaatttaggctcttaaaaatgtatcccttttcatgatattcttaatattaatgttctgtagatgttctatagaggcacttgaaataaactcaacatatctaataaagacagaaatggaaaggtaagtacataggttttctggttttgatgtactctatcccttgcctgttttttcttgaccaatacatacaatgttacttaaacatgccatcctcaatattcccaatgtcccctatactaagactagtcttgaccccagactgaaggaacttaaagttcccactaggaaatagtagggtgacataggaaagtaactcatccgaaaagattttctttagtggttcaacctatacaaacataccacccagggaatacagcaggcccagtgataattctagacatattcaacataatgatttccaatcaggtaggcaggaaatgaggaaaagctgttgagtgacagttaagtggcagggaaatatataattaaccaatcaatttaacaacaattagttaaaagcggtaccaacagctacttttattgagcccttactatgggccaggcactttatatacatcatctaacttaatattcaccaaaaaattcaggaaggcaatatttgtcaatattttgaattttattttttaaaccaatggagagtctgacagaaaatttgaacaagttgcaccaagtcctaaaactaacagatgttgctggaattggaaccaggaccatgtgctacagtaacttgctcaagtttctactaagctatgctccactctacgcaactctaagtttcatcaatacactggaactcatttcatatactcattccccttagtctattaccatgaaatacactaggttcaaacttgcaataagaaatcattaagggactcatcaccttacaattccaagtacagacaagtgtggaaatgatcctaccaaacaaggagaagtgtatcactgtcgcctttacatcttctcaggatgttaactttatctccagcttaatgacaagcacaaattcttgtagttcttaaatttcaggctgttctttagttttatagtacatatttaactgtatttatacccatgcctgagaaaatgctgtgtcttataaagtcatataatgctgaaggtcaaggaatatgctcttgccagatttgtagggatcctagcctagcaccactcacacgtaatcatttattaaaaattatttttctgatcatgatgctaatctgttcagagtcataggcccataaagacaatatttcctatgggttaagatgtgctaatctcattaactgaacaaaccagaatgaatttaatcacagcagtcaagggaagctaccgcatcattccaagacaaattagagatattgtacccctgtggtgttatctttgatttcgattagaggtttcaggctgcttcctatggctagattcaaaatattaagcctactaaagagaatgaaaggtaagtttatgactttgcatcttggaactgcactactgataactgcaaagcctaaggctttgaagagaaatgacaaaaaaaagtcaatcatattttcataaatattaagcttcccaattgtatataaatataaagaaaacatgcacattactttttaaaatgattcaggagataaactactggtataagtgatcatgttatcactaaatctcatgaaaaatatattaagctataacgattagcctgcttttaaaaatgtgtatgaaagtcagttattaaaagctagatgatgttgttaaataaagaaacttacaatgtgttgaaatttccctattggagaattataaaacaaataaaatagtgtttttctgatgcatcacataaaatgtagaagcgaaatttgagggtttagaatatttcaataaaatattaaatgcctgggcagtctccgtaattgtttcccttgagggggaaaaaaaaaaaaaaaaaaaaaacctttcctttcaggtagtaggcacacagttttactcaccccttgtctctccaaatctagactccaaatatatattagtcacaataaaactcacattcttattctgcttgactaatttgtagtcaagctgaatacaattcagtggaaactgaatatgaaataaattcatctaataaaaaggtaccaatgactgtataacaacatatgtagataaaagtgtatcatatataaaacattcaatcccacatggcagctttcctggaatataaaatcattttatcattatgggtattagctcatgaagtcagtattattttaaaaacatgctaagaatgttagcttcaaaatttaatatctcaaaagcaggattttggttataccaagtggtttataaaatagagatatttatccatacacagttttatgtgacaatttaggtgtccttatagcttcttggtgggcagtgtaaactggtaaaaaataataataataataattttgctaagtatttttgcgatacatataaagaccctttaaaaaatgttaatatcctggctgggcacggtggctcaagcctgtaatcccagcactttgggaggccgaggtgggaagattacaaggtcaggagatcgagaccatcctggcgaacacggtgaaaccccgtctctactaaaaatacaaaaagttagccaggcgtggtggcaggcgcctgtggtcccagctactcgggaggctgaggcaggagaatggcgtgaacccaggaggcgaagcttgcagtgagccgagatcgcgccactgcactccagcctgggcgacagagcaagactccgtctcaaaaaaaaaggtaatatcctttgacctaataatttcatgcgctggaagctgtctaaaaggaaacaaaatggtctactgggttatttagaacaacaaaaataaaaaactaaatgcctaactttagaataagtggtcattatgtgaacatttaaagtgtgtctataataacctaaaatcacttatgtgatagtaaaaaagggtgaaaagtcataaatatagcacgatcacatctaaataaatagcagaaaaccctcatttcgggtaaaaaggaacccaatgaaatatgccaaaatgataacaatgactttaagtgagaatatggttaattttgtttccttttacttcttccattcaattgggaatattaataattggacccttacagctgggcatggtggctcacacctgtaatcccagcactttgggaggctgaggcgggcagatcacgaggtcaggagatcgagaccatcctggctaacacggtgaaaccccgtctctactaaaaatacaaaaaattagccgggcgtgctgacaggagcctgtagtcccagctacttgggaggctgaggcaggagaatggtgtgaacccgggaggcggagcttgcagtgagccgagatcccatcactgcactccagcctggatgacagagcaagaatccatctcaaaaaaaataaataaataaaaagaaaattggacccttatctgttatatacaagaatcgactcaaaatggattaaagacttacaggtaaaacctgaaactaaaactactagaagaaaacatggactatgagaggtggctcatgcctgtaatcccagtactttgggaggttgaggcgggcagatcatgaggtcaggggtttgagaccagcctggcaaacatggcgaaaccccgtctctactaaaaatacaaaaattagccggtcgttgtggtgagcgcctgtagtcccagctactcaggaggctgaggcaggagaatcactggagcccggaaggtggaggttgctgtgagcctagaccgcaccattgcattccagcctgggtgacaaagcaagactgtctcaaaaaaaaaaaaaaaaaaaaaaaaaaaaaaacatcaactaaaagcttatgacattggtctgggcaaggattttttggatatgaacccaagagcataggcaacaaaaataaaaatagacaaatgaagttgcatcaacctaaacagcttctgcacagccaaggaaataatcccttttcaggtatatggtatacaaatattttctcctgctccatgagttgtcccttcactctgattaatatccaaaaatatataagaaaccttaaactcaatagcaatacaacaacccaattaaatatgggcaaaggacctcaacagactttttttttgaaataaaaaagcttttaaaatatgacaaagtaaaatcacagtggcaactgtgattaaggaactgaatttttattttttattttttttaagttctgggatacatgtgcagaacgtgcaggcttcttacataggtatacatgtgccatggtggtttgctgcatctatcaacccgtcatctaggttttaagtcctgtgtgcattaggtatttgtcctaatgctctccctccccttgctccctacgcccccacccccacaggctccggtctgtcatgttcccctccccgtgtccatgtctcaacgagcatgtcttaagggaaacaaatggacaacaggtatatgacaaaatgcttatcattagtcaggtaactgcaaattaaaacaatatgctatcaccccacacctgtcagaatggctattctcaaaaagacaaaggataactagtgttggtgagaatatggaaaagagggaaaccttggacccttaatgggaacataaataggtacagccattatggaaaacagcaggaagttcttcaaaaaaaaataaaaatagaactaccatacaatccagcaatctcactactgggtacatacctaaggaaatgacatcagtatatcaagtagatatctgcacacccgtgtttattgtggcagtattcacattagacaagatatggaatcaacctaagtaaccatcaacagatgaacggattcaaaaatgtggaatatacacacaatggaacactattcaactttaataagaaaatcctgtaattgggaacaatgtggttgaacctggaggattttggagttttcaaattctcaagtccaggcacggaaaattataatttttttttttggaaaaaaatgtgaaatatagacactattttctccgtctctgagcctagatactattttcctggactggatggagaatgtaaagtagaaacaagagtgtgttcctgagaggaggggatggtgaaagaaccgccaccacaacagagaaggttgggggtatccaggtgcagaagtaattgggtcccattccagagtccagcccaggaatgcaacaagactccaaagttatgtcagacccaggcaagaatcgtgagcatgtgtcttagcaaatggacatgagctagccacccagtacccaggcacttcagcaggatatagggtacagtagaataatttcccacatgcctccagcaaacacagtgctcaatgggtttttggaggatgaagaatgacaagggaaccaccatgtttcttgaccgtacagagatatgaaagggcctacaacttgaggccaaggaacaaggtccctatgggatgaattgtacatgaaatcaggtaagccacacccgccttcaaatcctggcactgtatcagtgtcaggactctgagctaagccatcatatcccctgtgacctgcccttatacatccagatggcctgaagcaactgaagatccacaaaagagtgaaaatagccttaactgatgacattccaccattgtgatttgtttctgccccaccctaactgatcaatgtactttgtaatctcccccacccttaagaaggttctttgtcattctccccacccttgagaatgtactttgtgagatccaccccctgctcgcaaaacatcgctcctaactccaccgcctatcccaaaacctgtaagaactaatgataatcccaccacccttggctgactcctttttcagactcagcccacctgcacccaggtgaaataaacagccttgttgctcacacaaagcctgtttggtggtctcttcactcggaggggcgtgacaatcaggtcccctccagaaatttaagacaaaaccccagagaaagggggggcatctcagtcctaaattggctgagatgaaatatgcaggatctaccggaaagtaggctttatatataaattaagttcagattcaagaaaaggcagttattgagattcactgccactgcatgtagatccttatgtggggatttctaagaatcattgtccagcacctaaactgcaaagcaaaccggtaataaatcagacaacaattaagagccaagtcatcttgagacaagagctcaggactcagagaagcagcctgcaaatgtgaaatggacattcagaagtcagtgagtttctgaactagcagtgcccggttacgaagctgttgaagagccttgtggactgctttatatgttctgggtagttccataggtcctcgcagaaagagaaaataaacctttcgttgaaattaaccttagacctagattcttaaaggactcaaacttttcgcggggaaggaaaggccagtctattgacaggagctgtagatattaaggcctgtggggggtgggggagggggactcattatctgggaaaagccacacccttaatccatcataaacagtgatgcctggggcacagttgagactacaccttggaggaagaatctaggtttttcctatccaactccaaaagaaacacatttcaatggcaactgctgaaaaacaagcaaacaaaaagtaccagcacctttttgtttctttggtaagaaggcgaaacatcccagattgtctaaaaaaaagaaattcgggaaatcagaacgttttatcatgatctggggttatgttgtccagtaagatagccactagttatatgtggctactgaacatttgaaatgggactagcataactgaggaagccaaattttcattttgctttatttttgcttcaattttatttatattgaaaacaaacagtttttaatattcttccattaaccataacttcattggtttgggagaacaagtttactttaacccatgaaaatatggcaactgaattcagatgtgctgtaaatgtaaaatatcctccaaccttaatgatttagtacattcttttcactaacgtaaaatgtctcattaagtcttttttgattacatgttgaaatattttagctaaataaaacattaatgtcacctgtttattttcactttttaaagtggctactcaaaaagtttaaattacatatatagcttatatttcttttggacagcactggcctggagtacagttcaaaaatagggcaaaaattcagagttacttcttccacatctgagttttgcgaacatttattcctgctacatacacaccagtctgtgtatctacacataatgaaaaacagacttttctcaatcccctcatatacagagggcaggtgagtgagccagtgagagaagactgagaggtaagtggatcatataaattaagatggcctaacaacattagaatcattaggatttaatcctataacttatgacaacagtccaagatgcaaagtgatttttaaaagtgatctaaattaaattttctagttttccttttctttccctttaataggtttcatgaaaatcaagaattataaggcggggaggtaaggctggagaagacaatctaataaagcgatgtaggacaaatgagaaaaatcaggcttccttattctactccaacactttccaactgtcatgaccttcatggtctgtctgtacctcaattctctgatcagtaaaatttggatgaaatatgctggactctgttgagacaaaatgaaaacataaggagagtctatcatctgtaaatcactacattatgtacccattagtattttattgttagcaaagattaatagaaaactgacaactccaaggctggatggcatgaagccctacacctagtagttgctgccatagtctgatttgaggttcctcaaatcattcttccccagcctaatcattttttctcttcagacctggaatcctgccatcctctcgcgtcatagtttgggggttactgcctgcatatgccaatgaacagtatagccacgtgacacagaaatgaaggccacagaaccataattcatcagttattcaatgtgttagctgacaacttggaaatcatagagcactcaactccaagttacttcctgaaaagcagagaaatgcttcctcagtgaggccacagaactcacagctttacattttacctacaatttgcacatgatccacatgatctggcctcggctttccctcaaccccttacaactgttacagtttcatagccttctgtcagtcactagacaaaactcagacacttccttccagtactggcaacattactgcacattcttcttttaggttttcagccctggctacacattagcatcacccgaggagcttttaaatctgtaccattgtgtgtttctgatgccccccacgccatgttgttttgtttgttttcgttttttgttttttgtttctttgagacagagttctactctttttgcccaggctggagcgcaacggtgcgatctcggctcactgcaacctctgcctcctgggttcaagcgattgtcatgcctcggcctcccaaatagctgggattacaggcacctgccaccacacccggctaatttttttttgtatttgtagtagagacggggtttcaccatgttggccaggatggtcttgatctcttagacctcgtgatccacccgcctcagcctcccgaagtgctgggattacaggcgtgagccacccggcctctaatgccccctttctttcataacattacacaccaagtattatttggcaaacttctcatcccctatactgtattacttattgacattgtttcccagctcaggcctacacgcttggcacattctgtctctctggccacaatgatcgtgtaagcaaggctgaaaaccaacttaaaggaatgggaagagttacaaacttaagtctcccacacatgatgcaggatgatgactttatcagatattttcatgattttatgatatttatcagacattttctcctgggaagtttatgttagagtaaaaatcatgtatcattagggagtagaggtaatgctaaaagcaaggactgagagtagttaattcatgagaatgaatgatggaatcccatgacgtgatagatcagctgctacactatggtctcaatagttcaattattcataaaattacactgatcgtagttttctaatgtgacatttttgttttgattattcggttggtcagacaactgagtaaccaaatggtttcgcctacttatttggttattcagttgttcagtttcttgacctttttaccccatgcttccttaacataagctgaatttatctctgttcaatgtaacacaaaagcccgtatttagagccagattataccagtttccagctgtgtcctcttaaacatattactcattctctcatgtcttccatttctttccttaaaaaatgagaataccacctatctcctatatatgtttgcaaacatgtttacaagatatatgtgaattaccttgcacagttagcatctctcaggatgtgaaagtgaccgtcttcctcctcagtaatttactctttgtcttatcaaagccattaaaacccctcagaggtgattaaatttgctgtgataaacagtggggttattaagcaaagtagtaaactatgaacacacctaagttttttcttaaatattgtagtggagctggaaatttttttttttaggtatttcttccatatccacaaaaaagcagcaagcccactgaaactcatctgtttgtgctactaaataatcccctacttttcctactgtaggttgatttattggtccccactttctcattcctacttaataggatggcatatctagcctatggtgggaaatgtgatagcctttggtcaacggggtgttaagaaaacatgacaggagcagagccttgagatgggctggcatgtttgggcttgctatctagtgacaacctatgaaaacatgcactgggtggccggtgccattccagtgtgtgcctctggacgtgacacatcaaagaaatccaaaccaaacctgccgctgaaagccaagcctagcaactaccagcctgatgcagaaccaaatctagatcaacttaggtcagccaaaccccgcatgaccatgagaattaatgctatttaaaaccattaagttggaggtaatgattattacttgatattattgttttgagagctgaccaatacatctgcccaaataaacgcgtttgttcacatcatgatgttgtactgaacccctataaccctcaatagcgaaggcatcaggttcaagagactgaggaagaaacccatagccagcaaacgaggcattgggttttattagaggtttacatacaggggagggaattcagtagtggtgggctggacaggagaagtgccttacctgtagaaacgatccagtggtggcagactggacaagatagcctcgcagcacagtggtagtgatggcggcggtgggatgagcgggcaaaccaacgctgcttgcgggcagcatgcagtttatatagcatttttacttaaccctctgcccttaatgacgttcacctggcaaccttcatccaacccaaaactcggggcctcaatccgctgtatgtatggcccgtgttccacgggatgcacttggggctcagatgttcctcatagacaaggaagggctctcttgctgggctactcccagattccgtagctcggaaaacacattcaggtgtgtctgcagtacagggtcattctaagggtatgcgcacattattgcaatcaggtgcatttaccatatacttgattacctatcttactggttatgttgttgttttgtgtgtacgtgtgtgtatgcatgggtgtttttacagagtcagatgtcaaccgcagggacaatacaagtgtcttactcatttcagcctgctgtaacaagataccatagactgggcagcttaaacaacagaaatttattttctcacagttctggaggctttaagtccgaggtcagtgttccagcgtgttcaagttctggagagggctctcctcctgatatgtaaacaacaaccttctcctgtgtcctcacatggcaaagcaagagcaagctctctggtgttttctttacacgggccaccggatcagagccccacctgcatgtgcttatcttaccctaattaattcccaaaggttccatctccaaatatcgtcccattgggggttagggcttcagcatatgaatttggggcaaacacgaatagtcagtccataacaacaagtgaaggactacagaatctattttatacagtaatattttcttttatgagctatatgaaagtgacaaagcaagtggtttagtattgtaataccatgacaaagattaagaactgaactgagcaaatactttatacttctggttcagttcatcataactgaattacccaaaaatataaaaggagagctgtagttgttctagaaaaatcttccttcgtgtaggagtgggtttgcgggttactgtgctaatccacacctggagttttgggcgtcaaggttgataagggtcaagggtttgggttttggctctggcttgtggaagatcgttttctgagagcattcttgggcaccagctggtcagacactcccattccaatgggacatagttttcaacagagaggaataatccaggtgtatataaggcaatacaagaaaccttgaggcttccaggccttagcaagaagaattggagtggaagtttaaaagcagaactggaacattttctaattgagggtggtagagagaattctgatatttatatattcggctgaggttgagagctttcaaggatgctgagctggctgctggcttggaatgaacgtgtgtgtgtgtgtgtgtgtgtgtgtgtgtgtagtgtagtgtaaataagcaacattgctagtcttgtaatcttataattgttcataagagaaaatacagtctagaggaagagatcatctagtttactgggaactagtaatgcttatcttgccgaggtttaaatgaatgatcacggctgtaatgacttataagaaaaattaaatctaagagcacagcctctgagcagaaactgtatacagaggtttatgtacacagctgtgcgatgaaaagaattagatgtgctgtgccctgatgcttttgcaataaagggttcaaaaatctgtggagaacaccctactccttagtacaacccagagcagtctgctgtagcctgcttaattggtatgctatgatcaaatccctcttgattacacccctagggtataataggaggcaggttttactttaacgcctttcatcatacagaaagtaaactgctttatggataaaaatagccatgtacagactcactattgacaccagccacccctggtgacttcaaggctcatcagcaatgcacaactgttttaaaataaagcaaagagtcacatgtagaattggaattacaggaataatgagaagtaaacagaaagaggccacgttgccttgagggctaacctatagattagaaaaaaatcggggccctaaaagacacactactgatggggtctagggatagagctatttttaaagcagtggtaacaaaacaattggtgtcacgtaacactccagtaactaagataattcacttgactgcaagacaagcaaaatataggatgttaaatgtgcaactatgtctcaaggttacccaagttaaaatttggagcaactaaacatgtctcattttacaatgacaaaatgaacacttagttttcactgtgtttaagaaaagtgtctttgccacattaaatgcattatcaggagatacattattatcacagctgcaaggaaaatatttttcagattcaaagattcaacaacactgtggtacgcagaacttgaattgctgtcagatgaaaagttaaacgtcagcaattgaaacaacaaatattcaggacaaagtgtttatagccctttcttttgagggttttcacattgaggaagtatgctttttatcttctccagtgatactttaacatgggccttcaagcacctgaataacagcaattacaaaaatatatttttttcatcaacgactgggcattttatgcgttttttttattttgcctattaaatatgcccttaaaatcgtgcttgttcctcagtctacttattagaagttcaaaacaaggctttggttcaaatccagtttctgagataaatttcttaattcattgtaaaaaatattaatggtgaccaaaattttaatgtttttagaaaacatcacaggtaatcagaacaaacaggaataaaaagaacaaagagtaaaggaaggagaaggaaggaagaaggaaaggggaaatataaggaggagtagagaatgaagaggtgaagggaaaagctgtgatttttattttcagataaagcacaggtagagaaaatctatgacattaggagagtctttcatttaaaaacctcatagttttaggtaggagggttcttattggtggaatctttcatacttgttcaatccaaattatccattaattgttctgtctgatttattagctttcatcaaataaatatcattttctatgctttagcaacttgaaatcatttgccaactgttgttatataatacaagtcgaaaaagttggtatgcccaaaggcttatctggattttgtattcattttttccattttgaagttcaaaacaagtcatttctttttctttattctctgcaatcaatacaaaatgtgtgttcatactattaagaagagcatgactgttaagaagccttagttcaatggattagtagacaaccatttttttaattagtcttccccctctgaacttttctccactttccgcagcaaatggaaacgtaatgagaatctcatagtattctgccaaaataaaggggatgtcaggcaataaagcatatccttgctaaatagcatcacaaatcccatatgtagaattatcattttatttttaagagttttttccaccaaaagccaagaataaaattgctttgaaggataattgttaaatggttatgctttggctctatatttgagcctccacgtaagtctttaattaataatttgtgctatggaccgtgttctgatgagatgttttgctaaggagatatgctcccttcccttactgccacccacaagagtaaataaaagcaagacactggcgttttggaagtcaaactgggattctgaagaagttcctgggctctgagtatcatgctacacagtagagagtcacttcctgcctctctaatatctaaaacaaaagatttgaactggtagccattgatctaattcaggcctgagatacatttggctagtttgatacaggacaggttaagccccaaaatcagggcttggcctgggaggattcttggctttgcctaggaaagaattcaagggcgagccagtggcgttaaacagctatgttttagtgaacattactgcgctttgtgaaatagggacaactcataggcagtgcctccaaagttggcagggtatgggctgctggctactgtatttatatccatttatacccactttcaattacatgtaaattaagtggcagattaatgcaaattgagagacaggttatttagaactttctaggaaaggggtggtaacttctgggttattgccatgtcctttgtaaactgtcatggtgctggtgggagtggcttctgctaatatgcaatgagggctgctggggatcacttttgttgccatctgctggtttctgctgtttttctcacttccgttggtcgctgcctgctggtacctgccagtttcttcactttatcctctgggaatgggaaataagtcctgcccaactcctacctcaggcttgcacagaatttttaattggaaaacctttttccagttacccaccaaatatacatcactgcctactatatatcaggcactgttccaagtgcttgggattcaccagtagacaacatgcacacataaaaaaaagtgctcaacttatgaggcaaatatatagtgcactgggatgttttacatacaactccagattcttaagttcctcttgaaaaataaaatatatggccaaaaatagctctacattctgacatggacactgctagactgaattgattagcagttgcccattttagactgggcacaggcgtgccatttgccagtattctttccaatttacacaatgtccgtatgcatttagatctttgcttcacctatttccattccctttcaggtccttgcaggtattttaattgtggactccattcactgtattattttattttatttcagttcagtttgtatcattttgagttcctgtttttaatttagtataatatcatagaaagtgtttgtacttaattctacggccgggtgcggtggctcacgcctgcaatcacagcactttgggaggctgaggcgggcggatcacgagatcaagagatcgagaccatcctgaccaacatggtgaaaccccgtcgctactaaaaatacaaaaattagctggtcgtggtggcacgtgcctgtagtcccagctactcaggaggctgaggcagaagaatcacttgaacctgggaggcagaggttgcagtgagccgagatcgcgtcactgcactccagcctggacaacagagcaagactccgtctcaaaaaaaaaaaaaaaagaaagaaaaagaaaaagaaagaaagaaaaagtgtttgtacttaattctaatgcagaatgttatggattcttatattggttctggtataaataagctaaataaatttaaacatgttttttaaactctgtgtggtccaaatatattctcagtaaagtaagagtttgacttatttgtgggtttgaaattgagttcagttgaaactcacaattcagttgagctgctgtaatttcagttttatggttccgtcttccttatgctatatatttttaaaagaggttttgttgataaaaaaaagaaagtttgtgaaccactgggctttctgatctctatgatctcctacaaatttaaacttatgtgatttaacactaatcaaaagcaaatcggtattcctatttaactttttatatacaaaggtcttatttccttaaaattccctaagttggaataatatcttaaaagctgttcttccatagtgtcaattaagtgcataataaactaaaaatatttgctgaaaatacatacacatctggtaaaattgtgttggtatgaataggaataataaatacaaaaatgaaaattgggaagagagaatagtggtgcatttgggaagggtggcatgtggaggagggcttctagagtattagtcatattctagtcaatttttctttaagagaagggccctcactctgtttcccaggctgaagtttagtggcactatcatagctctcagtctaaccttgaatttctgggctcaagccattcaactgcctcagcctcctgagtagctaggactataggtgcatgccactatgcccagataattttttaattttttcatagacttaatgtcttgatatgttggttaggctggactcaaactcctggacacaagcaatcctaccacctcagcctcccaaaactctgggattacaagcacaagccaccacacccagccccctatttcttaagtgaagtgattatgaggaatagctcaattcattattgctctatattccttacacatgtaaatcttatatgtacatctatagcaaatgaaaaaaaaggaattttcgttgatatttcctttaaatgaagatcacattggaggtcaaaatgtcacaccaaaaggaaagtaaaaaactcaaagtaaagatattttgttaaaattatgaagtgttaaaattgcaaatgacatctcatttgtaaatattgtattattatttattaagaattactcgaataagccaaaatgatgaaaatgcttgttatatagagaaatctaaaatgtaaggcagtaagcagctactcttccaataactccaaaagatgaaaatatgtttggtatactaaaaaaaatctaatctgtaatgtagtcagtggtatattttgaaagaaaagtaaaactatagttttgattatttataaaagaatgaattattttatatttaaaataattaagtcagagttaaatagtagtaacatgtaatttttaaaattgataggaagtgtatattatacaaatgtgataaacagcatttatactgtggaaaatttgtatcaatgacagaaggtaatctcccttcttactacaattcttttttaaagggaaaagaatataaaagatgaacaagtgtacagtctgaaaaggttaattttcttctttaaaaatttcaacactttgaaagtacctgcattcaacttctcttcaaaattattacttcttaaactacagtcagccaagcaatttgctattgagaactctcaaaatccattattaaatacaattttcaaacatacccagttttttgaaacacaaattttaactttgcttttgaaactgactgatgagaaattacctaactttgaaaaaatattcattaaaaagtccatattccacctagtcatgtgctaaatatcagcattataagcagctgtttcaaaacctagttttatgcaacatgtgccctttttaaaatttttcataaaatgtaatatctgttggtagcactactaataatattataggaaaacgctgaattacgatcatatagaaaattataaaatagaaaaataaacagagtttagtatagagtgtctgaacatgtgtaaagcaaggggtcagttgcggaggacgacttattgagatatttgtaatatcctttcatctacttttatctgttttatagtttcctagtaaattataagcagtgattacacccttaatctttggctttatggaaaagtataaaatcgctcttcagttttattatgactgtatatggatattctatttacaaaaacatatgctattacattttggccaatctttgtattaatttttgtaagaatatattgtgtaagtatttatagggtaataatacatatcatacgaatgttaagagtgcaatagcaaaataaagaaccatagccaaaataaattcctcataagcaagcatcacacacacacaaacacacacacacacacacacacacacacacacacacacgcagaaacatggacattttcttcactgactcagaaaaaattttcaggtaaaatgtcctgtaaatgttcgagtggtcacaagtaaaaatttacaaagtgtttctatagttccagcagaaagcgaggtgcattagaagaaaaatattcatgatatatttagaaagacaccaaattttgataaaacaagtggtaactcagtttaattaaccaaatatataccacatgcaaaatatgtcatagatactgataattcaaaataagtattctctaatttggaaattagcaacacacatttttgtgtatatatgtggacagatatattaatccatccctggcataggagtatcccaatgtactaatttgaactcttataaagcattcagttcaatataactcattaaatggccctacagcccaaagaagaagccatctttagtatgcatgatacaagctttcatttctataaaaagaaatggcaaaagattagatttgcaaagcaagataaaaagacacttgtcagctcctagatcttccaggaagcagcatatataggagaaagagaaaaaaggtaaaacatgattgatataggaaaacagctttacattataaattgtatggtgtctatatacgtgggaaattttctaaattaaaaacaagtcaagaaactataaagaaatttggccaggtgcggtggttcacacctgtaatcccagcactttgggaggccaaggcgggtggatcacccgaggtcaggagtttgagaccagcctggccaacatgatgaaaccccatctctactaaaaatacaaaaattagctgggcttggtggctcatgcctgtagtcccagctactcaggaggctgaggcaagagaatcccttgaacccgggaggcggaggttgcagcccaggttgcagcccagcctgggcgacagagtgagactcagtctcaaaaaaaaaaaaaaaaaaaaagaaactaaaaagaaattttcatttattatcagcaactaaaaggattaagtacaaagataatgtaactaagcatttagaggggaagactggtatgtgtaagggtatggtataaaaatcataactcttcagaagaaacaaagacttttgaataattgcaatgaaatgtatgtaggtagggtggggaaaaagtgggagaagaagggaattacagcagaggaggcgaggtagaggaaggcaaaaaccaaattacaaagggcattttgtgcaatgctgaggggtttatttttataataaaagctgtagggaaacgttaaagcattggtttccaagcctagctgagcattacagttacccagggagctttcttaaaatgctcactcccagtccctcatacccagagattctgatttaatttatcttgggtggagcctggtgattttcacatgtagctaaggttgctaacggctgtgttaatggattttaagtaaactacacaatcagatttatattgtggaatgaacactaatcctggcagtatttagactgattttggaatagactaaactgcactggatttcttatgatattatcattataatataggaaagaagacctgaagatctaaagtgaagccaggtagtaaggatggataaggagtgggagtggcattcatagttttaatgcgactggaacacgagaagcaagatatcatagtgattataaatattgactcgaattcaaactctactcctgccactttgttgttgtgtgaacttagacaagttacttaaccactctaagtctctttttgctcatatgtgaaatggaaataataatagctgcaccacagaaattttcaactgtcaaaccaggtaaggaagttaataatggataacaatatcaaagatatagcaaatattcaacaatggacagtcattatgaaaatctagctgtctcagtaaatgtgctggatgaataagagggaaaggtgtagcttggcttctagaatttatatgtaatcttttttcttaaaatataaaatatatagagaaaatctgtaagtcataagtgactcaataagttttcacaaatgtaatgcacccatttaaccagtatcagatcaagaagccgaacattatctaaacttcatacccctttcaagtcatgtctcctagggtatttatttggcccactaaatgtttagaaatagcaagagaaagattataagaagaggtgtagtagagaggaagataggtttaattttggataagtggggtcaagagcctgtgggatattcaaatggaaaattcaagaaggttttgagcagaataaagggtaagtcatagacactgaactgacagacattagcatcaaagcagtagttgacattaaaaatggttcttttcatattttcttttctttttttggagatggagtctcgctctgtcacccaggctggagtgcaatggcggatctctgctcactgcaacctccgcctcccgggctcaagcaattctcctgcctcagcctcccaagtagctgggattacaggcatccaccaccacacgcccggctaatttttgtatttttggtagagacagggtttcaccatgttggccaggctggtcttgaactcctgacctcaggtaatccacctgccttggccttccaaagtgctgggattacaggcatgagccactgcactcagcccataatgttttaatggtgtatgattcaagtgactaggcataatatgttgcttgtctcgttgctcaaaaagtaagaaaaataaaagaaagagactccactcttttgctaggtttaacattgtgttgttgtatgtatatatgtatttctgtacacatccctatattgggaccatatgaccttccacaaagaaacaatcttacttaaaattgttttaaataaatatgtaaaaagtactataaaattttacattattttgcgacagaaatacaagttttgttactgattagagatgcagcaacagtttgcttttcaactacattaggaaccctatgagcattttttagataatttcatagtaataagtaggaagtacataagacataggattcactaacttggtgagaacttaattgctcacaagagaaaaatgctagactaatccccttagcaaagaatctatgattaaaagattctaaaaaataatttgaacaatttccagttaccataaaaagacatggttgagaaaaatgcaactttttgctattgatattcaataaatgtttactatatatataagttggggctgagtctttctttcattctttgggtcttagcataaacaccacctcccccaacaccacctgctctaaattaggtttcactggccactctcttgtccccttgtccatgagagcacccaacataatttgaaagtatacatttaattgtttgttagccagcttattgactatcttctccttaatggattagtttgtgaaagtttagaccatattcatttggttcactgtcatattcctggcacctagaagggttgttgacgtattgcagagattctcaatcttggtgctactgagattttgcacaagatgattctttattatggtgggttgacctgaacattattacatgtttagcaacatccctggtctctacccactagacaccagtagcaaacatctcttcttttagttatgccactaggaatctctccggacatggtgaaataacccctggacggcaaaaccacccagagttgagaatcactgaataatttaatacataaatgaacaaatgagtgagtgaatgaatgaatgagttaatgaataactgtctgattgctcagaaaacggaagtagaagcaggagcaaagcacattccagtcagatagtgatatggtttaaattcatgtccccacgaaatctcatgttgaattgtaatccctaatgttagaggtggggcctggtggcaggtgattggatcacggtgtttctcattaatggtgtagcaccatccccttgatgctgttctcgcgatagtgggctctcacgagatctggttgtttaaaagtgtgcagcacctccccacttgctgtctctcttgcccttgctcccaccgtctgagtcacctcgctccccgtctgccttctgccatgattagaagcttcctgaggccgccccagaagcagaagctgctatgcttcctgaacagcctgcagaaccgtgaaccaactaaacgtcttttctttataaattatccagtgtcaggtatttctttacagcaatgccagaatggactaatacagagggaacagtaaataagtagacaccgagggacttgaaagcttattacatgcaagaactaagacagagctagcttgcctggagctacaagagcaaagctgaattgaaatgggcgagggaggcatggtccagttatgtaggtcaaggttaaaaggtttggaatttactcttggtagaatgagaggcgttttaatgaagaggtgagatgatttaattgatctttctaaaaggttgctccaaatgctgaaattaggatttatagatggggtcaagactacatgagagagagcagttaggatgctatttcagtactccaggaaggagctgatggtacacagaagtgtcaaagttgagagggactgtactaatttgtaggccaagccaaatcaatcggccaagcaaaatggattctatataaatattatgatcatgaacaatatattagaatgacattatatgcataagacataggtttggttattttacatacatgtagatgaaattaaagaactaatttcctgaaagattttaaaaatcacttagtctctgtatttgttgaatgactatgatatcatccaaattccagaataaaaacattctatagtgtaaattcatgagaaaataccctattgagtattattggccttataatgcaagcttcacttaactttacaattgtggaataattttctcactgtgatgttcatttcattgcgtgaaacaggttcagtacattattcatgaaactacttcaaaatgctttgttttagatttaaaaaatattggtattcacataactgctttgccaatgtgaggtttcatacgaaattcattgtttgattttctgaaaacttatcatattgattttgtgtcaaatctttatgaacaagcatttttataataaagttttattcttttctcataatctccttcccttcatatctcactatagattgtactaaatattgtatctatccttcatgtacatacagttctacgaggaaataagaaattcaagcggttcattgaattaatcactaataggagagaattgatcaaaatttgctgtaattttcttccttcaaaatcatcagaattctggtaaagctttgtatttcataatttggactccacatattggtgacaattcagacactgagagtggaacacaaaggaattgggtaacgagatcactaagggaatttttagcctagtaaagacagtttctcaacattcaagaataattcaattacataaaaattcatataatagtaattaaatgacaaaatacttttgaatacttattaatgcacacccctcagagacctgaaatttgcaagactatatagcttaatttgaatttgaattttcttacttattttagcaaaataaacttaaggttcataagaacatagctcttcattcacttatcttggtcgtaaatactgttaaacacaaaatcaggtgcccacagctcacaaatctacacatgacacatctctttacgttcctcctgacctacctcagcccaaatccctctctacctcatagaatttgatattaactttctgctaactttttgaaaggagaatagttctgttgctacgagtcacccttgaccctttgcaagaccaaacatgccgataatttaaaatgtgatgtaggctctaatcaataattaagtgttgttctattaacttatgatatatcacatactttatttgattcagtgacattaatatcatcatcaaacggtattataatttctcatattttaatctcctgttctaccatgcagcagagcacagctgcatattatattttccatgggaaatatcagccatcatatggcttgtagtcttccaaatttctggcctacttttcaaaatcaaatgtctacaatttccaaaaaacactgaaaatatttttaaagtacattttgcaccaaacattttaacttatgagtaatcaacctttacaacatttgaacgtaaaacggaagtgctaaaagtctggcagcaaaaacaacctttcagcattttatgagagatcctgtatcgtcatattggtgaatttaaaatgattttaagttctttctttcttctcatgagactttagatctaagcagtctgtctttagcactaaccgggatcacttcaatgcaacattttcatggaacacagcatttgctgtcaatcaataagattataattacaaaataatgatgccttacagacccattctaaaaatactttgacatctgaatctatgaaagggctcaaataccaaaaaggatcttccagattcacatgaataaagttcctgaggtagttgatattttaaaaattccgtgtcatgccaattatgtgaacctatgctggttagatcacacctgaaaatttaggatgtattgtcatggtatgtgaactgactacaaaaggtatcaggaggttgatatttgctacataagagaaagatgtgttcaagaaatcctcacacctttgcatctcactaggcaaatgggttaattacatctgaaatcatatttcgatttggttgatagtctgataagttaatttaaggtgaccctggtaccatctaactgttttgtttttattccaaataggatattggccctttctaaaaaggattatgtagtcttgtctatatgagcaaaaaaaaaaaaaaaaaaaaaaagtaacctgagtataactatggtactaagaaagaaaatcagtatacacaggtaggatttatctgccataaagaatagttcactgctataagaatttcttacaagaaactctactggataatcaaccttctagtcaaactccagggaattcaatgtagtttaaactcaatacatattagggaaatcacaaaatgaatcatatgtagtcattctatggatgagttcacaatctagatagtatttccgtgggggtaatgaggagtatctcgccacgtcagaggagtgagtatccttctgccttcttaagtataacacatatagttaacataatattttcttgaagtaacagtagagagtcaagccttgtaggagaacagatattttctaccaagtctcagcttagtctgttactcagttttcttgccatagtactctgcaacatgctgaatccacggtttttgtagaaatgcgtccacaaaatttatgccatgaatgcaacaaaaaagcagtacacacatccagtaagaaattgaattcaatcagtagataagcttggccaaatatttgaaactcaaaaactaaatcattaattgtgcaaaagtaaagaaaaagtgggaaacgaaattaatgtaaaatattccaaaacattcttactatttttaactaagaaagcatattttactgatgtctgcaagccttttgttcttcactctttcaattctctaatcctgccatccaccccatatctttctttcatttggaattttggtttacaacactcagttgtagactcaggcatataacttgtgttttagtcttattcctttgcacaaagacaaaatacatagacaggacacattgatcagaaaaccagaaataatctatttctaaaatttctaatccctgacataaatgtatcaaaatcacacaataatttaatagaatgagaattgcacacacacacacgcggcacaataaaacccaaggtaaaccaaagcacaacaaatgtccttctgaacaaaaaggttttccagacagctgagagctactcctttggatgacagaacacctcaacttctggatgaaaggtttacatgaaaatgattatgtaggacagctctctttcccttcttatgtatggtatgtctaacataatattttcttgatgatttagggttagaattatgatgtgaagatatgactgtggaaggattgatcccaggtacatgtggatgttcacccctagaatgcaatttctttttcttttattttttttagatagagtctcacactgtcacccgggctggagtgcaatggtgtgatctgggctcactgcaacctccgcctcccaattctcctgccaagcgattctcctgcctcagcctcctgagtagctgggattccaggtgcccgccgccatgcctggctaatttttctgtgtgtgcatttttagtagagacggggtttcactatgttggccaggctggtctcgaaatcctgacctcgtgatccgcctgcctcggccccccaaagtgctgggattacaggagtgagccaccgcgccccgccctagaacacactttcttagaaagtttcaaaatatctttttactgttacagtattttaggaatctgaacacttattagtaaaaggaaatatgaacttgctttctctcaagtagtatctttctttctccacaaagccatgtcttagagctctttcaattatgggtattaaaccagtatgaccagaatctcagacaacagacactatcctgtccacacagagctaatgtttatccctgtctgcagtcttcatcaacagtttggaaaggaaaagtcaccctcgctatttcaatattttaagctgacacattttacgaattcctttacactctaaaagtggtctatatatttattagataggacttctcaaggcatgatatagcctagaattttctggaacctctgaatcctttattgacactgaaggtccatgatagtgcctgcaaaatgattgaacaatactaaatcttgtaaacaatttcacattatatttgtaatgtaccacagtcattgatcttatgaatgatggtgaaactggcggtgggaaagagaggtaaacacaaaaatgtgtatcctaacactaaaccagtttcaaaaggctgtgctcccaagttatcctagccataacatgttctgatttcttactttcacattaaactctgtatagtatattgtagaacttaattcatatctgctaaattaaatgagtgaatacataaaacggaaaactgaggtaaattgtgtactacttacactaaatcaaagtacagccttaaaggaatatacatttaataatgagttttattaaataaaaataatgtattctaaacaattgtctgcatttaaaacttgccaatggaaccatgaaaaaatgcccaaactcatttttcattaatgcaattcaaagtaaatccacagctagaaacaattttatactcaacagagtagccaaaagttaagtttgacattgtcaagtgttagaatttgggagcaagcagaatttttaagttcgtgagaatttaaattggtgtaaccaattttaaaaataatttggcataatcttggaaacttagaaatacatcatgtcagtcagaatctaagcagacacaaaaagtcatttgatatttaaatcagaaagcttaaattatagaattgaaacaaatgagagaagaacagagttgacaagctgtggaggacaaagtgactcagagtttagcaaccacaggaagccactattacccttaaagtacagggagaggaagggagaggagagaagaagagtgggagagaaggggagagagagagagagagagagagagagaaggaggaggatggggaggaggaagaggagaaggaatggggaggaggaggaaagaagaaggcagggtgcatgaattcagtgaatgaggttatgagatcattcattggaagctgcagctatagtgggcctatctggttggaggggggacatcaaagcatatgcagctgttgccaaagatactgcctgaaacacaaagagaggaagagaagcactcttgtgtcttccctgagtttccaatccttcaccatcagccaaagagagctggaagtcacctggaaatggaagcctggcacacacagtctacaaaggtcagtctcccagtggtacacagtagagcagtgtaaaggagccaaagagtataccagagggcacatacatgggccctgtgacccagcaatcccactcctacatgtatacaaggaaccttgtttgtaataggaaaagaattaaaactggaaacgaccctagtatccatcaacagtagtatgcataaataaattgtgggttatttctatgacggaatatgacataatgctgcagtcacagacatggatgaatcttagcaacataatgctgattgaaagaaacagtcacagaagaataaatgcaatatgattccaactatacgaagttcaaaagcatgcagagcaagactatttctcttttagtaatacatatatatgtagcaagactataaaacaaagcaaatttcacgaccaccgttatctctggtggtagtggggaagcgatggaattggagatgggtacatagatggcttcaagttactgtggaaaattcgaagtaataaacacatttggttatgattgaaactgtatgtcttaaaatcttttgttcttatgtaataagatatttttaaaagacagatacatgtttaactgattggcaagttagtataacaacatcaacctaaaagaaattaagtttatttttgtttttgtttttgttttttaaatctgaaaagcatttccctttcagcttgctgggtttcttgcactaaaagatgagggtttaataatcatagcagatcagaggcttcagtagggaggagatgggatagcttattgtgaaaaacgattttccccctagtttaaaagtggcccctggtaacatttttcttgaagcttctagttatatatatcgttgtcagtcactttgcaactttgaagaaacagttttcctgccgaagggctctattatagttaatatgtgtctacataatacaaaaagtcatttaaaaattattgctttaagaactatttattgagtgcctcctaagtacataacatcaaactgtgaatttaaagtggacttgcataatttaatcaaaatttatactaaggaaaacaggctatagggcttttcgatactacaatacctgaaaaatgaaatactacagttataatccacatgataccaggtatgaaacattcagtagcagtgggctagagctacaggttaccttcttgagacacgttgtcaaagaagaccatagcactaggtaattgggaaatccagttggaactgtgtagcagacactgcccactctgttggtttacctctggcttgatcagccctgtaatggagagtctcgggcatgctaacagcccaccaggtcaagcacccactgcttctctgtgtttcagcctcacgactttgtccaaagttatagaaactcactcatccaacacacaggaggggacctgatgtccctgagaaataattaatgaggcacaggaaccagagacatattccccagcctcttattcttcagagggacaattatgagtacattctacagcattcctcagaggggtcttcacaggattgaacaacagtttcccactgcagtagccagctgaataatacactcactattgttttcccccgtttttccttacttcccctgcctcccacttgtgctccctgtgatcagctaccaaatgagctagttgctctctagtcctcgcctcaggcttagcttttaaagaaatccaaactaagacaaactgtgacaaattacaatccaaacgagattctttcctctcagggggatgcttagtccccccatcaagcatcattatcaaaatgaacacagactgcagaggaagaaaatatttgccttcactgagcaaagtcagactcatgaccctcaggttagagacacagagaaatgcaactaactctggggtgaataggtacagattcagagtggaaagactttaaaacagcaataaagtcctagaaataaaaaaagctgtcagctcggtacagaccagagcttgagagcaagagtactaagcgactcatagaaaaggattcaggagggaccagcacagcgactttaggctcatagtaacaagcaacagtttgctttggctaaagtttattactaggtgtggacaagcaagagataaatatcggaatctgtgggtacagcctttggatttcatgccatggcaaggtaaaatccatctgcaacatcaaaaacagagaggcatttgcaaaaggaaacatgaggagaatgttcctagcagcactgcccaaaataacacaataaacgaaaaatcttcgagcagcccaaatgccctctggcaggaaaatggacagttaacctgattacatagtagtcaaagaaacgactgctacacaaaacaatcaagataaattctagggatgggatgatgcatgaggaaaatatgagtcccaaatatctttttaataacatttaaatataaaaacaaactaaaacattttgtgtcatacagtaaatatttttaatgttctcacatatgttcacaatagccctatgacatatttactattattgtccccattttttttttggatgagaaaactgaggctcagagaacttcagtaacattcccaaggtcagatatccagtaattagtgtagacagaattcaaatccaggtggaaatgctctgaaacccacagtcttacctgctacactaaactggaacaaatattgttgaaacatatgtatctgataaaacatttaaaaatattacaggattataaattcaggcaatgtttactatcccaaagttggggggacatgggaagatggcatgaggaagctgtgctttatgtcattgccaactttctagtccttcagttggtggttaagtggagataaggatgaggccagagaacatgagtggcacgaatgcaagattacatcttgtattctcttaaaattttaatattttgctcatatgaattattttgcattgattttaattgttaaaatgaggtaaaatataatttatcctgatttctgaatttttaggcgaccgcttacattttgtgattcagacatagccatcttttctgggagaggaaggggaggaggtacacacaggatttgtcttgaatgtaggtttccctattttcagagattgtatatttgcttcctgtggcttggtgtgaggtctgatgaatgttaagcgaaggctaaatcaccccctctctccttagtaccaccactgaagtcacttctttctggccttaagttcaaaaggggaaactgaatgatgagtattgagcatctacactgtgtcatggcattagtaattgttcctcacttgactccctcagtagctacataaagtaagtcttcttattctcatttcatggagtaagtattcttattcccattatgtggaagaataatacttaaagtattcttattcatgtattaaaaactgaggctcagaaatactaagaacattgtctaagggcaaatatttcaagtgccataaattcttaaacttcatgggtattttgtatgatttttcttttcaacctcttttgactgggctattctgggaggtggtcacagctattagggccaaatgaattaaaatatatgaaaatgattgatgaactgtaaggcatcatatcaacataaatatagtataattaataatgtcaataataaaatcatttacttctacttctagtattcagaagagaggtaaaggtatattttgcctattttagagtaccatatgaaatgaaataaaatattattatgaagaaaaatttactcttttcacattgggaaactatccatcagagtcaacaatcattgtcctccttctctccaaaatagaacatgctgaggtttatgctatatttttgaactatttctattaacacaattaaaatgctgaaatgaatttgaaaagatgtttatattctgacgaagggtaactagaaatattttctactctaaattgagtcaggtgtgatactgtaaacaggataagtaaaaatataatataaaatttcaaaatttactacttgattccaatgtccagaaaagaatgaaaatataaatcatataaaactctagccaatttaagcaactgtaatccctttagacatcattaaatttactttacctctgacagtaggtgataccataaatgagtaagaacatattttaaatgtcaatatattgtctctctggataatatatttgatggttttatataccttactaaaacccatagaaactttttaaagatgtgatattagtgttgatatctattgaagatataattggctaaagtttaaaaaagagtaaaatatttttttccaagcacagcccagtaatattggacatgtgatctttgttttttactgttgtcataagcatatagaaagacaatttagcaagtgttctgatgaggtttaaagagcattttttctagtatatggtagtataataaacaataattcattgtatatttcaaaatagctagaagagaataattataatgatcccatcacaaagaaaggaaggattgagatgatggatatcccaattactctgatttgatcatttatacagtatatacatgattaaaatattacatgtgatatactttggctctgtgtccccacccaaatctaatgccaaatagtaatctccttgtgtcaggggagggacctggtgggagatgactggatcatgggagcagatttccctcagacttttcttgtgatagtgagtgagttctcacgagatctgatggtttaaaagtgtggcacttcccccccccccacatcccccagctcctgccaccatgtaagatgtgccttgcctccccttcaccttctgccaagattgtcagcgtcctgaggcctccccagtcatgtggaactttgagtcaattaaacctcttttctttataaatcacccagtctcaggtagttctttatagctgtgtaaaaatgaactaatacaacatgtaacacgaaaatatgtacaactatgatatatcaaaagctacaaactatttttgtttgctcatttactatatatcttagatattttggaaccaccaccaccacacatcacacacaaattcacaaacataacatgttataaaacataggaaatcaaatgagaacatttcctaaggctatgctttttcaactggtagttggggaggaaactgaatttcaaaatctccgctctataatttctctctaactctatattgtcacttctggggaaaaaaagagaagaaggtaaattgcatcttctggctctattcagaagaagaaaaaatggttggtgatctttgttgtatggattttatctgatgggtctcctagtttacacttagatttgctgaataaatcctcctcatttccagaaagacaatatggctttgtgggagtgctgaaggcacatctttgtcagttcccactatcggagactcccagtacatcctgtcatgccaggatttgctctgcctgacaagaaggaagaagcttatgatagctttctgaatgactctgaaaaatgaagctgctctgcaggtatcatcactagaccacagataaactcaataacattcatctgctagaaaaaaaaaaaaaaagaaagaaaagggttcacttccagatcagcctttggtagagataggcagtagggacttggcagtccctagtcacattcaaatgaaggttcgacctattgtgctgaagtctaagacaaaggtgcttatttagatttcctattttatggctaaaatatatgtgactgtaggaatcctctgttggacatacgcatacacaccaacttatctattgcaagggtctatattattagtatgactgtatattaaataattttattatctgaaaaatttgagtgcattgaagataaaactgactcctgaaatctaagtcctatttaatcaaaacttgcttcaaaaccttcccaaagtttcaacatgtattattttttcgtgtgtgtgacaaggtcgcactctgtcgcccagatggtgcagtggtgtgatctcagttcactgcaacctctgcctcccgcctcaagtgaaacctcccacctcagcctcccaagtagctggaattacaggtgcccaccaccacacacagctaatttttgtgggttttgcagagatgaggtttcaccatgttgtccaggctggtctcgaactcctgggctcaagcgatctgcctgccttggcctcccaaagtgctggcattacaggcatgagccactgcacccggtcaacatgtattcttaaacagatttaaaatgctttcttcatagcattaaaaatgtttcacaataatttacatgagaactctatggaagcttaatatatttccagcataggatacacacaatgattcaatgtcctggcccttgaagtacacataattggaatgaggagaaggacatttggaaaataattaccatgcaatatgatacctgctattgtacaggttcttacaggtgctacagaagaatcaaaggaaagggagactaattccacctcagagaattaatgaaatgtatcacggcaaagatcagattttgtctgggtcccaaaggacgttcaaaagcttggtaggttgagaaagtgggaaacagcattccaggtctaaggagactgccttaaagtttaagtaggacagtcaaagagtggaggaaataagtcaaaataggaaaatgacaaaaaatagagaaccttgtaggccaggcttaggacttctaacttaagacaatggagatcatcaaagaccctttagatgactaagtctgagagcagtgtgtaaaaggattggcttgaaaagatcaaaatcaggaagtccagatagaattgagaagactatggcaaatagtgttggttgatgaaaaggcattgttggtattaatgggagattccagagatactatccaacctgttttatacttttttgatcaggttgcatgtctaagaacatccctaggaagtattacttttcactgcattattttttactattcaactataaagtaaatggatgcatgtaactgttgagcctttccttgcactcatgccataaatgtaagaacataaagctacaccttaaagttaccttttagctcttttattttttatgttttagtagtattcagtctattctactgaattcagtcccgatttgttatattttatttactcttcaaagaaagtttttcaaatgacaattgaaataaaagaagataccatttgttctgtagattatctacattccaattcctatttcctaggttccctattctaatcatctacttttctatattttcttcatcaccaaatacaggcagtcacaggcaagtgcaggagttaataatcattgataaattacatgttatatagactttgatattcaatttctctggagatatataactatatatacccttctttccctcagagggctttaaggaaactaaatccccaaaactaaaagcactgactcatggtttaaagggtaagttaaatctctctgtaaaggaaagcctaaatgtgatctttgcaaacataactggtgatcaatagccgaaagattaaagcagtacatatgcaaaaaggaagattgaaacttaacattttgtttattgatgtcattcttagatctcaattaatttaatttgatacatcaacctccgtcctcaatcaaacactagatggataaagataatcactattatgtaatagtcaatacgcccaggtgtctcctggcatatatgatctattgaaatacatatattattatattttaactaagaaacacagtatctaacccaagtattatgtacattttttaaacaattcacttccttgaaagttatgagttaccaatcatttttaataaatttctcccagctttacatttatctatcaattatatctgaacttcaaatacactctggatgcatttgtctcagagcaatgatggtgtctaagcttgcagtttctgtgtctgtgaaattcatttgcagtaaattgtgaataaataaatgcagtaaaaagcctaggctccttggagagtctacattctcctccctcccatctctttctctcttcttctctcctaccctctcatcctccatctgtccctttccctatccttcttatcacacatgggaaaaactcaattgaattaaattcagtctaccagaagtatacaattgaatttttgataaacacaccagaaattagatgtgtatgttcatttattccttccgcacatatttgttgaatgtttacttcatgccacactatggatcaagcagtgaagataaaacagtaaacaagacatgcaaggaaactactctcatggaacttccaatctattgtagggaatagcaaataaatgacaaaataacataatcacccaatataataagtgttattgaagaaataaacaagatgttcagatagaaagtacctaaaatagagagtccagggaaggagagagaactagtctggatttcatagtcaaagaaggtgtttttttggatgtgcaattaaacagatttgaaggatgaaaattattccatcatgcaaaataatagcacaagtttgtccaggaaagagcctttgcaaattccctgggatggaatagaggccttcattactgtttggaacttctctcttcaatctacctttgtagcctaaaaggcatttttaaatatggtcaagaatgttgaaactgtttttcttgatagtgtaaataaatgtatgaactactcaaacaattagctatagtgataaatcgaataagttggtaggtttgaatatgctggataacactgtttctgataccacctagagactggttcccatctgtcaactggttataaaacaattttggaaggaatattataacttgcaaagaaaacgaacagaattcagagaaaaagtaacaaaaattgctcttaaatatttgaaaatatgttcatcctcattcctgagtagataagtgcaaactaaaagacatagtttcatagtttttcaccaatcatattggcaaagatcaaaagtttggtagtatactgcgttttttatggtatgaggaaattgatgttctcataccttcctgacagatttgaactgatatacgtggccatgtgtatgactatgcgcatgtatgtacagcagatatctgaaagaatacacagaaaaccgcaatgccagcacccccagtaagagagaaggaggataactaggaggctagctaacataataggagaaacaattttctttatgcgttcttttttgtttacctctatgaattttgtactatgtgcaattaactaggtaattggagctttaagagcactttgggggtcattaacactaaaaatattttacatagaaataattataagcatattcatccaaccatttatttatttatccatgcacccatccatccattcatccatccatccgtttatctcttcatccatctcatgtttaatttgtataaacgtttatttatcccatagactctatgtatgtatggtacatgtaaggttatataagagatacaatgttaaataaggcagtttctactatccctaaatttacaatgaaggagaaaagctacctcatgattacagatatgaagggtttggtaaatgcatcaccaaggcttacacataagcagaaggagagggtgcagagagctaaaaggctcccccaaaggactgaaacttgaaaggaattctgcagataggtttgaaagccctgacatgatttttttttttttttactgtttcctattgcatattcttttgtccctttcaagtatgaaaattcttataatttccttcaatgtatactctctaagtaataaaaacaattgtattctcaaaagctaacaaacaagaaagcaagcaaacaaaagttcaggtatcacatttgcagtaatatacaagtgctttcattaaaattatgcttttatgtgtttacttagaggagtcttgagaaaatatttagacctaccccctaagctttagggaagtggtccccaacctttttagcaccagggactggtttcgtggaagacaattttttcacagacttgggctggggagatggtttgggaatgattcaagcacattacaacatttatcattaaattctcataaggagcacacaacctagatccctcgcatgcgcaggtcacaatagggttctcgctcctatgagaatgtaatgctgctgcttatctgacaggaggcagagctcaggcttgcccggggctcacttcctgctgttccccctggtttctaacaggtcacggaccgattggtctggggcccagggtttggggacccctgctttggggacccctgctttggggagaacagcataaaaaggcagcatttctgaaactgttctagatttttatttttctgtcagtaaaatggttgtagtattggtatataaatcttacactgtattgtagagtctcaataaagttactcactgaatgaatattttaaaaagttttcccttattaaattacaaaagtaaaataggagtactataacataatctacataaataccaaatatgaattgatatatttttcctatattttaacagaaattcttcttgagagaaacatagaattctatgtctcctatttatagacattaactgctacattttgcacaaccacttttaccgttagaaagagaactgtactttgatggttacatagcaccttttcctcatgtacaaaatactaatgctactaacaaaaataattttaagtgatcaaaatatgaaatgtaattatcaaaccccattatgaggatgaggttaagataaagtaaaatcatctttgtcagggtggggcgcagtggctcacacctgtaatctcaatactttgggaggccaaggcagggggatcacttgaggccaggagttcgagaccagcctggccattatagcgaaaccccatctctactaaaaatacaaaaattagatgggtgtggtggcacacccctgtaatcccagctactcggtaggctgaggtgggagaatcgcttaaccccgggagccagaggttgcagtgagccaagatcgcaccacttcactccagcctgggcaacagaagtgagatcttaaaaaaaaaacaaaaacaaaaacaaaaaatcaactttatctatgctttgctataggtgttaacgataattgcctattgtcctacatggatgattttattaatagtgattacataaaaaaatgaaaaactttctgtgtagtggtgatgtaaaaagatagttttcatcacatggatttgttatatttttaaaaagataattcttcataggtttttcagggattgtctggttttatttgtttaatgaaaaataaatgaggtaacgtctcattgtaaaataagagtttaaattttaattaggaaaagatacccaagacagaaatacatttaaaataagatagattatcacttttaattatagaaaatgaagctttccagaattatgtttaaatttatagatgcattaaaaactatcaagtttaaacatttaagtacctgaataatgttgagcaaatagcaactttggactatgctggcatgaggagagtgaggaaatgccacgataaaaatcagaaattattaaagaagtccttgctttcttttgcttacaaaagattctattgatattgaaaaacaaaccaaaacaaacaaaaaaatggctacggcatctggattcaaaatgtttccataagtctatggatgcaaagtgagtctcaattttatgaaataagaaaaaagaaaaatgttagctagaccaggcatgatggatcacacttgtaatcccagcactttgggaggctgaggcgggaggattgcttgaggccaggagttctagaccagcttgggaaacatagcaagaccctgtctccacgaaaaataaaaagaaaattagcagggcgtggtgtgcacttgtcccagctactcaggaggtgcaggtgggagaatcatctgagcccaggaattcaaggttagagtgagctatgatcatgccactgcacttcagcctgggtgccagagagagatcttgtcccttaaagataaaaataaaaaataaatattagctaacctactagttttacctgagttccttcagtggattacaacatatttcaaaccacagccctattgaagttaatttctgtgtgatggaatttattagctttatgttttaaaatacactgattttctcctctgaaagagtgagaaaatattctttagaaacagtttacattacaaactctgatgagtggatatgaatactttgccaatgaaatgtgtgtggatacttggaaattggctgggacatgaataaattgctcaaccctattactgtacacactgaagtactattttttagtacttcagcagtaggtcagcagtagaatcctcatatccccaaagaaagaacattataaatatatgtgtaaatttttagcataaaacgtgtttaaaataaaatattaagatggaatattaagtataacctgaatattaagaacagatacactcggaattagtggggttggggaaaaagtagaagacagctctgtggccgatggttttggtaataatgtttagggattccaggaatatgattttcaatgtcatagtatttttccaaatgactaagtaggtttttcaaaaactctgggtttttttttttttttttttttttttttttagaaaaataattgatggactcaatctgaaagttattttggcctaccatacaaagcctatgcagttctcagtatgtgacctgctggaatgagtgtgaccacctcagtagatactaacgttgtactggcaatacttttaagtttaaaaccacaacattgtattccggaagacttctattttgagtcttttcattctgatagtatcctccaaggaactttaaagaatagaacccctgattcaggtaacaagatctgaatgtttgggatgcatcagtgagtagaagcaattcacgcactttcagaagtccttaacttttgggcccctcaagtaactggactgtaacttgaatccagtaaatgaactacatgaaactgtcaccaaactaaagcaattgatgaaacagtaacacgaataaatataaaaggcactgctaaaaaggctttaagaaaggctttttaacatttttgagggaaatagtatgtaaaagtgtagtacatgataactaaaattagttaaattaattgcaggagttactttaatcaccacatgtctacataacaatctaaactactaaacgttataatcttcaagaaaaggctacaactatgaaaaagagcattggtgaatgtattaagtttgatagtaaaaacaaaacagacaaattaagctgatttggccattgattaacttttggatattgggggacataaatatttatggcttgttttctatatctttaaattgagtatggatccagcaatcccattactgagtatgtatcccaaagaaatgaaatcattatattgaaaagatatgtgcactcccgtgttcattgcagcattgttcacaatagccaaggtatggattcaacctaaatgtccatcaacaaatgaatggataatgaaaatgtggtcacacacacacacaatggaatataattcagacatgaaagaagaaaatctaccatttgtgacaacatggataatcctggaggaagttttgctaagtgcaataagccaggcacagaaagccaaataacatatgatctcgcttattataggtggtatctaaaaagttgggctcatagaagtagagagtagaatagtggttaccagagactgggaggagggtgtgaggcttgcagagatattgatcaaagaatacaaaatttcatttagacaggagaaataagttcgagagatctattgtacatgttgattctacaggtggttcataacaatgtattatactcttgaaaattgctaagagagtagattttaagtgtttttcacttggctgggtgcagtggctcacgcctgtaatcccagtactttgggaggcggaagcgggcggattgcctgagctcaggagttcctgaccagcctgggcaacatagtgaaaccccgtctctactaaaacacacaaaaaattagcaggatgtggcggcgtgaggctgtagtcccagctactcaggaggctgaggcaggagaatcgcttgaacctgtgaggcagaagttgcagtgaaccgagatcaagccactgcactcctgcctgggagacggagcaagactccatctccaaaaaaaaaaaaaaaaagtgttcttcctacaaaaaaataagcatgtgaggtaataaatatgttaattagcttgactgagccattcatatatatatattcaaaacaacatgttgaatgaaataaagataaacaattttttctatccattaaaattaactatttaatttaaataaaataaaatggatttgatcatcctaacacatttactaggttgttataagatctaaacatggcatcatctgcagaggtcttggcttaatgtctgacatatattaattgcttagcaaatcgtagctgtaatcactaaataaataaatttattgacttttttattccatagtacccttcgctacattatttgtatctctacttcgtctactgggaaggtatgcctgtggcagaaaagtttccatcttatctagcctttctcacattcccttctgtccaaatcattccagcccactctgaatctaacttgttttgacagagtacttatttacttggcacatgataggttcttaataaatatttgtttattgccttataggaagaaagttatgaaggaaatataacttgtttactgaggggtagcaagtttccttctttctttcttttttttttttttttttttttttgatggaatttcactcttgttgcccaggctggagtatgatggccagatctcagctcaccacaacctccgccttttagtggagatgatgtttctccatgttggtcaggctggtcttgaactcccggcctcaggtgacccgctgcctcggacgcccggccgcaagtctttcttttatcttactaaacacagacaaatgatggagaaaaagtctgttaagcaaatgcatactgtcttggattatttaagttttcgggtatttaggttgatttcccaactaggatatcctggaaacagatttaatgtaaatcatcttatcccttcaatctttagattctgtattaatctttctaaaaatttgctcttatgttcttctggaacatttatatccctaatagggatggtaaatctgataatctgatattcaaggtagcatggtgcacacacggattatttgatttagaaaaaaaatagacatgtgtttccctaaccgcttgtaaaatgcagcatgtatataaatcatctcatgtattaggcagtttccattttcccaaaagaaaatatgcctgtgagccctcaaaaatattttaggccaacatgtatacacaaaattttaggactttagcaaatatatataatcaattgtatgcatgattttgataagaaattgatgccattaattttctatgataaaaatattaaatatttttatatttcatatttatatcatataaaacattagaaatattagaaatgctggcatgttttttagtctcgcatttcatgaaatgactttattcgatctctttgaaagctactttgaggtaatttttttctttgtcataagaacccctttttttaatgtcatctagaagcttttttcagaacccatcaactccatttccagctacataagttgagataaattactttgtgaatatgtatgctcttcgtcataaaaatttgacctcacgccacactctgcttgctagtaagaaagctgttgtttatatttttccccttgtcttttggtgtatatttgtgaattcaatagcatgactgcttactgttttgtatatgtggatacgtaggtatgtgtgattttttaaattatcattaacaatgacacctagcaagtaagaagatgaagtcagatacctgggaataatctaacattcaatatttgccttcagtttttcaatccgtttcatcaggtaacctacttacagatgtaaaacttgcaatgatttgtcttctaaacagtattatcttattcagagtaaagcaattgagagttctttctaaaataagagatttttaaaatataattaagcaactttgaacaaattcacctataaggagacgtaccagttataacactgttaacttacatggggttggggtaattgcttacaatcagatattctcagacattacaaactttaggttgcagtactacaaacaaatataatgaaaacggtgaataaacatttgtttatgcatggctttattcttttgttcaccaattccttgttctgtttaaacacattccaaaaacatttacccataacgtaaaggaaggtatgcatagatataatttcaaacattagtcaatagcattcagtgactgaatggatttcgggatggagaaaggaatacaaaaataagcgacttcagggatttcagatataggagcctggaagcagtggtgcttaatagaaaggggaaagagtcatgaagagctggtttatgtgggagtagataatgagttccatttggtatatttaattttgagactgatggggggacacttaattggagacgttctgtaggtgtaattatattaagaaggggaaaaattcaattagagctccaccaaattatatcagctgtgtccaaaccatattgattgcctgtgtgtatagctggtgtgcagtgtagcagagctgaatgctactaagctcccttccgttctacgttttttgatttgaagaagaatatggagggtgacatgctggaaagaggacatgaccagcagctttctctctctctctctctctcactgttcctctggtttctcctttgtttcctctactgcaaatggataatactgtgccatgttcaactaattggccatagttactgaggatatcaaaacccatcaagcacagatacttttcttttatattattattatattttaagttctgggatacatgtgcagaacgtgcaggtttgttacataggtatgcacgtgctatggtggactgctgcacccatcaacccgtcatctacattaggtatttctcctaatgctatccctccctttgccccccaccccctgacaggcccaggtgtgtgatgttcccttccctgtgtccatgtgttcttgttgttcaactcccacttataagacagaacatgtggtatttggttttctgttcctgttttagtttgctgagaatgatggtttccagcttcatccatgtccctgcaaaggacataaactcataattttttatggctgcacagtattccatggtgtatatgtgccacattttctttatccagtctatctttgatgggcatttcaacttacaatgaagttacatgctgatatacccatcatagtttggaaattttgaaacttgaaaatgcatttgatacacctaacagactgtacatcataggttagcctagcctatcttaaacatgcttagaacacttacgttagcctacagttgggaaaaaaatcataaaacacaaagcctattttataataaaatgttgaatatttcatgtaatttattaaatactatactgaaagtcaaaaccagaatagttgtataggtcctcaaagtatggtttccacagcatgagtatcactttcgcaccatcctaaagtcgaaaaattgttaagttgaactactgtatgtcggggaccatctctgtacttgaaagtagtcagaaaaccaaaaaagtaataaaaatatatgatacggtattattattattattattaggtctagtattctacttagagaaagaggaacttccactaagtatctggattaaaagaagcttttgttatttatacaactaaaacgttgtagaaattatttcccaactaatcaagacgcttttaaatgccttcacaatctaatcataacctgcttttctagccctatttttggtatttcacccaagcattcaagatttcagaaacatatagctacccattgtccttcccagatactatgaaattacattcctttaagcttttgtacatgttggtccctccctcctggaatgcaacccctactcctccataaccccaattcttcatttgataaatctttacatgctttgagatttatctcaaatattaccccattcctcctaccctaagcaaaaccattcatttcttttgcattatatatatttactattgcatacacaaaatgctacattctctatgacacactatactaggttgtgaactcatcaagtgcactattttttaatttttccattctttacacctaactcaagtctatgcatatatttttctattatatgattcatatattatatattatacatttattatatatattattttatactatattaatacatattaacaattaatactatatatatttcatatatgttaaattatgcattttatcttattacatattatatatattcatatgattcatatattatatggattcatataggtttgttaaattaacagtgaaagccccagtttttgaggaaattgtatgtattgcctatatcttggcagtcaactttactaataagctgctataaaataaatatgattcattaagagtgtaaatggaatcctaataaggagataaccctaaatttacgatagtcaggcatgttgtgcaacagagaaactgtattctgtaattgctagggggagagtgcgtggttactgtcgatagttgcgttatttagatcattacattgcataagtaatgtatgcccatattgatgtaaacgttatgcaggtaatgcatatttattacaaataaattagaaaatagagtaactgtgttattctgatttgctgaatcttttgttcacatgtaggctgaggtataaatcaacagaataaaagtgtttttatggctaaggtcagtgagagattcaaacaaacgtataagcatataagtgtgcttatataagtatgtattcatagtcacacacatatactcacatgctaacgtatcaattgatttaaagttaattttatagggggttgatttgtcacattatcaaacactaaagaatgtatgagtttttaaaatgtccatgagtgaagaccaaatgccagctaactgagtgtaacatagaatataggtatattgaaagtattcatatcaacttatatttcatcataaagctgtatttcattttaaggtttgaaactccaatatctactgtgtcaaagcagattgagtatataaaggaaatgggttcagtggtagctatgacaaattaaattttgcctgcttctgtaaagtggaaagtccctattcagaaccagacaattgttactagaactaaaatgagggtctagaaaatctattcaaatatacacacacgcattatgctaaacacaaacgtatctgtccttatcaagtaaaaataatgagcaaacatctgtgcatgaatgtaagctcagtctactttatcagggctatttccgattttggctgatagatcagtttccttattgatatggctacaatagaatccatttgaatgagattttgtaaccataaggaattgtattttgtaaggtggggtcacaaatcctttcctgtttcaaactgattaacactgatactgctcttttgtgaaaattgcctgtgtgcaggaccatatttgaaaatttgaacaataaataataagcatatgtaataaaagtaatagcgatgtgtgtcatattatatatagtttccgtactcccctagtggggtgggtggattttattttcaggggaacttccaaccttataaacaattcaccaatacattttccatctatggggtaaaaatgcaataggttatagccatatagtttacgccagacctctaaggcatttggaataaaggtagaaaaaaagggcaacatttaatatttgaataaatatcataagggtgaagaaaggagagtcgtgggtacatattgagagaaaagtaattataaattggtatgactagaagagaatggcaatgagctttggcaaatgatccccattatagtgtagtttaaacgattgatgtacaagcccgaaaaggctggagaatatcagatctgctggttacagggtgtatctgactaccagtttcagggtacagctgaaataaatcagtgatcccagaaaagaagtttctttttacgtgcaaaacttctgagcaaagtgatctctgccagctggagctggggattcacagcctctatttttccatcaaaagaattaagttgactcccagatagagaataactatatattttttttcagatgtagcctcctgagtactcaaaaccatctccaggatatggaaaattcaccttatccaaacgtatatggctaaaattcctttgtaaggcactacctatttccctgtttcttgtatttgattagagataactattgagaaaacatggtttatgaaagaaatgggaaaatattttcccgttttgataagaatgtatttttaaaaaacaaatggaaacctaaagacacaaaaaaatatttgtaaaggggataataccctgagggaagggagccagaagtagagactagagatattaagaaaaactttaatgaatttatattttggctcagagctcacctactaagggagtaaacaggcaaagtcacaaaggtttataatccttacacttgccattggtcggggtaggtgattagatgtgaaaaaaaatgatgctttatttattctgggcatattaaactgaactgggtgatttaaatgaactgtaggaaattcaatgcaacagctaaaatgaatgactaaggagctagaagatcttaatctgtataaagctgaaagaacaaaatatgcacaatttagctctgtgctaatgaaaggaaagagataacactaaaaataactgaatggtgcaggcttcaaggcagcagaagagttctggcacaaatggatctatccagaaaaaaatgagacttaattacacaaaggaaaaactgttgactgtgaggaaaagtgtcccaagatgaaatgactgctgttgaatgggaaaccatcagagaggcagtgacgagagtgttatctcgacaactgaagcagctgaaatgagacacgttgccggaaaagccattacagactaaataccccctggtcctaaagagatagatgcacatcaacttaaggagaattgcagagcaggcacaccactagaacacggggcagtgagtcaggagtagggtctttatctcaatgccattaggtgtagtcttgctcaacctaatttatttctgcggcttggattgctttctgactattctgcttcagtggaatgtcgttgtgaccaattttgttgctactaaaatacttaagtaacaaaatccacttcttgataaagatttaatgtcatctaatccctaagagttaaggacattacaaagattatcagtgaatcaatgaatattggtagtcatcatcaaaaaacaataggttgagagtttcagtaaaactaatgaaaaccatatataagaacattataaatatgattacaatagatgcatctcttttagaaacaaggtaataaacactgtgcttccaagatgtatttaagaatgttgaaggaagtgaggcacactgacttgtgcctataatccccctgggaggctgaggtgggagggttacctgaggccaggagttagagatcagcctgggcaacaaagagagaccatatctttaaaagaattttgttttagttagccaggtgaagtggcacccacctgtaatcccagctattcaggaggattgcttgaacctaggggttcaagcctgggtgacagagaaataccgcatctctaaaaacaattttaaatttaaaaatagaaaaaagcatgctacactgggccccaagatctatgcttgcctccaatttttccccaatttttatgatttccctttgtgtaatgtgatatttgatgcataaaagaatatatgtaatggatatgtaaattacaaagctcaataataaaacaaacatatgtccatcccaataactgaaatattagcaacaactcacacctgaacctatgtgctcctacactagttcttcactcttttgtacccctccctccatttacccaggattaactaccatccagaatctggggattgtcatatcattgcctttgatttcttttgtttgctcatttgttttgtgttggttttttcgatttatcacacatgcatgtatgccaaaacaatattttcattaggtgttcctatgcttgagctttctggagtgttgtctaatacaagggtcagcacactaccgcccatgggctccccggctctggagtgagtgcacttccccaggctggagcgcagtggcgcgatctcggctcactgcaagctccgcctcccgggttcacgccattctcctgcctcagcctcccgagtagctgggactacaggcgcccgccaccacgccccgctaatttcttgtatttttagtagagacggggtttcaccgtgttagccaggatggtctcgatctgctgacctcatgatccgcccatctcggcctcccaaagtgctgggattacaggcgtgagccaccgcgcccggcctccctgacagtttttaaaaatgaagttttattagactcactcacacctattcactcatataataactatggctgctttgatgccacaacaacatagttaggtatttgcaatatgacctagaagcctgaaatatgtactatctggccctttaagaaaatgtttgtggacctctacattatgtttttatgattttctcatattcttacatgtgatcatagttaattatttatactgctatataatattccatggtatgaccataatacaattatttgctattatgaacactgtagctacgaatgtccttccctccctctctggcactggagacactcagtgtaaattgatttcctaaattaattctttaatcctttttgcgctgaatatagaagtcacaaagtcacacaaacattaaagaatatttggaaataagagtagagtacagaaaatgcaaggaaaaaaaaacaattctatctctcccccttagacaaccggtaatactaatgttatgcctttttcctcttgctgtgaaactccttatccattaacagctaaggaaggatcactgtcgcctcaccttcctttttcatcctgcctattatgaataatccataaatctcattttaatgatttcactagaaagcattaaatgtaaataatccgtgggggtggacataggaggtaatattagacgagcaaaaggaagaggcaagatttaaaagaccttattaagcttttaaaatgttttagcacatgtattctgttcttaatatttcacacacacaaaaaaaactgtctagaaaccacaggtgatttcataactttacttgtatctcttttttttttttctggagacggagttttgctcttgttgcccaggctggagtgcaatggcgccatctcagctcaccacaacctccgcctcctgggttcaagagattctcctgcctcagactccggagtagctggggttacaggcatgcaccaccacgcctggctaattttgtatttttagtagagatgggctttttccactttggtcaggctggtctcgaactcctgacctcaggtgatctgcctgcctcggcctcccaaagtgttgggatttacaggcgtgagccaccgcgcccagcttacttgtatctcttaatcccatcataaaggggcatatcctattactttaaaagccaacaattccctctcattttcattcaccatgagttactactactcctgaaaccttcacaaagtttcccagaaacaggacagcccactcctagcccatgggcctcttcccttcctcatttcttacccttttcttcctccctgctttttttcttgaaataaaatttccccaaaagctagtctgccactgcaagcacatcctcagataactggataaaggaagataatgtggcacagaggagtctggggatacttctagccaaatagtttttgtgccataataatctttatgacagtaggatcctgaaatgttacctagaacacttgtgcctagtcccaatttctggtgggataaaactgtatataagggaatcattacaggtgcttgcgtctgagacacttctggctatgattgagtctcctacacattatcaaaaaacgtgtaatgctttaataacaaaagtaaatgaaaatcctcaaaggagttaatatgctaatgtacatagtcactttataagagggtagtgtaagcaaattatcccacattaactcaatcagagtcccggtagaaactggaggattgatttctcaatctcggggtatgtgaggccagtttgctaaaggggttatcaacagagatatgctcagtgttaggaaattcaagaagggatgacggagagttaactgtagacctcaagggttaagaggaaggacgtttcctgaactagagagccagacccaatagaaatgcaagagagaactgtccagcagaagctctggtctaatgttagctgttcagagctaacctgtggaaatcccatggggccacatgaaaataaatactccacccttttcttatccactgtactcctcctgctgcagcctgtctcaactggaaactgtagggcaaaggaactctgatgccattcctaaagggcagtccccaggacacaaagcacagtggtaaagaatgaaaaatggatttgaaaggacaagagggaaagaatttatgcactaagcataacttttccctttcaagttaatctagtatgttgagttggtttgctctttaactaaacccccctgtttccaaagcctgaggataacatactacctactgagttggtaaacaaccttaaggcagcagtcctggagcctagacagagacattggatgagtagacgaatggaggtacacgaggtatacatggatggatgcatggatggataggtgaatggatggatgaagtcaatcacattagtattttacagacacacgttacacaacctgtatctgaacacgatgagtctctcttcctcctttgattatggaagttaagagcaagcactgaggtaaccaatattatatagatttctggagtaaaacaggtactcatcatgactatcaacgatttgaatttggggatgatgtcaattattcaaagaacctgaaaaaagtagtgaagttgcttatctgaggccccagaacttccttcattttactctggctttcaacgttggatacacattaaaattatctaggaaacttttcaaactgagatgctcggattacagaccacttaagtcagactctgtggaaatagaacgcagatatcactgtttgtaaacactccaccaatgtgtagcaaaatgcgaaaactactgatctttccactctctttaagatctaccattatgagccccaaaatcattctggttctcttggtaatttacattttttaaaggaaactctaagatgccttgctgataatattatatatgaaaagggttatcgaatttatcgggtttggggttgggggaaataatacttatcaaaggagtaaaaatatgagcagttcataaaataacctgtgatagtccagattacttgcatattttcccttgcatttcagagtccttatcagtattcaaaggactgtagagcttttagaaatgcttcagtgaggaacactttatactctgtccctgataaatgaaagtgtttatttcctctcagataagtcagtaacaagcaagtattttctagcaactggactatacccacctattcatttcccaaggctcattgggcatcactaggaatacaacaggttttagttactaccaaccccagttactgtagaattaggcaattatataagagtttaaaaaatcagtaaggatgtttttattttaaactacttggataattgaaaagtaggtagacaacatttattttttgtctttatttgccaaacgactgtattagatttaaaaccagaaaacaagcccctatgtagaatatagattctcaccagttcatagatcaagtaataagacatttcctagggtgtttaattgtttgatactaagagcaataaattataggaaaataatttgtaataattggttaagtaattaaccacaattaagaaaagatgatggaatccctgaggatatccgacaatactgacaacattataaactttaagagaaaaaaaatagttgttgcagagcaagaaaagtcatcatgtgcctagcacaaatagaggtctaattataggggattttacgtttttcataatgtctacaatgagcatatactacatttataatcacgaacagtccattagcaggtatcatatatctgagttgggaaataccctgtcacttcgctaatacttctttctttttgttctaatagtgtattcaccaaataatcttctaaatatatatgtgtatatatatatatttgagatatatatgtatatatatttgagatatatatgtatatatatgtgtatatacgtgtatatatatatttgagatatatatatgcaggaagaagtgagtgacattctaagaaacactaatgaccaaaaaaccacataatatcttttcttagtggtgttccttccttatattggccaaccaccttgcaataaaaaatgatgatgtagacagaaaggaaaagttagagctacctattctttttcctttccttttagtccctccttacacgtcagtaagccaaagggcatcttcttgataaactgtacatttatgaagaaaggaaataaaaaccattaagttcattttatgcagcatttccactattctggtaagtaaagaaagcatgtgtgtggatgatgtatgaaatacaaattgtgtaatttctatgactctccatataagttaaatattctcatatatccatctaaaaatagcactgacttcagtaaagtttcaggaaacaaaatcaatatacaaaaatcagtaacatttctacataccagtaattttcaagctaagcaccaaatcaagtatgcaatcccatttataatagccataaaaaataaaagaggtgaatgatctctatgagaagacttacagaacactactaaaataaatcacagatgacacaaacaaatagaaaaactttccatactcatggattagaagaatcaatatcattaaaatggccatactacccaaagcaatctacgaattaaatgttattcctatcaaaccactaacatcatttttcacagaactggaaaaaagctatactaaaattcatatagaaccaaaaaggagcccaaaagtaatcctaaggaaaaagaacaaagccagaggcagcacattacccaacttcaaactatactataaggctacagcaaccgaatcagcatggtataacgtttcagttacatacaatgaataagttctggagatctaatgcacagcatagggactatagtcagtaatactgtattgtatacttgaaatttgctgagagtaaattgtaagttttcttaccacagacacaaaataactatgtgaagagatggatatgttaattagcttaactgtagtaatcagttcactgcgtatatgcacatcaaaacatcccattatacatcttaaatataggcaatttttataacatttaaataagagcaaaaacaaaaacaaaaacagcatggtactggcacaaaaacagacacataaaccaatggaacaaagtagagaacccagaaataaagccacacacctgcagccatatgattttcaacaaagttgacaaaaataagcaatgggaaaggactccctgttcaataaatggactggctagccatatgtggaagaatgaaactggatccctaattttcgacatgtataaaaattaacccaagatgattaaagatttaaatgtaagacctcaaactagaagaattgtagaagaaaacctaagaaacatcattctggacattggggttaggaaagcatttatgactaaatcctcaaaagcaattggagcaaaaccaaaaaattgacaagcgagacctaattaaactaaaaagcttctgcacagcaaaagaaactatcaacagagtaacagacaacctacggaacaggagaaaatcattacaaactacatatcacacaaaggttcaatatctagaatttacaaggaacttaaaaaactgaacaagcaaaatacaacgccatcaaaaaacaggcaaagggcatgaacagacacctctcaaaagaagacatacaagtagcctacaagcatatgaaaaaatgctgaataacattaattgtcagagaaatgcaaatcaaaaccacaatgagataccatcgcacaccagtcagaaaggccattattaaaaactcaaaaaacaacaaatgctggtgaagccgcagagaaaagggaatgcttatacactgttggtgggaatgtaaattagttcagccactgtggaaggcagtttggagatttcccaaagaatttaagacagaactaccattcaatccagcaatcccattactgaatatatatccaaaataaataaaattgttttaacataaagacacatgcattcacgtgttcatcacagcactattcacaatagcaaagacatggaattaacctagatacacatcattggtggactggataaagaaaatctaaatataccccatggaatactatgcagccataaaacagaatgaaatcatgtccttcgtagcaacacagatgcagctgtgatggaggccattatcctaggcgaattcatgcagcaacggaacgccaaataccacatgttctcacttgtaagtgggagctatatattgggtactcatggacataaaggtgaaaacgatagacactagggattactagaaggggaaggagggagggggataagggttgaaaaactgactattgggtactatactcagtacctgggtgacaggatcattcgtaccccaaacccctggaattcacttgcatgctccctcccataaggagttgaaaactggtctaggtaaatgaggcaaccctgtcacgagtcccgggaaggggtcagggaaataggctgcttcgatatcatacaactctctttttaaaaggtccttccaatatttcttccaacttgaagtccagctttacaacaagtttctggactctcttctttcctactctgcaggttatcagaaaataaaacaaacaaaaccgcaaactacaaaataacaaaaacacccaagcaatgtgattagttaagacattattaaagtgtgggtgtttccagagacgtttcccctttacaaaccatcctattctcttaccttttgagaagggagtgtgtgcgtgtctacgtgtacataagagagacagagaaagtgaaagagagggagatttggtagataaagactcaatagacttaggaatttcctatgtcgttatttgaatttgagagattactgagtgtaagaaaagataatccattttggctggagcagtggctcatgcctgtaatcccagcaatttgggaggccgaggcgggtggatcacctgaggtcaggagtttgagaccagcctggccaacatggtgaaaccccatctctactaaaaatacaaaaattagccaggtgtggcggtgtgtgcctataatcccagctagttgggaggctgaggcagaagaatcgcttcaatccaggaggcagaggctgcagtgagccgagatggcaccactgcactccagcctgggtgacagagtgagactctgtctcaaaaaacaaaaaaagaaaaaaaaagagaatccattttaacttgaatcttgaaattttctgtaaagtagcagaggtaaattgccatggaaatcataggaaaggaaatataagcccaacacggtaatagactctgcaatgaaatatatttatggtgctataataatagtgtacatactgtttatatgttttcaatttttagaataaatctttgacaaaacacgagacctaatcatagttagagaacacagaaggaatgcaactcaacataaaattaaaagtagactttacagaatttgggagaagaaattcagtaggagaagtgaagaaacatggaggaccactaaaatccccattttatcatgtgaagggttaagacatacttttgacactgttttgaagaaaaaaattaacatttaaggtcttcatgtaaaagaaaaattagttaatagaacaaatacatggggtagatataaatgagataatttttcatctctcataagagagactgtagaccatgaaaaaatgagaaaatcaagaattagagatataaacatgttattacagatttgtcacgcattagaaaaagagaatgactcaaatatctgcctctgaggagtgagaaatgagagaggaatgcagcatatttaaataaaagaacttatgaagtaaaaattacttgaatcatgtacagataatttgattaaaaattgaaaacattgattcaaacaaatttatattcattaataagcattgtacactttttaaaattccaataagaaaaaatgagagacttaaaattaggtaggaatgcatttcccagaggttaaaaatttatattttaatatatatgcatatataagcgggatcataatacagcattatatgtatacatactgtgtattacagtctgctttattttttcatgtatgtatttggattacctttaatatcaatgcaatcacctgtaaaattttattttaaatttcccttctttagagatatatcattttttagtagcctcctactgatgaatactggtgttgtttccatttttcactgtaataacaattaaacaataaatataggtacaactcagtctttgcacatagatgtaagcatttcttcgataatttccctggaaatgcaattgcttagtcaagtgtaagcacgctttctcttgattggtattgcaaactgctctcatgaaataaattgattcagtcttctgtcagaagcatacaaagtatacaaggaaaagttatttttattttcattatttggttacaaatgagatcgaacattttttcatatacctttggatgtgttttattttctttttgtccaaatatatggggtacatgtgtaattttgttacatgcatagattgtgtagtggtcaagttagggcttttagagcgtccctcacccaaatatatcatacacattaatttctcattatccactccactccaaccccctcaccctactaagtttccattgtctatcattccactctctgtgtacatgtgtacacattttttagcacacaattatgggtgaacatgcaatatttgactttctgtgtctggttcatttcacttaaaataatgacctccaggtctaacactttcttcctgtatgcttaaaattaggcaatgcatttatttttctgaattgatttgtaagattcaatttcagtttactggtttttaatgtacagattttaaaaattatctatgtgttttccattttaaattttgggtttttaaaatcatttctacatagttctctaccatcgcctcattgtagaaatattcacctatcgttcttcctgttctttgggcttcttaagcttaattatgattgaatatttgttcaaggtgaaatttaattcactgcattgtgtaaagcagggttttgccttttaacatgattatcaaaaccatttctttcatagtccatctctatccactgatttgaaattccatttttattatatacacttgagcatattttgggattttctcttttgtttcactaatctgtttgtatagacttttagtagattttttttttttttttatacagagtcttgctctgttgcccaggctggagtgcagtggcgaaatctcagctcactgcaacctctgcctccctggatcaagcgattctcctgccgcagcctcccgagtagctgggattacaggcgcctgccatcatgcccggctaatttttgtatttttaagtagaggctgggtttcacgatgttggttaggctggtctcgaactcctgacctcaggtgatccacccgcctcggcctcgcaaagtgctgggattacaggcgtgagacaccgcacccagccagtagaagttttattaaacactctaatagctacatgggcaaatgacctttcatttaaggttttcaacattttctattaatcctcatctatattgctgccagataaactttagagtaattcttgtcacatccaatgtcttcctgccaccccaatttaaattttatgtgtttctatcagattttagcttaatttgtagtaaattatatgtctaaaatattaatattcccaccaagaaatataaaattatatctgtccatggatgcaaatattctgttatttttccagtaaaggcttgtatatcaccaaatttcatgctaaataaattcacagtaatttcacattttgaacttctgtggaaaatgatagctttgattttcaataggttgttaaaagagaaattagcatttagaaaaattacatttaattaatatttaattatttctaggttttttcttttcttaatgagctttgggactaatttttcccattagttataatagttgtcattgttgatttacttagtaccaagttgacaatatcatctattaatatgaataatttgacttttttccccaatacttatacttcctgtttcttttacttggcttctttcactgactagaatatgcaaaatagcatttaaaaagagcagttttggtagtcattctagttatatttctaattttaatgaggataccttcaatatttcaacattgatcacagagttggctcttgttttgagatagacaatatttttcatgcttataaactatcatctattcttacattgctaaaagttttgtttctactcctaaattagggacagattcttttcatttatcaatactttttcataactaaaaagtattgtatattttttccttctgatctttacctacaatgaaggatgtaaatagattctcttatagtaggcatatatgttttcctgaaataaatccaatttggcatgataacttcttctcttattggctaaatctgctatgttttataagatttgaacgtctgtattcctgagattggttgatagttttcaatgtgtatgctatttttttgaagtctcataatcaagattataagggctttagaacatgaacatagaggtttaaatactattttcatggtttggaattttgtaaacagataattcatacttagttgtttgaaagcatttctcaatatagtatttttgaagttatttcttgtactgctttttaaaggtttcttacagaatcaaatgtttagttctcttattttccctttaatctcaaatataaaaaaattaaggctattaattttctttgattacagctttgttcttattccagaagttttcatgtgtattttccttattcattaatttttaaatggcctactttttttttggttcaaggaaagaacactactttttctctcctgttacaaaaacaatgtatgtttaccataaaaagatacaacaataactattaagaaaagtacagataactcattttttcattaagcagcaccactgctaacatcctgttgtctactctgagtgtttttctgtatatctgtctataaaaatctaacgtaaattcaatgtccgattcctgtattatctaaaaattatatcatatgatctactaatcatcttttcctatttgttttaaattgcttgctggttttgttacattacatttttttctagacattttataacaaaacagatatatcaaattaatcatattcaatgatgtgttgttgcaaacatatgtttatgaagtccctgcttcgttgacattttttttcttgttcatatggctggattttctttgaatttacgggcttttgtatgggagctgctatattgtttacaagttcaatggcttgcaacctttcctgtgcattatagtcacctggggagcttttaaacagcccagtgactaggttgccacctaaaccaattaaattagaaacttcccaggtgggacctaggcatctgtaagttttaaagactctcgtgatgttctaaatatcagcaaaggcagaggaccattgagcttgttagaatatttgggaaagggtgtttctaagattaaaacttaaggcttatgtatttcgtaaacgcagctgctttaacaaattagtaaacaagctaatcctagtatctctaaaaaacactagtttaattttgcctggagctgcagttctcaatatattgtccagcatatcctccatgcagggaaaccactgtatacaccaatacttatgagggaggatgatttttcaactgcaaatctttaattgccttttagaaaatccatccagttttccttaagcaagttttagaaagcacatacacgagcaattacaaatctggccttcagcctaactcaagaattaaaaaaataaaatctcaaagtgaagttgtattaattctttttttctccttacttttatttcataaaaatagacatctttatcataaaactggcttcttgacatcatttggggccactttccctctgaaagacaattctaattgcatttacttgttctcagaatcatacatttttttaaaaatgaaaatagtttgtacacgagttgccaaagaatggtctaattcagtgtcaggacaaagatggtctaattttgcattatttagtcatctaattaaaaacaaaactagtaataatttagccataaagctgttcattgaagaataaaagcaattgttaattaacttttcattgaggaaagtcatacatttttcatgttatcataacatttcaaaatgccctgggaaattacaaaattaaggtaatgtaaattattgatatattataactctaacaatgaaacattttacccaggcctctaatgaggattctcagttaaggggaggagcagaggaatgcataaacacatgggaggtggggtggagcggaaacccagcttccaggaagatgttttaggagaaaacagattcctaagctatttgaggtacaacagaccgaaggcaatgtgcagtgcaatttatttccctaaacttatctgttataaaactgaatccttaagctggttgtacaaagtcacacaactagtcagttaatgttctacaaatagctctttcagagatttttctactagacttgtcaccttatttaaaccttgaaaccccactcaaaattgacagtgagagaaacagacacacacacacacacacacacacacacacacacaccagggacggagggagagaaagtgtattaatagctaaaacccctcttggccttgggaaagaaactctctaccctctgttaataagaagtgagagagctgcctcctctttgaataaatcaggttctttagacaatgtagagttaagggctttactcatcaccctgttctctggatgccatgtaagctcaccagattcttgtgaaactacagagaatggattagacagtccaaaacataacagattgtacttgtgtttgctctggtaagtggagctttagtttgatgtagagaaataagaggaaccggcatttctttcacctggacattatgaaagagaggtatctgaatcatccaattaagtgagcaggaaatctggaatattgtaggtgttttacatgctcattctttctttctacctgcttaattgtatctgtgctatttctgttaaatgcatctgcggtgaactttgcagttgctaaggagagcgtttgccaattccatatgcctagtctaaggtaggctgaagctaatctgtcattctggagaagcaagagaagctaaggttttcataatatttagttgataagggatgagaactttagatacatgttatctcttactttgctatttttccaaaaatgtatttgaaacactgttaagcagagcaataatatttatgcagcattttacatttttaaagtcctttaaatattacatcatgcatcaaaaattatcgataccaagatgtgattgtctcaattttagagacgataaaattaaaaataagaggttctcaaaatgtcattattttataataactgaacaaaagttttacctcaacatttaacatcaaaaacattttcatttttattagatcatgatgttctgtttgctcgtcacataaaatattttaaagagatgtttggggtttaaacagattaagtatttctatagtgccttgaattaacaaataaaagtaaataatactaaaactacacccatctattgtcttgctatgaaacctagaggtaaagtgtatgtgaagtaaaacagtatttttgaagttgtaatgtcttaccattgcttcaattaaatcgttacatacacacacacacacacacacacacacacacacacacacacgcacacataatatattagatgatagatagattagataggtaggtaggtaggtagatagatagatagatagatagatagatagatagatagatagatagatagacagacagacagacagacagacagataggcatttgtgatccccactgaaaaaaactggcaagcttgcctaaaagtgaggagaattattaagaaatagtaaactacccaaggacattctgttcttttccttacacataaatatgaacgatggtgctcccctttggttccaactttctgtgtttcatcccctatcatgccaccattgtgttagtgtttcccatttctcctttacattcaaagtgttgcctgtcccatttaatattttaatctgaagaaatccttgggatgggaaacacaatggtaaagaatgaagaatcgctttttaaaaatactgatgattacaatgtattcttaacaagctttggatgaatttgtattagtcgcccaaacagttctaaaaaaaatcagcataacagcaaatttgacaacaatcaaaaactcatcctttctgaatatgtccctgaaagaaaagctcagcactgtatgcaactccatcatatggagcccagaacatctctttgtggatatgtgactaaaggcaaaataaacatccagtgtaaaggtgcagaggcaaaaaaaaaaaaaaaaatagagtggtctattggaggaaatacagatggactggtattgctagtagaacggtggtgaatgaagctagaactatagccatgaactagatttttagaaaccagtatcctatacttgggggttagatttcattatgtagacagtagttgtggcaacctatgggattaagtagggtccaaaaacaaatatgtagtagtagtagtagtagcagcagcagcagtagtaacagcaatgacaacatctaggatctattgagcacttaaaacaggccaaatactgttttaagctctttacttgtatcagctatttaattctcatagaaataagtatcattttatcatcattttacaggtgagtgatgaagtatcttgctacacattatggaggtagtaagtagcaaagctggaattcaaacagaaaccagtgtgcctttacactgcaccaccctgtatgcttagggagatcactctgttggcacattgcagggggagaaggacattggagactgtattcaccacggccatatattgtgtgatggtatatttcttggaaagcacaattcgggaacaccatagcagagaaggcaaatattatcagccttctttacaggttagaacatagactcagagtgtttaaattaattggccttacccttctgaatcttcatacactgcactttctacccatcagaattacttattcctatttcctaagatcagtcattccagaaaaaatgaactttcttctttttatgaattcagaaggaccggagacaggtaggcaagacgcatgaacacaaaagtgtcttaaaatctcagagatacattcatttgtgcactttcacttattcattcattcagtaatcatttatagagtcttttatgaaccatgtgctataagctaggtcccgggagtaaaaggcgggagtaagctgacaattaagttttcttttgtccattgaattttgtccaattcgcaggtggtacttggttggttgaacctcctaaagttaccttctagctcatgcccccaactatttgccactttacaaaaacgtcacacacaccataaactgagaaaatcatcagtccagggaggctcattccttctgcgatgaagaattcctatattgtcgcaatattcagctgacaagccatggggtaaaactactgtgagcatttcaacttctgattataccccaccattttttctgatggaatacagagagtggccaaaccagcagccttccttcaggccacatttccccagcccagaagttcctaaaatcttgtggaggcgattcagctttatatttgacagttatttatatttctggccctacagactctgtccgagcaaaagcttttctagacatataattttaaggggaaaatatcaatatttgaagaaaacaagtgtgctggaatgtccctctaccttatgattcatttgttattcctagggtgttctgcagcaggttaagtgggctattgaacaaagaaaaccccaggaattctgacatattctattaccttaaactgatcgaaaatcagcttttcttctgttgagatgaattacttgacagtcagtagaaaaattcttcccatgggtttctcctttctgaaacctttcccacccccagtcctcagaaatatactttggtgagtttcctctatcccaaagcattattcatataatccaagaaaaactgaaagagacttgaggactaatttgcaatgatctgaggtacctgaaatattttattcattttatttttatatttctttgaaataaatacacttactatcctaagggtaactctgatattaaaaagactcacatttattacatatataccagagcctatatccccaaatagaattatttatgagaaaccttaacgcaaataaagatactaagccctcggggcctcttgtgcttttatatttgacatctcctctttttaaatattcatgtagaatagccttaagtagaaacttgaagatgtgctagtataaaacattttcctgagccactttattgttgatggggtgttttctcaatctggatctcagtaagtctttcccttaaatgaaaaagggctatttctcaaaccatgtatgaatgccagcatttgttcagcttctttttttgtttgttttttttttttgagactcagtctcactctgtcgcccaggctggagtgcagtggcacaatcgcggttcactgcaacctctgcctcctgggttcaagcgattctcccgcctcagctccccgagtagctgggattacaagcatgtaccactgcacccggctaatttttgtatttttagtacagatgggatttcaccgcgttggtcaggctggtcttgaactcctgacctcatgatccgcccgcctctgcttcccaaagtgctgggattacaggcctgagccactgtgcccagccttgttcagctcctttagcttactttagagcagtcacaggttgccacttttccagcatcagggacaaagttcagatcaattttataacacgtcgattctaaaaatcacagtctcgtgggaggtggaatatctgtcacaactcataacatatttcctactgcttcatgttccatatattagaaacccattcaccactaatttccccaaatttacaagttaagagtttaaattatagttttataagtgaatttatctactttatttttcaggtcatggattctagctctcatatgaagtaaggtcttaatgctttttatttctttaccttatgttaaatttcagattgatgagctttctaataatattgaaagttcacattactaccttagtagagcttccaaattcaaattgaaatttcactgggctgggtgcggtggctcacacctgtaatcacagcattttggaaggccaagacgggcagatcacttgaggtcaggagttcaagaccagcctggccaacatggtgaagccccgtctctactaaaaatacaaaaaatagttgggtggcttggtgcatgcctgtaatcccagctactcgggaggctgaggcaggagaatcacttgaacccaggagatggaggttgtagtgagcagagatcgcgtcactgcactccagcctgggtgacagagcaagactccaccaaaaaaaaaaaaaaaaaagaagaagaaaagaaatttaagcgaagatgtgagtaactgtatcagaccagactcatttttatatgtaaaagatgaaatggcgttttctactcttaataaaggcaaagatgaactaatacataatgcaaaatgagcactggaagagatatacaagatgggtaagagcaaaactatcaatttttgtatttttcattcattcagcaaataattaccaagcaagtcatacatacgtaaaatagtctttatattttttgtcccatctctatgatagtgatgaaagtgaatgattctttaaaaaaatgataaatattaaatatcggctagatacaaaatattatcattggtgtatataaccagaatttaagttgaatcattggcatcaaagattttaaatagttcggaaaattaaaaaatacattgctagtccccacttacaaggagcttgagaagagaaaataaaaataccaacaaatcaatacagaaatattcactatagatcatgaaactcaatgacctgtaataaagtttaagaaaaacaattttatattgccttgatagaatagcccaaatcatcaaagcagatggaattttcaaagacagtatgctatcatgagaaagacatgtgcggaaactaggaagaagcttgtattctgaatgtgttaccaagaggttacaatgaatgtaataaaacatctttttgtggtaagaaatatggaaagacagtagctgttctactgcattaatctccttccaggttaacaggtgcagcagcagttggcttcagaaactcttgttaatgcgttcctcagactgtcccatctgcttcttattgtttgctccatacaaaggcatgttaatatgtctacctacatatcatcattgtttcattttattatttgctaactgaactgtgccaacatgatagaaaagaatcaagcttactataattttaagatactaagacacttactagtaaaaacaatgtttatcgaatttaagacctttgtggactcataacagagaactagttctgtgcaacaggttcctttcacctcaagccattcaatcaacattttaaaaattccaatacgattgctccaaggacctatgagagatactttggattcaaggacctcagagtcgagtggaaactctttctttaaatagaatgtgacccagaagcccaatatgaaacagatgaagagtgagctattcagctaaaggaatgctgatggtggtagtggtggtggtgggcatccactgtcttctcaccctacacatggcccttgaaacactactaaaacccactaaggctccagtgagactattgtaaaattcccatatattctccagttcctagtttgtccaccaaacctatccacagcttttctttgtttttaacttttaagttcaggggtacatgtgcatgtgtgttatataggtaaacttatgtcatggggatttgttgtacagattattttgtcatccagatataagcctactaaccatcagttatttttttttaatcctctccctcctcccaccctccaccctccaacaggtcccaatgtatgttattcccctctaagtgtccatgtgttttcatcatttagctcccacctgcaagtgagaagacacagtatttgattttctgttactgtattagtttgctaaggataatggcctccaactccatccatgttcctgcaaagtacatggtctcattctttcttatggctacgcagtataccatggtgtatatgtaccacatttgctttatccagtctatcattggtgggcatttaggttgattccacgtctttgctattgtgaatagtgctgcaatgaacatacgtgtgcatgtgcctttgtaatagaacgatttatattcctttgggtataaatgcagtaatgatattgctgggttgatggtatttctgtctgtaggtctttgaggaattgccacactgtcttccacaatggttgaactaatgtacagtcccaccaacaatgtatacgtgctcctttttccccacaaccgtgctagcatctactattttttgactttttattaatagccgtcctgactggtgtgagatggtatttcattgtggttttgatttgcatttctctaatgattagtgatgttgagcttttttcatatgcttgttggccgcatgtatgtcttcttttgagaagtgtctgttcatgccctttgcccacttttttagtagggtttttttttctcatagatttgtttaagttccttataaatgctggattttagacctttgtcggatgcatagtttgcaaacattttcttccattctgtagtttgtctgctcactctgttgatagtttcctttgctgtgcagaaactatttagtttaattagatgccatttttcaatttttgcttttgttgcaattgcttttggcatctttgtcatgaaacctttgtctgttcctatgtcctaaatggtattgcccgggttgtcttccagggtttttatagtttgaggttttatatttaagtctttaatctatcttgagttaatctttgtacatggtgtaaggaaggggtccagtttctatcttctgcatgtggctagccagttatcccagcaccacttattgaataggtagtcctttccccattgcttgtttttgtcagctttgttgaagatcagatggttgctaggtgtgcagtcttatttcttggttctctgttttgttccattgatccatgtgtctgttcttgtaccagtatcatgctgttttggccactgtagccctgtagtatagtttgaagtcaggtaatgtgatgcatccagcttttctctttttgcttagtattgccttggctacttgggctcttttttttggttccatgtgaactttgaaatagtttcttctagttctctgaagaatctcaatggtagtttaataggaatagcattgactctaataaattgcttaggattgccttggctacttgggctcttttattggttccatatgaactttaaaatagtttcttctagttctctgaagaatctcaatggtagtttaataggaatagcattgaatctaataaattgcgttgagcagtgtggccattttaatgatattgattcttcctatccatgaacatggaatgtttttccatttgtttctgtcatctctgatttctttgaggagtgtttggtagttctccacgtagagatctttcacccctctagttagctgtattcctaggtattttattctttctatggcagttgtgaatgtgattgcattactgatttctccctgttgcactgcatgcaacagatgcaatggaacagatttctctctgttgttggtgtataggaatgctagtgattttggcacattggttttgtatcctgagactttgctgaagttgtttatcagcacaagaagcttttgggctgagaccatggggttttctagatatagcatcatgttgtctgcaaacagagatagtttgacttcctctcttcctagttggaggcgctttatttctttctcttgcctgatttccctggtcaggacttctaatactatgttaaataggaatggtaagagagggcatccttgtcttgtgctggttttccatgggaacacagcattccttaaatagacatgaagcccctgcccacaccccagtgaaaaacaactcactacttccagattaagctttttatatttttggccatctctcactgttacaaagtttgtttgtttaaatatttagtggacaaagggctctctttcctttcttctcatcataataagaatatgcttcattgcatttccactgattagctgaatatttgaaaacagctaatacgtccctaaaattataagttgctttctagacaggctccagtttttcagtgtctcatttaaattatgttccccagagctgaacagtacagatttggtctgatgaacttacttttagtgtcaacaaagagggtgttctgggcaccatttcaattactatacttatttgtttttcttgtatctctatcataatgttaaagtcatcgtaaactcttgtttttttatttaatacttttgggtggagagaggggaatgctaacttaagaaattatattttccctattcaattttattttgatgtattaagcaactatttcagtgcctaatatgtgccaggcatgtgataaacagcaggatgcaaagtatacatagtctacatctacatggtgtatacatatagtcaaagaaatattataacagttaacatgtattggtaacttaagacatatgtatagaggaatctgaggcttggtttgtggtcaagatggtatatatataatccttggtttgtttgcttcttgagacaaatctagaaacaactaggccaaagtaaacactatcaactattataatagtcatgactcctttgagtatttattctttcttctggaactctgacagatattgtgatttaagggcgtagggataggaaaggaaaaaaatgaaagcaaagagacagtgagaacactttttagagccagggcacagcctaagatgaagaacaaatgaaagatctacatcagcagccaaaggtaaaaataagcacttcagaaagaaaactgattttccacagaagaaaaaatatggcagacataatgtctgatggcataggctccagatggaataagaaatacacagctgcagagtaaggctatcttcagttaatcgagagaagcctgatcatcagaagcattagccaatgtctgtaaacatataataataaaataaatgcagaaatcactataaatctttgtgttaattttgttttataaaaataattcaagaactgttattttggaaccattatatgtatatagtaaggtaattaccatataagcaattatactaatgtcattagaaacatagattttcagcgtaagagagaagagactgcagttaaaatcaaatatgttcgttcctaattcttgatccaagtggtgatctgagtggtagctatctgtgtttatggtatatggttatgttatgcttcaataacaaagtgtattaaaaatagaagaaaatgcaataaaagttttaaaaagcaaagggcaagaataaagataaatcgtttcttcaataaacagtgcttatcaatcactattgcacattttatttcacttaatttctcagaaaaaccttatttctattgaaaatctctgtatcttcaggcactggaaagactcccaccaatttaactgtaactcggatgttgatttcctaacacaagttcctcccattatttaatttacctaaggactatcagttaccttaatggaaaacccttccacttattatatctctaagttatctaacaatcatgtctcttaagaaaatatatatttttatctcaagtaatctcaagttaagattactacctttaactaaaatgtttatccattcaattaaaatttattaaagtcagctttgcaaatggtatttcttatttttcttcttcctttcatatgtgtacaaaatattaattcaacccagaagtgtttttcctccctaccagaaaggtaatcttattggttaatttattacctcattcacttaacttctacatgttacccagataaactattgtaaccagaacttacattattacgattgcaatatacattattaccaacctgctatttaggagaaaaaacacttcttagatatcataaatgcagctttaacatgcagaactgctttaaaacaggcatacaggaattttttggggggggatgaggggtgtgttatttttaatatgtctaaaggtaatacatttaatgaactatacaatatttataataagttattacaaatatgttcattttatgaatttttattttttcttaattatgaagtttgtaagtatattaggaaggtaataacttcacagcaatgtggcagacacagttgaatgtaacgtactcattaattttcaaaacaatcctatgagatatatactcttaagattccttttgtaaatgaatagactgaggcacaaagaaggtaaataatttgcctgagagcattcagtgcgcaaagtacaaggcacctaatttgaatttggcttcagaatccaactcttaatagctacattctgatgaccctagatccagggactcttctcatccaattccggttttgttgtgttttatgtaaaacacaccactgtgggttatcagattccaattttgttcattgtcttgaggattttatcatttacctgtaaactaaactgaattctgccatctcacccattttgccactcttactaaatactcaattgtttagttttccttcaatatcgggctacatctctccaaattgatgtttataattttttgccttccctcttgacttgacatcactgagaattaaaatctgactgcccaaatccttactgggactcctacaacctactgattctactgggacaacctacaaggttgtcttgtagctgtctttctcccccaggatttgaaaaagccttgcacactgaagcccaagaacttgatataaacttcaaaagacttaccaccacaacaaatcacgtataggcaaccttcatgcctggagctcctgctacaagagccattcagaaagtccactggaactccagcatcatccgtgttctgttccaggaaataactatgactgtgaaattaatgtttatgccatcaccacattcaaaccataaaccagaaaatccatcagattaccactctaccatctgaagatgcttagaattcaatgtctagaaaacttcttaactgcctgccctctagactcaacaaataggatttatattcttctccaacaagtttttgtttttatgtttgtttccatagaggtgcctctcattaaatgcctgatcacgtgcatcatccagcaactatgctctactagcaagtctcaaccgatgatttagctagtccttagtaaacaaaaggcaatcgaatgacaaatggacttacactgttcagaaggatgaataatgtgtcttctttacttgaacaggagtgaggctccaccaagacgctccccttgaccaaactttagctaggctcctctgagccctcttctcagctaggccataaccttggcctgcacagacctgaacaaaaaacactaacatagcttctaacaggtcaaagccacctctctaggataactctagccccacttaaggtgcatttctgagaaaactcaaagctgccaaaataatttaccctttgttccagtcaaaacccgaagacagtgagaaggcaggagcctaaccttaagtgccatttagcaaacgtagaggtttcccagggaacaatcccacctttccactttttgtaatttgttacttccctgactttaatgagccaccactcaaactcattctctcattctccctttaaaactcccagtcacctctacacaaatcaaagttcagttcagttcatgctgaactcttctctattataatagtgtattactgattaaaatctccccttactaattaaactgacgtccacttttgcttatctttggataactggttatttagttggtttagtttcagtttgtgaatgtcatgtggtctcaaaaggtcacatcatatagataaaaccgtgcacgccaacatcaatgaacatgtgaagaaggtaaacatgattattttattgcaccatttgtaaaaaaaaaaaaaaaaaaaaaaggtcaatttaaacgaagtactgcatgattacattgaacgtatttacgtatttgttgaatagtatttttcccttgtaaaattgtatatgttaattatacaaatgttggaatctacagaccatggaagcataaaatatatattgcctcccattctgagaaaatcctattgaaagataagttatgtcatcacagtttttctgtttttgtttcgttttggtatggcttggtttctggcttttgttgttattattttgtctatataggcaagtattcatttatttcctgcattagtcaagggtctctaaggaaatatttgattttatcaacagctgaagtaggaaagagtgcctggaatataatatccacttagaagttttttatggtatggttgattcacccattctatttaacctcagcattcaattactctcactgctatttttttttaaacctgaatcatacattttacatttaatatacactcattgcaaatacatttaaaaattctaataaggcagagcctttagaagaatgcttgactcagaaactcaataaatctttgttaactattgaaggaaattttaattaaataattaatattcataatcccactcaacaaaattactgatttttattaatagttttttcaatcacctgtatattttaattagcatactgtaaagaaagtaatcatttttcctttttaaaataaaaaacactatgttatactgactttatcactgagataatctcaagcagttattatgagctgcttttgagctatttgaaggtacagttttactgctatgtaatttccaggcctatgtacatctaggcataagattttctcagctgttaaagctcgtctcgttgccatttgtcccctcttaatgatagcaagaactaagtcatcccagttttgcacatattatacttgcgttaagttctttttccagttataagaacacaactttaatttcttatggataatttcatctgaacaacacattttagaccgaaacttcagtttccttaataatttgtacttttgattgtgggaaaatgacaacagcatacaataatagaatattatacttttctagctggggaaggctgatgacacaaaagcataggactacaaaatggcaaaaaacatgattatagtgtatacatgagtttttttgcaaagatctgaatagagaaaagcagtaaaatagtcttcacaacatatattgaaaaatgctaaaaatacaataacttgcaccattgcagctagtactatattcacattataaaaggccatttaatgtatccaagacaacattggcagacacattaaggttatgcttttgagttctattgcttttctgtacttctgttttatttgatttgaaaatatgatttgttgttgtagatctatatgccctttcaccataaagagtgtgccctttgttttatattcgtgcttctataggtaaattttaataaaaataattttaatcagcattggttgagcatagggctttttatttctttaaactggcctgtttattactcaggtttgagtagcactacactataccaagcatgaagcaaaatgtcttaacactaggggaagctgagcttggttctttgtagaaaaactctatccaggagacatggggtagattaatacagacattcacacacacctccacacatatgggaaggttgaagaatttgtaacatcatcgttttattaaaacaaaatatgtctcaccacattgttgggtacatgttactgatctggcttaataatatataggatttaacttcctgtacttgatatgcttggaggcaatattactgcagtacaagccagggcatcagtttcactatgcttttgtcagcatagaaagtagcactagaggacaaaatgaatttgaaccaatgaagctttcatacaataccctgaagggtactagtgtaagacaggggcaagaaagaaacagtgatgatgtgagatgtgacccgataactgtccttcatggatctacacaacctctggaaatgccttctgcctgcaagaagcgtcaggagccctagaacatatgctaatatatataattaaggaggccaaagacaatcataccactctattcaacgaaatttatatattcacatacatacacacatatacacgcatgccacatatacagaaatttatgcatacatgtgtattgtagtttgagtttcataataaaactcaaaagtgaagacagttcacatgcacacgaattattagacacaaaaattggaaggaggtaaaggataataaagtgttataataacaggctgaaagaactatgattctgtcttctttatcccaaaatgaacttaataaattaatataacctcaattgcaagaggaagaacacgttgaggttgcatactaaggtgtattttatatctgatggttccatagctatgaaagtcttgatgatgccaatgctaggcatccaaatttgcagaagcaaaatctctggtcagattgaaaatgtgttacagtaaggaggaggtctaatctctcatcttttttctctgcataaattttgagtgtgctaaccacacaataagtaagttgtcaataactactgttttgattgattgtattaatccaaatattgaaatgagcatgtttgctgctttactgcttccttgttaacgcctagtaaatgttaattactaagtaaagtttctgaatgaataaataatccagagataaatgttatacccacacctcaggaatgcccactggtgatctacaagagaagttggggtcaaccaaagtgtataaaggtcatacagaaaggactcaggaggtcaatgtaaaggaggcttccatcgcataaagatgaaaaatatgaggacaataaagatcataatacagaaggtggagagcctcagttacatttaaatatatttaaattcatgcattcgcagtgatgccaaaacaaacaactggatgataataaataaataaaatattcactggtggtcgggtgcggtggctcacgcctgtaatcccagcactttgggaggctgaggtgggcagatcacgaggtcaagagatcgagaccgtcctggccaacatcatggtgaaaccccgtctctactaaaaatacaaaaattagctgggcgtggtggtgcgcgtctgtagtcccagctattcgggaggatgaggcaggagaatcccttgaacctgagaggtggaggttgcaagtgagccaagatcacgctgctgcactccagcctggtgacagagcaagactccatctcaaaaaaaaaaaaaaaaaaaattcactggcaacttttggaagagactagagaagcaattcattattttgaaaattgttcttttgggggaaaaactgaagcatttactctgctttgctttgtatcaattatactatgaggcaaccaaatagaaatgcagagttctctttataagccgggctcagtgactcacacctgtaatcccagcactttggaaagcaaaggtgggtggatcacctgaggtcaggagtttgagaccagcctggccaacatggcagaatcccatctctactaaaaatacaaaaattagccgggcgtggtggcgtgcgcctgtaatcccagctactagggaggctgaggcaggagaattgcttgaacctgggaggcagaggttgcagtgagccgagattatgccactgcactccagcctgggtgacagagcaagactctgtctcaaaaacaaaaaatcaaaacaaaacaaaaagttctctttatagaactgctcctcctaacaaatgaagaagtaaaaacagtatatcattgttttgcaactcataatgaaataatcaatcaaaacaatgatcatcaatggctgccaatatcaaacgttatataccttttgttgaaagtacacaacactttctatacaatcatcttgagtaaaaaaagaacaaaatcaaactgactacaagtagctctctagacttagctgctaatttgtcagcaccacaggagctggtgaaacacattaaacaatatcatgtggatgtaatcaacaaacctagacaaaaggtcctgtttcttcaaaaatgaaaagggagagtgagaacgaggatgagggaggaggaggatgtagggtgtggaggaaacagagacaacagagagaagagaggagtcctataggataatttgggaaatataaaatgtatttgatgatattaagcaaatattttccggggctgggtgcggtggctcacgcctgtaatctcagcactttgaggggccaaggtgggcggatcatttgaggtcaggagttcaagaccagcctgaccaacatggtgaaatcccatctgtactaaaaatacaaaaaaattatccgggtgtggtggcgcatgcctgtagtagcagctactcgggaggctgaggcaggagaatcatttgaacctgggaggcggaggttgcagtgagccaagatcgtgccactgcactccagcctgggtgacagagcgagactctgtctcaaaaaaaaaaaaaaaagaagtggggtgggggggttacttgggaatacagtctgaaatgtttagagtagaagtgatatactttcggggatttgcctcaaaacagagaataggaagtgggtaggtagagaggaaaccagatggtaatgataataatggttagagctaatgagcagtgtatggtatgcattatgttacttttttattttgtatatgtttgaaattcttcataagagaaaaaataaatggtccatgtgcacctgtaacataataatgacaagatatgtcagcctaagaataaatatgtcttaagttatcccctttacctcatcttggcttcaaagtaactatatgctttaatcattatagtttgtctaggtccccagagagtgtttttagatttttatttgttagtttatgaacttcagtcaagtaatcagaaagccaatataataaaatagtctttaactttctggaaaacatgcaagcataaataaccatcatttatacttctgtagcaacagtgacattgaatcatactcaaagcaaagtatctaagattcagagtaagtaggattctcacttgtccaatgcaaagattcagctacatctggtgggtaaaggagttaaatattaacttcatcttttagtatctatttagatctaatttgtatagggggttaaggatctcctgataaaaataaaattaataacttaaaactctccataattagacaacatattagctttcatgcccatcaaatatgaggagctgcaaaaagcacagtgtcaaggggtaagtctagtgttctcacgtaaaaatcatcttgcagatacagacaggataaactaaataataatgaggcctaagatttggagtggaggaggagtcccaagtacaccttgatggctgttacctgcacttacaaccaaaacagccattttcatgtcaaatgtgtgccctgggatacaagatctatgtatacattttaaagaattattttattacaagtcactctttggggtccagcaactctactatgcctcctttataacagagaacagattaaaacactgagaatgggaagtttccccttgctgcttcatggatgtaagttgagtagctgcgacttcatgcagactgaaagaaccaagcaaagcaccaaacagtggcattgaagaggttgactgacagtggtctagggcacagtttgagctgcagcacccgtggagggaaacctctgtctagattatcattagcgtagctgatagaggtgagaaaggttctgggagaagcatccaatcacagagctaagtcaagcatcagtccaaatttcagaatgtctgagtgataaacatcctgcagggacaatgatgcaaattggagtagaaaacactgaagagtggccaaggtcttgcaaatgcacatggagatgctaacaagctagcaaaatcctggtataaagccaacactacccatgattacacaggttcataatgccacaggcagtttaggttacaataaaattcatgaattcttcagtgcttggctgggcaggatatgtactgaacaaagcactcccgtaggtactgaaaggcagtgcctattcactaactggtgatgttattcatccgtttcctgaaccaggaacataggagcccctttgtctcctctttcatccctcccagccagtccattgctcaatgtctaaaattggattccccaagatcagacttaaatgacaaatttgagtccatgtagctgattatgatggagatcacagaaagcatcaacaggaagtgagaaacaggaagatctgtgatggagatcacagaaagcatcaacaggaagtagagaagtgagatagagaagaaaggaacacacagagtacattaatgagcaagttatgactatggatgactgggacttaatgccactggagacttctagcaaatgaaatagacatgcctcatgcatcctatttgagtgtaaaaagtttagagtttttatcatccaattctcatctattattaacctgaagaatgctgcttgggtcttcaatattccagcacttctagccttccccgcagtggcaaacccatcagagaaagtcttcaggtgcacgcaattagatgatgagacaaaatgggagcgctgaaagggtacggacagcgtccactagatttaaagagtaccctacatttatcttatagtgtagactatagctgttcttgcttttttgtaccaaatgactcatctttttttccttcctttagaaacaagattgaaaatgtaatctcggttgaacaggaagcatggagatagttcaactgaattggaagttgctggttgtagaatatttctatgcattcttcaagacagtgccatgtgaagcctcttctgacctgtccagttagcttttatttctctctcttttgtgacagcactgtactttgcacatcttattgtttcattcttcacacttttcagtattatacttatctatcttccagtaaattcttcttaacagactatcattttcttgagagcaagaattgggtcttcgttcatctttgtattttaggcatggagtatagtccccaagaaccagtaagtgttcatcaaatgttcatctgttgaatgaataaatgactgtgtgcattgctgctaatgatattcttcaccattttcttcagaatctgcttatgctggtcagattaaatggctttacttgagctgtttccaactttcaaacagattttttttttttttctgacagtgatttaacaccactgaaagttttcagttaccttccagttgttttaaaacatgaaatagctatttctggtgaaaggaaataaaggagaagagatagttctcacttcaatttgagttttgagaggatcgaattgcttcagcccaaggggtcaatactgacaggtcatccctagcagctggagagtatgtcaagataatactccaaaagatatttttatccttcatttgctacaaagataaataaatgcatatatacaaagtgaacaaaagctttgaaaatagtaaaatgttaacataggatagtatagtcactgttattgaatgaatgtttgtgtccacccaaaattcatatgttgaaatcctaactcccaaagtgatagtattaggagatgggtttggggctttttgggaggtgattaggtcacgaggatggagctctcattattggaattagttgcctcgtaaaagagaacctacaggccaggcgcggtggctcacacctgtaatcccagcactttgggaggccagggtgggtggatcacgaggtcaggagttcaagaccagcctggccaaaatggtgaaaccccacctctactaaaaatacaaaaaattagccaggcgtggtggtgggtgcctataatcccagctacttgggaggctgaggcagagaattgcttgaaacccggaggcagaggttgcagtgagccaagatcgtgccactgccctccagcctgggagacagaatgagattctgtctcaaaaaaaaaaaaaaaaaaaaaaaaaaaaagaacctagaacgctccctttcccctccaccatgtgaggaatcatcaacaagatgaacgtcactgaggaagcgggctcacaagacacctaacatgctggtgacttttggactcaccagcctctagaactaggagcaacacatttctgctctttataaaccacccagaaatataatatctatatgtatatagccaccacccatatatgtacacacacacagtttatcaatttttgaagtgaaataacatataaattaacaaaaattctctcacgtgctaccacatacatagataaaatatgtatgtattttatacatacatatatgcatgtatacatacatatacataaaacatgtatgtaccacatacatagataaaatatgctaccacatacatagataaaatacttgcccagatacatagataaaaattcaagtaccatcaaagtctaccttcttcctatctataaagctataaaatgagtggtatgagactaaacagaaatgttctgtgctttttggcacaaacgcatatttgtttatttattatgtatgtatttatagtgttttcatacaaatagaacaatttgacatatatataataaactagaacacatatgcacatatgtatgtacatgtatgtatgcatacatatgcacatatatatgttctacttttgtgcaattaatactacataacgatcacatttcaacatctgtttatataaattcatctcttgtttaaaactgtagtataaagggcacaggcatggactaccaccaagctatgtccatttagattacctattttactattacctagctacaaagaaaacccatgtccatctaaacccttactcatgtgaaaacataaatgaagggcaaactccttgaagtagaattgctatgtaaatatgtaattatacttttaattttgaaagataatgccaaattaatctcaagagtctgggcttgtgttactccatagtcaatgatggcgatggtcctcaactcttgcctccaaaatgcattcattcttgaataactttgatcagatgagacacttatgatctcaatgctcattctcctactactctttggataaccttgtttgacatttttttttacagtgtgtaaagcaaagagaaactccaaactctttacaaatatgctttgctaaagaataagacctatttgatagcacaacagggtaagtatagtcaataataacttaattgtaaatttaaaaataactaaaagagtgtaattggattgcttgtaacatgaaggataaatgcttgaggggtgtatatcccattctccatgatgtgattatttcacattgcatgtctgtatcaaaacatctcatgtaccccataaatatatatatctattgtgtacccacaaaaataagatactaaaaatacaaaaattagctggacatggtggcgcacacctgtaatcctagctccccaggaggctgaggcaggagaatcgcttgaacccgggaggcggaggttgcagtgagccaagatggcgccactgcactccagcctgggtgacagagcgagactccatctcaaataatactgataatgataatgataatgataataaaaataataacgaaattcagtggattctgaataaggcacaataagaagaattttctttttctttatttagtcttaacactgaaaagtcttaatgaatgtgtatctaccatgtgaaattagacagaatttaacagtttaaaatattaatggaaatatttttcatttaatctatttgttctaaacaattgctaaaatattttggttacatctaacctcacaaaggcaaccattttctattacttttctatattcacttttttcctattatttactgggtttcttctgttattgttgttgttttttcctttttgagacagaggttcactcttgttgcccaggctggagtgcagtggcgcaatttcggctcatggcaacctctgcctcccgggttcaagtgattctcctgcctcagcctcctgagtagctgggattacagatgcctgccaccaggtcaggctaatttttgtatttttagtagagatggggtttcaccatgttggccaggctggtcttgaactcttgacttccagtcatccgcttgccttggcctcccaaagtgctgggattacaagcgtgagccaccgcactcagccagtttgttaggtttttattaggtgcaagattgtgctgtattttttaatcaataaaaacacaagcaagccacagctccaagaagtgtacaacaaatgatttgactggagaataatttttttaactaaatacttggtcacactatataagtggcatgtgaagaaaaaacagtcactttgggccgaaaatttcagggaaaaaaacccttatggagtaaaaataactttatagtttattgctgaatgatttacatttttattgatacagctaacttgtatatactcagtgttagttcttaatcatatttaatgcctgttacacatgccacattcctcatgaaactattcatgattcttctccccataccaataatttgtattattccattctcatataacatgttttcggtatgcttttaaattgacaatatattttaatttctcttataattttctatgttctatgttctatagtattaaaagattcatgacctagagacacacacatatatatatatgtgtgcacacatccatatatatttaactttatagaattcttgaatttgactgaatagaaagtggtggccaagaatattaaatctacctaaaattcacagaggtttgagattcacaaaaggtcacttgatttggcttacaggttcaggggagaaaagtaaatttcatggaagaaaatcataaatatttgcgagtagataaggtagcagatgtagacgttatctatagggaaatctgacagcaaaaggaatgagagctaggatgttacattcaggggcctgaattacagtttgctacagatacaatacatccgcacttagcaaaaattacatttataaccttggcttttaatcaaggtttaccataatgaaaagctgtgaagaacttgtatgactcgcttataatttttttggttttttttaagatagggtcttgctctgtagcccaggctggagtgcgatggtgcaatgatggctcactgcagccttgacctcccgggctcaagagatcctcctacctcagcctcccaagtagctgggaatacaggcatgcaccacgacgctctgttaatttttgtattttttttatagaggtgaggttttgccatgttaccctggcttgcctcaaactcctgagctcaagtgatctgcccaccttggcctcctaaagtgctgggattacaggcatgagccactgtgcccagcctaaaaaaattgttattgatgtcactaaaaactgctcaggaggaaaataagtaggtcttattgtgatgaaacaatattttattgaaaaaaattgatcaacattttttatttaaaaacaaaactggggctattttattcagtaatatgccagtattcacatagcaagagttttgagcataggctttggagcctgagcatctaggttcaaatcctgactttaacatttattagtgggacgatgggtaagttcattagcatctccgtactttagtttctttccatatgttaaatatggataataatggtgtctaattcataggattcttatgagaatttaatgcctgattataagtgaggttaggatggtaccttgacatagtagctgttttatcattgttctggattattatatttattatctatgcctattttatataccatacatgcctgtaaataaagtttgtctaggatgccatggaagaccagagttcaccacctttgtggagatttgataggattttcaccattagataataagagctatataatgtatgtttcctctttagtctgggctcccatgattcttggtgccaaacgttttggtttaaattcagtaactccaattgagccatatttctgtcaaattcttccaaatgtcaactatatgtggcttctagtcaatttgaccttgttttactgattctgatttagtggcaagatggtagatgaatgcaatggtttattctcgtgattttaaatttaatcatttgtaattatatacttttaagacgtaaagcttcacctgtcataaaacatgccctttatggcacaatggttttaaaatatggtcccaaaactcattggcaaatggaaaggtagggtctatgtcctttcctcttcaatctgggtgagtttgtaactacttcaacagatagaggatggcaagagtaatgttttgtgccctccatggcagggtcataaaagaccatatgactactaccttgtttgctagaacagcgtttgcttggaaccctgagttaccatagaaaatgtgtgagtatcgtaaagccaccatgctaggaagaagccaaacaacatagcaagttcacatgtaggccttcagaattccaccctccagccattgagtccaacttagctttcaagtcttgacagatgaggctatagatattgcagagcataaacagaacatccctgctgtgtcctatctgaatttattactcacagcatccacggcataataaagtaattgttttaaactgctaagtatcagggtgattttatacacagcaaaagtaagtgggataccctgccaatatgtctacatatttccaaacaactgaaaacatgcacaccccaaaatgttttcttaatgagaaaatacaactcacttttttatttctgtgccttgattaaaaaaaggcacgtccactaaaagaatgataatttttattctgattatgggataaagaaacatatggccatttgtgacatacaaaaagtctactggaagcaaaaagtgggaaaaaaaagccttacgaatacccgtaaactggtgataaatggacaaacaaaatttggtatatccatacaatgaaattttatttagcaaataaaaggaatgaaagactgatacattctacaatatgaatggaccttaaaaacattatgcaaaatgaaagattacagacactagaggccacatatagtatgattccatttatatgaaatgtccaaaataggcagatctatagagacacaacacagagtagcggttgccagaggctagagggagagaggaatggggagtgactgctaatgggcatacagtttcttttggggatgatgaaagtattctgcaactagatagtgatgatagttgcatagctctgtgaacatactgaaaaaacactgaattgtacacttctagagagtgaattttacagtatgtgaataatatcttaataaagctgctgtaacaaaatccccaggatatcccatttctaaataaacgtatttttcccttgaggtcttctgatgtttacacctctttttgttgtgctgtggctttttggaagcagatttctctgggtttgttcatttttgttttatttcagtattagaaccaaccctgcttatatatcctgtctttttttaaatttaaggcttaacaacaaacaaacagtagcaataatcccaattcccgagtgattcaacaagttttattgtgcagatggtaagaaactgtttccctcattgtttgctaccaggagaaaggctgtgaaatagttcttctgggtcaaaacatatggttcacaaaaatgacttcctttcatcttggtctcttcttgccttctgaaagaccaattcctcctaattttaagtttacttttggcaaaatggtctcatgtattaatgactttatttggttaacaaagtaacatgtttacaggcatgggagaggataaatgaagctagaaaaaggagtactgaaaatattaggttaatgtgttattgttttcaagagccatctataacatccttgaaacttacacaaccactgactaaacattttatttagaataatcaggaaccagtggaaaatctgcttatctagaccttgaagcatcattttttttttctgaaaatttcttcctgattacatccagtggcagatactgctatttgcttgtttgcttgcccaatatccaataaacccagcaaagaaatagttgtcttgatggactattaacagccaacccacagtaaaaacaaattctaaaaatttaaaaagcatagtaaccaaaaaatattcactccacattttgctttttaaactttaaaaaatgctttttttttttttttttttttttgaaaccctgaaaaagtagacagtaagccagctcctggaagaattggaaatcaactgcatgagggtctaggaagctgagaggctgaagcagtctcaggacaagtagatagggaggagtcctttttctctcaacaacaaaatcgtgattttgtttagaagtagcaaggtgtcaagcaagaacaaagagctctatttcaagcatctctggcacccagtcatggccttttggcatctgagaggacgacagctagggatttctgggatagttttgttttcctgatgtacatgctgcctcttccttcttcttgcttcctttttcatctttctgctctgaaatgtaagacttgaggctggagatgttgaaaccatcatcttgcaaccaagagttgacaagcatgagaatgatagtaaggtgtaaaagagcaagaagatcaaaggggcctgggattttcatgccatcacagggccagtttcttgctttagactccattccttcagattccatcatatgagaaagttaaaatcctctggttctagtttctgctacttcgatgcaaaaatgcaatccctggcctggcacggtggctcatgcttgtaatcctagcactttgggaggccgaggtaggtggatcatttgaggtcagaagtttgtgaccagtctggccaacatggtgaaaccccatctctactaaaaatacaaaaattagctgggtgtggtggcgcaagcctgtaatcccagctactcgggaggctgaggcaggagaatcgcttgaagctgggaggcggaggttgcagtgaattgagatcgcgcctctgcactccagctttggtaatagaacgagactcgtctcaaaaaaaaaaaaatacaaccctcacttgcagttcctctcaactgggcacaccaccataccctgggtacatttaagaaacgtgaaagcactgtgattgtccccataacggatggaaaggtgctctaaggacgccagacatccagtaacacgcaggaaagtccaggaaaatgagtaattgtttcatgtcctattcagcttttgaaaagtaggggacagcctgtttataagtatgtgaatatatagaacctagctcaattttacatataaatacaaagtctttatatgcactgcattttccaagaatgaaactatcccacaataaatcaaagggaaaatgtgcacttattttattcagaactttaccaaatgttattaatcatacagaaaaatcccattactttaaaatatgctgttcatggcattttaatcattcataccactcacctgcatacgtcagcatttcgagctgtctacttctgtggttttaggtacaggtactacatttatctagagcagtatgtacctttcttattttcatattgaataattaattattgatgataaatatatccattatttttaattcattattgtcctttgatttattttttacaaggtaattgttttagaattttatatatatatgtaagttacatttttggtaaattctctttgaggatagtaatgggagtattacaaaatatgtcttacaaaagagggtgttcagtcttacagggttaaaacctatacggtacatagaagaaaaaaagtttttaaaagaaacacggtagcctggcgtggtggctcacacctgtaatcccaacacattgggagtccaaggtggggcggatcgcttgaggtcaggagtttgagaccagcctggccaacgtggcaaaaccccatctccactgttacaataaaaatacaaaaattaaccgggcatggtggcacacccctatagtcccagctgctcaggaggttgagacaggagaatcgcttgaacccaggaggcggaggttgcattgagccgagatcatgccactgcactccagcctgagtgacagagcaagactccatctcacaaaaaagaaaaaaagaaataatgtatacatatttagaaaataagataatacacccaattgattaaattatgattttcatctgtaaatgttcctatgccttcagatgtttattttaggactgtggccgacttggttctaaagaagatggatcaccaggtcattacagggctttccttcacaattagaaactaaatataagactcaacccagagtaatttcagaaaaaaaataaaataccaatataaggtgtattgtcaaagataattgtgctcctgcagcttttctgtgtataatagactcttccttccttgtagcagcttgcctagattgtgaaaaacatggtgtttgacccttagaaaggtcaaagacttatataagatatatatgtatatatgagcatatgtatgtgtgatatatatatatatcacactgatatctatatatgtacatatatcagtgtgggaaggaaatggaggaatagaatgttaattggaacaagactagtagtagctgattagttcttcattccactaaacataacgatgggcaaatatctagctgctttaagtcttattttataaattgaatatcaaatactaaagaaaaaatacattttcacagccaggaaaaacatagaatttttttcaaatttcaaaatgccaagtaaaacttgagaggaaataccgagcaaataaggaactttgtcccaaggtatggaaacattgacaaaactattaccagttatagctgacctttactgggtaaaacctggataaacaggaaaaactttaagagaaaagtcttcttcagtgggtcaaatcccatggttttcatgaactgggcggactgctacagggcaggaagagtttactacacagagaaaagttgtgggaacacaattatctttgaagaactcttgggccagtgtaggccccgtggtgccagttccctgtgctaagaggcagccagggatatatacctcaccctttgctatatagctgccttgcttagaaacttcttctaagagaaatgccttatcttttcagatttatattaaatattttccaattctatttctgcctttatctcaggaaattccaagtgagtatgaagctcatgctccctccctaaaatagcaaaatagcaagctctttgcatggatttttaaaaatttatctttttttttgagacagggtctcactctctcacccagattggagtgcagtggtgcaatctcggctcgatgcaacctccgcctcccaggctcaagtgattcccccacctcagcctcctgagtagctgggattacaggcgtgcgccattacactgaactaatttttatatttttagtagagacgggtttcaccatgttggccaggttggtctccaactcctgacctcaaatgatccacctgtctgggcctcccaaagtgctgggattacaggcatgagacactgcgcccggccgtatgatctttttacaaggtttcaagtaacaattttatttcctttgcttcaaaatttccaactattgccattcaagtgctttccactgatagtctgcaaatacacaacccttgaagaactcattgtaactatggccaaaagagtcactgttttaaacacaatctcacataaagaagacttaaactaggtgtactagttgactccatctagaaaattatttctcctagacagaaatcttagattaggcaaatgtgactgagctaaacaaagtctttataatttacaagttcttagggatcaattcttaattttgtacaaaaccacaattaccaacatatgatctccaactctgacaatggggtcttatttttaatctccattataaattggcaacagaaatcttctcatctcatttcagtaaagttggctttgccaaaataaagaaactctctttgaacctgaatcagatgatggatgtacaagtcacttattttctgggcttagagttactctggagagtaaccaatgtttaatttatcaatgttcctagaaattaattagtttaacatgacctactgttgttaccaaagtgtttttcatactaggtaatacaaattgggcctgattatctaggcaattgtatttaattttctgttttggttcatggcaaccaaattggcacttataactttttcccttttgtccaaaattccattggaatgacggaaggtattcatgtgtttagaggaataaaattataatcaacctagaaaacaagaaagcaagcaagcaaaagaccaagatactggtgaaaatactgaaagatgtagatgggatctcactggtaaagaaaacaaagaagagtcaataaaaccacaaacaccaggagtaagaagaagcttcacacctttggttgacaaatagtgtacttcaattctgctggctgttgtaaaggagattacaggatacctggaagatatataatgggagaagtagtctcatatagaagctattgtgggtttgggtcctttagaaatttctctgaggaagaaacattaagttgtggcctaaaagatgaaaaaggaggctgatagtagtcctgtattttaaaagaaaatcagtatcaccgtaatttagggagggaggttggagagaagtggaaaatcagaaagagatagctgttaaaaggtagagccctataggttgtggcataaactttacagtaatggacagctattgaagagttataaacaacagtcaaataaatgttgtaaaaacatttattccatttgccatattgaaaatggggtacaggggccaggcgaggtggttcacgcctgtaatcccagcactttgggaggccgaggcgggcagatcacttgaggtcaggagtttgagaccagcctggccaacgtggtgaaactccgtctctactaaaaacagaaaaattaggctggtgtagtagcaggcgcctgtaatcccagctactcgggaggctgaggcgcgaggaatgcttgaacccaggaggcggaggttgcagtgaaccgagatcgcgccactgcaccactcctgcttgggcgacagagccagactctgtctcaaaaaaaaaaaaaaaaaaaaaaaaaggagtaaaatggagtacagggtattaggaagaatatataaagtacaataagatagacaaatgcaagttttatgcacaaatgaacatcgttagaactccgacacaatgtcttcttcccttcaaatgtcttcacttttccattcccactatcatccttcagcctagtctctaccaccagttttactgacgcgtcccccaaacggttccttcaccctcttctccaacctgctcccaagtatccttcatagtacaaggaaacaaattttccgaatcataatatttttcatttcatttttctgcttaaaaatttatcatgtcttcatattacttatagatggagtttgagaaaattattaaatctattccccacctaggttcgtaatcaattaagccgcacatataggagtcagacgaatagagatgaaaatatctcctttactaatgataaagctgttatcagcgaacatagcattaagtcttcttattatgtatgtttgctaataatttgcctagtgacatccattagtaagcattaaatggaagaagaagcattccctatataatttatatcatgggggcttaaccccaatttaaagagcatgaagccatacctactcaattcctcctccaaaaatcagggtagatggttcatttctgctttcttaattggagtacatggagggacagggaaaacgggcaatattattaccctagcgtagttctctccacaattggatatttgaaacaacaagcaaggagggtccaaagatttaattgcatatacattaacagtttttgtctcattttcaatattctttagagtttgcttattcaaacttcttgctaattatcatcacaagccgctatttctgtcattttccttgtgctgtccatattacttgcctcttcttttaactctagtaccaagattgactgatgataggccattcaatcttttccaaagccgaggttagcatgcttagctgaatgagttcgggcaaatttcaattttatgcggttcatagcaatagccatattaactagtatgtttatttgtctctaaataaggtttaggtattctgaaatgtctctctagcactggatttccagttaatgagcatctcactagaaatttatattgacaacaaccttattaatattaatcccctagcatttgcaagactaggacaaaatttcagatatcatttatatgatatttttgaagacattttataaatacaacaaatatgatggattatttctattactataactaaattatgttttgaaataccatactatttactaagagctataaaatgtgatagtatcctataaaattaatatctcaataactctaaaacatgtcagttgaaaatagtgcatatatattagtgtgaatgtatgtgggggtatgtcaaaagagaatctccttaatacaagcctctgctggaaataaaaaataaagaaaaaaagcagaaaatgaattatttaataatttctaagatgttctcaggtgccaacacaacaaatcctaatgaacccagggttgattaaatgcagataaagaagatatgcatttttcaaatctcatgaagagaaaaaagatttttctgtcgatcattctctaattaaagtattaacggtaagatagagactgtattccctcttactggaaagataaactgtatgtttctataatatatgtcaccctagcaacaacacacaaagcatcaactgcctttaataaaaactgattttataattaaaggagctaactgttgaaaaatagtcactttttatagacacttgaatatgaaaattggtttctcacacctcattataatactaagtgcaaattagtataagcctttgctcatccattccaagtaaagcagaagcacagacagatcaaccaacctagcactgtacatgacacgttgtaggaattcaactagttctgttaatttaaatacctgcaatagtttttattatatctgcactatggatttttaaaaaatatgtaacagcaaaaaaactaccaagaatatttataatataaacagttttttaaaaatattctttctcatgaaaaagtctatttaggaacttctggtaagggtaagataacttcgacccatttttcccttcctcttcccactaaaacagcaacaaatgctggtaataatgcaggaataaacccaagataactctgaaggtagtcagaagaagacgacggagttttggtttactgggtctggagcagaagttgagtgacttacatcttttcacttaatagaagcaagtgacccagactcaccatttcgagacccacaaccagcagtcgaaagcagcctagaaaggcttatctctccacatctaagaggattccctgagacaacatcaggttctcctgacactttctaggacaggatgggtagatgcaatccagagaattgccaacagtaaggggaaacactctctgttcctggtgggcctgcttcagctctcatccacagatacctgtgaaggagtaaaggatgttccatccccaaatatgccagattggtatgttggctattttcagttggaaactttggagaaattgtagtttcagaaagagttagctcacctgtctcttcctacatgcagcaaaccataaagattcctctgggaggggcaccctcacaggaccagagtgagaaaatagcccttattaccagagacttagaattggaggcttcaatggacctgaataaatatatttactgaagtaacccttatctttcactagttttatacccactatctatctcctagtgactcccctagagaaaatttactgtccctagccagattctctttatcctgtcattgctttccaaattcatcaaattcatcattcatcattaaaagcatcttgctttgactacttcttcaggcttcactttcttgtgatgatctccacgtacatgtataagtaatacaatttgtattcttttcttttgttttctgcctgatgtcgatttggtttctagatccaactgaagagcctactaagaactaaaagggggattggaggtgatatccaattcccctacacctgcacatgtgatgaaactgtacagaactaaatacacacacacacacacacacacacacacacacacacacacacacacatataggaacaccgagagaaactgaataaaattgctgaattgtagtaatgtcaatattctggctgtgatattatattatagttttgcaaaatattaactttagggaaaaaatggtaaagtgtacataggatatccgtattatttcttattaactgtatatgtatctacaattatctccataaaatgtcaatttttttaaaagtcaattttgatttttttattttctgtttggatttcactagatgttcttattgattttattcactatataattgagaatcatcttgctctgtgtttactcagagcaagctgaactttcagcaatcttatttttaaaaaatgctacatgatatgaccttatcagcaatttactaagttatttgaatggactttatggacatgaacttatcttcaaagcgtcttttctgtttaaagctatgtcctttaccgttttttttaaactggaagcattccttccctgccagctaaagaaaattccatgttattaaaaatggtggttctcagccataattaatacacatagttcataacacccatttaaaattggtaatgtgtttataagagaggtgagacatgcaagaaaagaagtggtaccaagtgatcaccagagacacatggagtgtgtgagtgtaggagagttatttaacctctgtgctatttatttatttacttatttgagatggagtttccttcctgttccccaggctggagcgcaatggcgccatctcggctcactgcaacttccgcctcccaggttcaagcgattctcctgcctcagcctcccaagtagctgggattacaggcacccaccaccacacccggctaatttttgtatttttagtagagacagggttttgtcatgttggccaggctggtctcaaactcttgacctcaggtgatccacccgctttggccgcccaaagtgctgggattgtaggagtgagccaccgtgcccggcccacctctgtgttttactttccctatctataaaaagggaagtaaaaatagtatcttctacttaggatagttatgtgctataatatgtgaagcccttatttcagagccaagcatatagtaagcacttccataaatattaattattattattactcatggaacataattgattcccattagaatttgtaggagtaaggaggtaacactttaaatctactttgttcagagctgcttctcgctggaaaccttttaagtagtgtttgtatcaccttttctcctagcacttacatagtgtactgcttgtgtaattaactccatggataaagaaatatccttccccttccatttactagctttttaatagtgcagcttcaggtcttccactagaaatattagaattgtcacttaattttcaacctcccgatatttaattgaaagatgtacaatataatttaaaaggtacctacccatagggcaactaattctgaaaacgggtgataagtgaataaaggaagtatgcttaatttcattttcatgctttcgcagtttctatcttatattgataaagaaatcctaagctctacatctgtataagaatgtatcatcctttcaatatacttgtatctatataaaatgcagatgtgtatattcttgtgtgtgcatacacacatgcacagctatagaatatagatattttaatttagataattttaggactttacataaaatgaatcacatatgcactattatgatgttttccccaatgcaagataatattttctaagattttagacataagatgtattttatcatgtacaatgcactctaaaacttaccaagtttccatttacaagggaaaacgattaaaaccacaaattgctatagttaagagtttgggattattttattttattttacaaatgagagcattcatttctgaatacctaccataacacatgcatacatctgtcagaaaaaaaaaatcatatttagaatccaagtttactcccggagaaccttaacctatttcaaaaacatctttgggaagatgtcaggaattttcacaatttctattacactcttctgatttgagtcaaagaaaataattttcaacataataggacagcccagggaggcgagtttcagccagttgctgtggaaaaaccagaggcagtcgctgtcatgcagctgccaacaccacagttgggggccttgccaagtagacagatgccaaaacagaaaaaatagcttattccaattaattgttgaaacctataaaggtaaaacacttcatgtgtgggcctgactacagaactgctttgtcccccaaaggcatcgtgtatttgcttttcattgtgggggttgctagaaacatagaaataatattattaaagtatagaagatgtccaaggaacatgcatctttcctctagcaaagaataatttaaaattaaaataagtattatacttattacttttctaaattgcgacttctctccatgcctcactttccctctctgtaaaatggagataatagcatcacactgctattttaatgagaaaagtgaaataatacatgtgatgtacttaatggtgccaagtagttagcatacatcaaacatgagcaattatattattcctattattataccaagttagttaaacttgtattattttactactaatatttgtattactgcactaagttagataaatcaaaaccattgttaaagctgatctagaagtaagttattagacatttctgtttaggagatatcagttacttagaaatttagttactataaataagtcttacatatagaaaattacctttttttggtgactttagaaatttagggcgtaagaaataacttttcaaagaaaaaaattatgtcatcattttaaagagctctctcagtgagtattaattgtgttcatagctagataaatgtgtgcacacacaacacattacggccaattcaaattttaaaacaatgccattatagtggaatttcatcctattctgtatgggatcaaagcatccagaggtctaaaaaacattaaaataaccaatcctctaggtgctttttaagttttcagttaatttgtcttatctacattgaagcaaacaatctaaaacttgcaatggatatctgtgaagcatacatcaaaagaaaagtatagtagctgttagttcaaggaactgaatgatagagcttccaattaaaaatacacacatgtgttgtttatcttatttcagtgaactaaaaggttatttgcatttcttgtaaagtgtgctcatccctttaagtttcagtgaactgtttgagaagacatagggaatgggaatgcattttattacaacctttccctttatttggaaagattattcggtagctgtttctgaaatgtctagtactactgtgaaaaactagtacccacaatatagttctagaaacagaatagacaaagttgcttctgatatctttctgtctactagtcaggaatgcaagacaatttcagatcaatgatccttctactatcaaaagtcatgggacctaaggatcaagatcacttttatttttgctccatttgaattatccaggcaaaaccaatgacataaatgaggccttacgtgacctgacatccctatgcctgatctagcaggactgtgacatcaacagtaaagctagacggatcaaaaggtgcctccaatgcccgtgtcagcgtcagcttcagcagaagctccccacttggcattcctgcttgagtgctttgcagtcctggcatgtcacctaactggctggtgcttcctaataggccctacaccacttctgattgatgtgtgaatatgcaaaccttactggaatccaggagccagatggcccacataccaagtatagcagccagacaaaacagaggcagattcagcaaactgttggagagttacatttttggtgattcctacagacacctaagtatacatagtcctatttaattgatttcattccatgttaacccacaacaatagtgcctctgtcattaaactgccacattctaattaaaggagaaaattctttcttttctcctttccatttagcatgaaatgaaggcttttataatcaacctgattctaccctgctacttgtagaggctgtcatgtagtctctaaaggcacaggtgaacaaaatctctttgctgcttctctaggataaagcagtcacttatttctttcattaaacttagatgaattatttaaaacaaaagccataacttgtataaaagagtgcccagatgagggtgtatcctccctgagtgagtaatatctagtatatatcagccacacaataaaaaatgatgaaaatggtaaaaattataaaatgataaaaaatgattaacaaaacacaggaaaatcatatatacatatatatgtgtatatatatatataaaatcacacacagcatgtctcataatgaaaagtagaagttacttaatatcggttttctttttttacatatgtaaaatatcattcatgggtgtacttgtgtgtgtgcacaaccacattgaatggagacatttcaattagaacttctccgatagaagaaatttaatccacaaataggaaaagcagtatatctcagcgttaatcacttatgccttaaaaataatcatgatagcaaccaaaattctttctggaatctgaatcagccacacacatgtgtttctgactttattcattaagattagcagccttccagaaatcactaaaatggaatcttcaaaagctccagttcaagatctggagataaaatgaaagtctggtgatcctttccatagactctgaggactttctttaccgtcttaatgtcttcaatggaaaaacgaccgtgtatgacaaaataataagtttgcttcctgagcttgaaatgaatggctgcctatcagatccactctgagcatatcacttcaggctgtcaggccagccacattgctcacaatttccctttgggataagctaatcctaaaatcattttatagtttggatagtttcagcatgagatattgatgtctttgtagaagttctattgcataacatatacatggaagactcaagttatacggatatgtatgtactacactaattgtgtagtgtgactatgtatgcattaagaattttaatcaattgtgtaaagggaagcaaatgttcatctttcatatctcaaccaatagttttggttctcatggaaatcaaacattacctttttgtaataaaatcagtgtttcaacagaaatatatttcacaatgaaccttgtttataatgaccatctaaaatttctttaagagatgggcattacaggtcaaagataatctgtatgaaaaaaatacataagatattataaaatgtagcttaaactgttgtgtattaggaaaaatttaatacaaattctgctataattcaaaaagaaaataatgaagggaaataaaagaaaagaataaagtggaacaaaatgtgtcacataaaacaacatataccagggtagggtactataaagttttatttctacagctttgaaagaagctaaaaactcacttgtgactctgtagctcatgagtaatgtggtcatttcaaacttatggtgataaaactttatggcactctagttcagaacatatgtcaaacagagaaaaaagtaaaaatcaaaatgaaatgtgacaaaacactgcaaaacccttctcatctgacaccactattctggttttgtctgggaatcggtggtcaatttcattttgaaatttctgtctcagagtcatgtagcaacttaaatgactgctctgattagcatcaaagtaagtgtagaaaaatgatttgctttcatcatgatggtgttaacaatatgtacttcagaaaatgtcatcgttagtgttgctaaagtaagaacagaagcataattcctgcagttaaattccaatctaagatatttgaccttcacacgaaaagaatgaagacaaagcctttctcttttaaaaactatttttatggaatatattaattttagagaaaatgtcatgtctttacaatgagagctcaatattttcaaatgatgtggttatatattaaatgaatacgttcattttcttaccattaaatttttggtattagttctgggaggccataatttttctacttaaatttttgcctgtatataaaaagtactttgtgtaaatagagtccaatttgactttagtttattagtattaattagttgtattttgtcacttggacaacttgcaaaactttggtgttattctgattgtcactccattttcttagctgtagggccagaatctaattaatcctattattaatagttgtctaatttctcactattctgttccttagcctaaaggtttcataactctgtatgaaaatgagaaaacctgtcattgattaatatatgtttgtttttgtattaattgtgcaactgcaatgttactgcacatagaaatgtaactccttgattgaggagcacattgccacacatggaatctccaaaatgccaagtgaaaatcaccactcttaagagtttatttcagagtgttgactaaattgtttggggacttctttgcctataacataaacttaagagtttttgaggtacttgttttccttttaatcaaatacttagggaattataagtgtcttcttagagaccatgctttcatgcctagctacagttgaccaactcttttaaaaagctttgtctcctgaaataataataggaacaaactcaacatttctaagagaagaagacaccgttatcaactgagtgcagtgtaattcatcagtcattgataaaatcatattctagattaatccaggattcattcaattatttctaccaaatctctttcccttcaagagagggagtggagttagttgtcatccaaaatgctaatccaaaataataagggccatttaagagaagttattgagttgctttagaacttgtagattctatgctatgctgtcactgtaagtagcattattttagaaaataaacccctaaaccttaatttaacatgaaatggttcataactacaaccacctgaactgtgatcaaatcatgtcacttagatccatgtaaagcagtacttactacacccctctcacctggagagtttactgaaaggcatacctagggaaaaggcattcatctagtgctgccccagtttgaaagcgtaccaaaaagtattcacacaaggtttgtgtcacacaaggagaaactgtatgtgcctgttcttgaaacccacagcagtaatggtaacagaagaataacaagaatacatatcttgattccatataccaagctttatcctagaaaaggttgggattactggacttaaaagaacatggtattccgtaatcagacaaccttaatttgggaccattctggagactgcttaccacagtgataattatacctaatttgttaaaattcattttttccaattataataataattagaaaactataaaagtatacaaatgcagtacgttttatcttagttttcttctacttcaaaattatatatattatctaaaatttgtttttcttttcaggttatttctaaggtactttgatttttgttaaataattcagtttaaattccacgtttttatgtagaaaaaaatcaaggatttgatttctcttatattcaaaagtgcaatcgttttctttctacattgagatgaaagtattttggagcataaacaatacacgctaaataattgcaaatagcttttaaaggctaaagtttgcaatactgaagagctaaaccagcattgtccattagaatttttggtggtgataaaaaacaaaaaatgttctatacatgcactacataacacgatggccactaaaaccatgtgactactgagcacttcaaatgtagctagcaaaatggaggaacaacatagtttcttttactttcactaatttaaattcaaaataattttttgccattgtctaatggctaccaaattggacagcacaagtctagaatttaattactaatacatgtatactttttttattggtacatatgtcatataaggttgtatgcgcagaagcatacagataaatggatgccatcttgttactatctaaaagccaacatacaaatgttttatgacttaaaaaaatgccacagattcttgcttcactttaatgtgaggaactcagatatttattaacataattttgaccaaaagtagcctccataccaaatgcaattatttagccatttctgcaagactggagattttttccccaaaaactaactagaaaaataacttaatcctctgttttaatatgccatttcacagcttgcaattgcttattgtgaatgctcctatttcttttcttgaaactttggcaaaactattatgccagaacatgatttacattttgtcattcatttaaaattcagaatggctttttatgccattaagtctatttatttacattaaagacaaatgcatacttaacaatttggagaaaacaatcaaaagcttttgaatcattctaattggtgagggcttattctttaaaaagtaacatctatttgatgtagatctgtgatctgacagaaaactaattgttttaagtatttgtaatccaagcagcagtgatgcaaatgaatttaattatcagtttaaaaatccaaacaatgggaagtaagacaacacgctgccttcaaagctatagtaataaaagaagtgctagtacatttcctcatgtacctggaaatgagtggcccagatttgcttgcactaaagtctacatgcctaattttaatcattttgattgtataatcaacttcccccagtcatttctaaagataaattaagatgcatgctttcattaagaataaaacaccctgatttcttcatatttctaaataacttgccttttccaggttttctgaggtaagaattcctgaatgatactcacaaaagtaaaatgtacactgaatctagtaattatatttattttaattttctttctttaagaacagactgttggccaggtggggtaatctcagtattttgggaggccgatgggggcggatcacctgaggtcatgagttcaagaccagcctggtcaacatggtgaaaccccgtctctactaaaatacaaaaattagctgggcatggtggcaggtgcctgtaatcccaactacttgggaggctgaggaaggacaatcgcttgaacccaggaggcagaggttgcagtgagccaagaccacgccattgcactccagcctgggcaacaaaagccaagctctgtctcaaaaaaaaaaaaaaaaaaaaactgtctattttatattgaatttgagtaaaatgcaaaatatgcagtgaattttactaaaatcaatgtattttactgaatattagaccaacgcattgtagttggggattgcccctttggcaaagctcccatttagttcccaactattctgatttatagctaatatggagaaaagttaggaaatgaagaatttttggactgacacaattataaaaccaagaggaaaaagcctacagtttttaaaccaaaaaacctaactttagaacccggatttgtgagtaagtagtttgagcaagtcatttagacaaatgctcttcaagctataggtcaagacatttgtgagctgtacaacccgtttatgtgtcataactgccattaatgtaaaaaatcaaatagaaggctggtgcggtcgctcatgcctgtaatcctagcactttgggaggctgaggcgggcggactgcctgacctcaggagttcaagaccagcctgggcaacacggtgaaaccccgtctctactaaaatacaataattagccaggcatggtggtgtgtgcctgtagtcccagctacttgggaggctgtggcaggagaattgcttgaacccaggaggcagaggttgcagtgagctgatatcatgccactgcactccagcctgagcaacagagactccatctcaaaaaaaggaaaaaaaaaaacaaatagaaaagaatgaaataaaattattaaagtgtggctacatatactaaaaatgccaccttttataaaacttttgttttatttctgcatgtgtctgtgtgttttggggggtactggatcatcaagagtgctcactttttctcttaaattggattgtgaacaatgtaggggagaaaaaattgatttcctcgcctatcacaaggttcatagctgagacccctatagcaaaagaaaggttaacaagagaaaagcatacaaatgtatttaatataaattttacaaatgataccaggacacaggagcattcagaaatgaatacctaaagaaaaaggggagacctgtgtatttttatgctaaatttgatgaagagtggacaacctggcagaagtatgattggagaacaaaagggtgtaatctaatggtaataaagttggggtgggggggaatgtagcaaagcctgtttgttcagtcttctctgtgtcccagtgtgacattcctttcctttaggtatgggacacatgaggggtcttatggcctacttcagagcaaggccagataattcttttctgatctgcttcagaggaaaatggtggcagaaggtcagagactttctcacttccgctgtttcccgaaatgccaaggtgccatatttggggatgatatgtcctaaatcccactaacaacaaatataaaaaaggtggaagcccccaatttaaaaaaaaaaaaaaaatagattgtttaatcatttgaacttgggaatcttgaaaatattaaaaagaatcctgattctttctccgtttagccttgaacaagttatttaactattctctgctttggttctgtcatatgtaaaatgaggatactaataatgtctatctcagtacgttgctttaagaattaactgagagtgcacatatatctttgacaaatcaattaaaatacctttggatatatatccagaagtaggaaagttggatcatatggtaattccatttttaggtttttgaggaatctccatattattttccaaaatgaccatactaatttacattcccaccaagagtagacaacattctgaccacaaaacataagttagtgaggtgatagatatgttaattagcttgattgaatgtttctgtaatatattcatagattaaaatatcacattgtacaccataaattactcaactgttacttgttcattaaaaataaataaataaggtcagtcaccgtggctcacgccagcactttgagaggctaaagcaggtagatcacctgagctatggagtctgagaccagcctgggcaacataggggacccccatctctacaaaaaataggaacattagctgagcatggtgggggacacctgtagtcccagctacttgggggttcaggtaggaggatggcttggaggtcaaggctgcaatgagccgcaatgactccactgcactccaacctgagtgacgaagtgagatcttgtctcaaaaaccaaaccaaaacaagataaataaatgcaattaaagaactcatgcaaatccattataacaatgcttgacacttaataaaggctagccatctgtatgacatctctgttctatgactttttagttacttttaggtttaatgtgaatgttttttctttctttttaacttaaatgccgtataaagcactcttttaaataatgtacatagaaactttatctaaaattcctagttatgtgattttgctaacaggcatatttttcatggaacaaaaagtcacggacaacaagccctcattgtccatttttctcatatgaatttctctgtacttgaaatgttactgtcaggacttggctctgccctgcttctatcatgcctgtcaccttattcaatagaaacaagatgagtgttcttggcattgggaagcaagaagttagtattgtaagtatgattatttcacacaatactagaaatcgttgctgaggaacagcctgcatattgccacggaagaaggctgggatcctgtaccctgagataggccaagtgaaataaggtctattcatagacttgtatggtagttacaacattggttgttttagataataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagttctctacctatttatatatatatatacacacacacacacatttgcatatatatgtttatatacacacacacacacaaatgctacatatatattctaattgttttattcattttctgtgtattttaactaacttattgagatgcttgaacaaattgaaatgctttttataatgcttttaaaaataatcactacatataacatattctccagtagttgaacaatgtaaagaatttcttatatgtatgactttattctaacattcatatttcttgggtacttactaaatgttaggcactcacagctagtaatgtaaaatggtgggcaaagtctcttccaaaactatagtttataggctaataatggaagctttaggacacttttccaataattacacaacatgttatagtttgaagtgtgaaccttcgaaacagaagttgctggaaattcagtgtccttacactattcgaaggatttatacatgcagaaccagaaaacaaacaaacaaaaatatctcagttaaaatcagtcacttcagaggaaacaaattgatcgcgatagcagtagggaaaattttggagaaaaaatgttagctttgaagcaagcttgtccaacccgcagcctacaggctgcatgaggcccaggacagctttgaatgcagcccaacacaaatttgtaaactttcttgaaacatcatgagatattttttagatttattttttttagctcatcatctatcattagtgttactgtatttaatgtgtggcccaagacaattctcccagtgtggcccagggaagctaaaagttctgacaattctgctttgaagactcccttttaagttggcaatgaatgtacttacatgattatgtaggtattgttacttaaatgtaacatgttacgtttaacatgtttaaacattgatgaccaacgcagaatctcagcactttgggaggctgaggcgggcagatcacgaggtcaggagattgagccatcctggctaacatggtgaaaccccgcctctactaaaaatacaaaaattagccgggtgtggtggcacgtgcctgtagtcccagctactcaggaggctgaggcaggagaatcgcttgaactagggagtcggaggttgcagtgagccaagagtgtgccactgcactccagcctgggtgacagagcgagactccatctcaaaaacaaaaacaaaaacaaaaacaaaaaacaaaaaaaaaaccgaaaaaacaagaaatgtcttctgaccaatttctgtttctggtctgtgcatttgacttgagcacagatccattgttgcatacttgaagcgtcacgtacacgtgttgagttaaggaaaaaaagtcacattttcttttgatcactctcccatgtaacttcgttgaaagttacctttcattcctttttccatatcatttcctgggctagtcttacataatgttcaaacagggatcatgtaacgaattccatatcagtttataagctagactattaagattggtaaatgtatattttgtgttttttttcttactgctttggagtattgaaaggagttttagtataggggtgtttttatactaaacatactttagtttacataatagagtgtacatttactatacatattttattcaattcacaattttttttaaatcttgctttgttcaatagtgttcattatatacactttgaacctggcttcaaaaatagtacatccttctctattttatgcattttatatcaactatatgtaattgtttcaaattaagattttagataatatcctgtcacattacacttaggttgtctgaccaatagtttcttaaagattcctctatagttacattttctagtttcctttgcaattaagtttagccatataactgggttctgacccatgggatgttggtggaggtgacaaaagtcccttcctgacttagtcagaatattctaagacccctctatagctatgctgtgtaatgtggtagccactagccacatgtggctttggagcacctgaatagtggctatcccgtgttgctgagatttgctggaagtgtaaaattcacaacggaatttagagaggtggtacaataaataatgcaataaataatactaattgatatagtgattacctgttgaagaaataatatttttgttttacatatagttaaataaatattattaaaattacttcacctgtttcttctcagtttttaaatgaggctataagaaatgtaaatactatataaactttttgcaatacatttctattggatgtgctgccaaacttctcaggattcctatatatctttctattctactacatctaccattcatttcttcatcattaattattctatattttttattataaatttactgtgcgctaggcactctaattattccattgtttattataaatctactgtgtgccagctactcttctaataatcacctactgttaagacacaggatgggacatgtgacttcatgataaaaagggggaaacaccctgatataggaactgaattttacaagattttttgtgctccaacttcagtccctgccagaacaagcaaaaggagtgactacaatgtgactttctaaatggttgtattgaggaccacagatgctgggtcctgcctattaggaagaatgggcacactgagttatgaaatgataaaagactcctgtgtctcattctttggccttcagggactgtggtgattttgcaatgtctgtgaattgcccagggcttcagtgactgtggtgatagttctaaaacagggacacacagctttaggaacagtttcagtctataagtctgactatatgtacttcctgttgataaactcatgcttttgtcagtcttttgctaatactgaaaaacactcatgaaccatcctccatttcccattattattcaaggactttagacattcagagttctcagacaattttttcttttgaagagaaaatgtgggtggtttctttacaacttttttgttttgtgtattattattagacactgtctaatgttacatagaaaagaattggttgaagacaagaaagacagcgtctaacagaatataaaataaagaaaaacaaaaccaaagcattcaaataattaatatgaatgagaaaggtatcatttggtttcgtttctactttggctagacagtttcagtacttctgacttttctcataagtctttttttctaatattttaagcattgtttctcttcattatcttacttaatctaaaacagttccctcaaaacctttttaattctcttttaaaatctctacttttatatcttttaaaaatataggcatcaacattatactttaatactaacaaattttactatagaaaattgtgaaagaaccaaaacaacagtcctcttgttgtaaccacaagagcttactaattcatttttaaaagaaattatattgcctattcattccccttttggttaccttcttgctcaagaagtaaggtactttgcaaatggcatagttgatcccagcacctagatatatacatctctaatcaagtgccttttctattcagaaggtaaaagtgtaggtgaattatcagcccaatataataagatcttatcagtgtgtcactagtggagggtgcccaggttcttggtgtcttgatcaaagaattggacaaaatgcacaaacaaagcaaggaaggaatgaagggatttatttaaaatgaaaagtacatgccatagtgtgagagcgggctgagcagcggctcaagtgcccagataaagaaaatcttctggggtccaaataccctctacaggtttcccattggccacttcatgctcaccccacgtaaatgaagtggtggcctgcaattggtctgattggttgtggaaagcaaccaatcagaggctgaagtagagttacataggacactctcctgtgcaaacatctgattggttgcaaaaagcaaccaatcagaggctaaggtgaagttacaaagttgcacttctgtgcaaagactgggcccgcaatcagtctgattggttgggaacagccaatttcccatctgctacacagaaaaggtgggaggtttgcaaagggagtagcctctggtccttatgttacttaggggtggaaagttagggttttgccttcagtttagtcctagggaagtcagcgtgaaatggccttaggttcccttcctccagaccctattctcctgcctcaaatgtgtgatatttttttctcgaaaaaaaaaaaaaaaaaaaaaaaaagaagaagaaaaaagaaaaaagaaaaagaaaaaattcctcagggacctctgcaccaggtgtgctaaaacagagcaacacatgaaaatgtacttccttttcctaatttttcaaaattttaaatttttttattttaatacttttgggggaacaggtggtttttggttacctgggtaagttctttagtggtgatttccgagattttggtgcacccatcacctgagaagtatacaccgtacccaatatgtaggcttttatctctcacccatctcctacccttccccctgctctgagtccctagagtccattatatcattcttatgcctttgcatcctcatagttgagctcccacttatgagtgagaacatacggtgtttggttttccattcctgaattactttacttagaataatggcctccagttctatccaagttgttgcaaaatacattatttcattcctgtacttccctttcaaccacagaaaacaaacaacaaatgttatcatttatgaagaataaaatcttgtgtattttggggagtggaagaaaggtagcacttcttttataagttagtgctattattttataacttgagacatctgattagcttacctataacaaagtggaaatagaaaatatataatatacagtaaactattcatataatgtaactgtttagaatcttaactatcaggcagtgtatttaatgatctttcaagttgcttcgtattttctttttgtccgtttttttaattcaaattattggtttactgacttagatgataggtttgttctttagcagatatgctgaaatgtcttatataaatagtctctgaataaaatcacaatatcagctatcataaaactctacttacatagctcgtttaatatattattagaaacagtcttcattttaaatgcttcttccagaatgtatgcacatattatatagtgaggcatacttaaatattaacaggacattgctgaccttccaaaattgtattcgatgtttcagaagtaagttatgatactacaatcagtaatataaagcattctgctatgactttattcttaaaagagagaaactaaatcacatttacttgaaaactggcatattgaaatgaaacatttccatcctttgtggagatagagaacgctccagattcttgaagagaccatcagagaaaatctaggccaacatttattgttactaaatgcataaatttctctttcagtatcaggaaaatatatgagtatgaacatctataaatatgttttaaaaattatttgaagcctttccaataaaatgacaggaagaaaaccttttaaaaaggtgtaactctacaagcataaagaaaacaggagaagaaaaatgaacaactcaagatgttagcaaattttgggaagtacttccttgccttatggctctaacaaaggctgcaggctcacccactatgttccttggccaggatgaagtatcatatattcttctaatgagctgtgacttctttcagtgtggaatgagacttaccaatgaatatctgcatgctaggtatactcattactaccagaccttcccagctgatagaaatatatttttacaaaacacattttaacaaattgttagtttttattgaaaatttatatttaatatgatagttttccctaagttttaatttataattttatgtttccctatcccttcatcgatatttatttttagtgtttttctggttatttttacttgtgtatttttttataaaaagtttataatcaatttatccaactccagaaaaaaatactacttattatattggaatgcctttaatttacacattaacttaaaaacaatagtttactttataatgttaagccatgcttttcaggaacaaggagcatctttctccttgatttccttttgggttgttcaggagagttttaaacataggtactgaaatttcttgttaaatgtgtttcttgtttttgctgttgttgctattgttgcaaatgggtgtgcaccatccataaaaacttctagctcattacctataaaatgaattttactgattttgcctgtaaattttatagtctgctaacttactaaattattttattggtatttgtttgtgttcatatttgtgtttgttaatattattgttttgtgtgatctcttgaggtaaacaattctatctgtaaattgggatcccattaccactgcttgcaattgttttgcctcgaattggtttatcttgtctggttgcaatggctaatattttcaacacaatgttaagtattaatggaggtagctgtagtactcatatggttttcctgtctttatccagaatgcatcagatgtttcttctttaagtaatgtacaaacttttggactttacacacacacaaacacacacacacacacacacgcatatatatatataatatgtcaacaaaattattcaattctgttttatattaaatgtactttaatcatgaaatagattttaattttatcaaatgttagtatctcacacttaaatataaaccaaaagctaagatcacttgtaatttgaggaatgacttcaataatgagaaacagttcctcaaaataaagcaaataagaacaaatgggaagaagacagaaaacatgagcaatgcaagcagaagagaattatgggaaaattataattgaggtccacagaaagttaggagagaaataattgtattttataaaacaaggtcatgacaatataaaaaaatgaacaaaaacacctataattgacatcctatttagtggtgagaaaatgaaaactttctcaggaagatcaggaacaagacaaaaatgtctctcttaccactctttttcaacatcatattggaagtcctagctaatgcaataagacaaagaaaatagacatatctattggaatgtagaaatgaagctgtatttcttcatagatgacatgaccatctatgtagaaaatctgaaagaatcgaaaaataaccctggaaataataagcaattgtagcaaagttgcaggacacaagattaatatataaaattcaattgtttcttacacaccagcagtgaacaagtggaatttgaaatgtaaaacacaaagccatttccactaacattttcaaaaataaaatactgaggaataaatctaaaaaatatacaagatctttacaagaaaactacaaaactctgatgaaagttatcagaggaactaaatgaatggtgaaatattcagtgttcatggatagaaagactcaatattgtaaagaagtcagttctcctcaagttgatctacagatttaacgcaatcccaatcaaaatcacagcaagttaccttgccttatatagacaaaccgtttctaaagtttatatgaaaggcaaaagacccagaataacccacacaatattgaaggagaagaacaaagttggaaaactgacactatctgactacaagacttactatgaaatgacagtaatcaagacagtgtattggcaaaataatagacaaatacatcaatagaacagaatagtgtggaaatagacccacatgaatacagtttactgatctttgacaaacgagcaatggcaatagaatggagcaaagatagccttttcaacaaataatgctgaaacaactggacatctacatgcaaaaaaatgaatgtagacatagaccttgcactctatcagatcagaagagagacaaagatcaagttactgctactggatttacaagttaacgttcactggttgtacacactcatacaatgctagaggcacttgtatcatctctcattgttccttattttttaatagagataaatgtatttattcttgttcttgaggataaattttaggagttgaaaataaatactccttccataaaaacatactaaaactaaaattattttcaatgattttccatgggaaatttacctatactttgccaccaaactctctcttgcaatagtctttcttatcccagtaaataaccatcccatccttccttttgctcaagctaaaactgtttttctccactctctcaatctccatttttagtccaccagcaaatcctgttacatctactttcaaaatgtatccaaaattcgatcatttctccccagatccatggacatcaacctaatcctagccacacgcacacacccagccttcattactacattatcctctaactcatctctctacttctacctttacatcctacattctaacttacattatttctggctactgttcagaactctcaaaatctcctaatctcccacaatgtacaagccaagacctttacaatggtcaataaggccctatctgatttgtccttctaataccactccacttgcagatcctaccgctcttcctcagtcactctgcaccagccatcttgactcccttgttatcccacaaacacgcactccctcctcagagtgtacatattcttccctctgcctagaactctcttctccaagacacctgcaagatgccctcctttccttccttcaggttttttgtatgcctcttaagtgaggcttttccaggacccactacataaaatggcaacctaccctttgaaatatccctattctacccttatcctgctttattttttctcttagcacttgtcactctctgaaattctatattctacttgcagagagaaaaaacaaacaagttgacaaacaaatatagagaacgtcagatagtttgctaaatgtttccctctttggtttagctcgctagctaacagggccttatgattaaagggacttgatctcttaactgttatattcaaaacactagagcacctgatatgaaatagatagagaatgtagacttcatgtgtatttctgtcaaagcatgtttccttaaatataaattatttgtaaaggataagaacttcaagtacagatatgatactcaaaatatttattctctgactgacataataactgcaggtaattttaataggactagttcctatgaaaagtactctccgtagaccttgtagatcgaagacatttttttttcttcaggccaggtaaactaaatcaaagaaagaaacatttagcaaattcatctgcaactctcatttgttctcattaaaagacagctaatgctaaaccaaagagtaacttcacacatttctaatgaaaaggtctcttagtttgcactcatcacctggccacaattctggacaagaccgaaagtgatcacttgtttattgatcactttttgtccatttttactattacttatctctgcatatagaactggcatagtgaaattagctaaattaggatacaaataagcaaagcccttttaaaaaccatactctgccttttatgttccaagatacatacaagtctgccctccatgtgcattacaagaaaggtttctacagttaaagttatatcagtacattactgtcagagtagatcttaattctttgtgttctggctaccatgatcataatttgaaatataattctaggaatccataggaatcttggtaaggttaaaaatgcaacacccttaagtgaagcacagaggaagaccttcagagtgtcactaaaatgaaatccttctgctgaagcaaagtaaagcacaaaagagagattgaaagactctgtaggtcaattggaaatgttttattcttaagaaaaatatatagtagcccatgaaaggattgcagtgaaagaaatttgcggatacagtcaatagtaatgccacaacgaactgtttttttctaacctttgaacacaattatattaatatctttattcatcacctatctgccctgaaacacaaaataactaggattgttaaaaatatatatatacatcagataagtatttttaagtcttataacctaaaacaactatatatacgtatatatacgtatatatacacataaatgtatacgtatatatatacacatatatgtatacgtgtatatatacacatactcatatatgtatatatacgtgtatatatacacatactcatatatgtatatatacatgtatatatacacacgtatatatacgtatatatacatatgtgtatatacacttatgtatatatacgtgtgtatatatacacacatacacacgtatatatacacatgtgtgtatatatgtatatgtgtctatatgcatacacacatatacatatatgtgtatatatacgtatatatgtatatatatgtgtatatatacgtatatatgtatatatatgtgtatatatacgtatatatgtatatatatgtgtatatatacgtatatatgtatatatgtgtatatatacacatatgtgcatatatgtgtatatatacacatgtgcatatatgtgtatgtgtgtatatatacacatatgtgtatgtgtgtatatgtgtatatacacatgtgtgtatatgtgtatatgtgtatatacacgtgtatatacacatgtgtgtatatgtgtatatgtgtatatacacgtgtatatatgtgtgtatatgtgtatatacacatgtgtgtatatgtatgtgtatacacatatgtatgtatgtgtatacacatatgtgtgtatgtgtatacacatgtgtgtatatgtatatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatacgtgtatatgtgtatacgtatatgtgtatatgcacatatgtgtgtatacgtatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatgtgtgtatacacatgtgtgtatatacacgtgtgtatgtgtatatacacatatgtgtgtatacacatgtgtgtatatacacgtatgtatgtgtatatacacatatgtgtgtacatgtgtatatacacatgtgtatatatacgtgtatatatacacaaatgtgcacatgtgtatatatacatgtatatgcacatatgtgcacatgtgtgtatatatgtatatatacgtgtatatatacatgtgtgtatatgtatatatgcatatatttgtgtatgtatatatgcatatgtgtgtgtatatgtacatatgtgtgtatatatgtacatatgtgtgtatatatgtacaaatatgtgtgtatatgtacatatatgtgtgtaaatatgtatatatgtacatatatgtgtataaatatgtatatatgtacatatatatgtgtgtatgtatatccatatatatatatatacacattttttaaaaaataggtataggttgagcctctcaaatccaaaaatcccaaatccaaaatgctcccaaatcagaaaccttttgagggctgacatgacacacaaaggaaatgctcattggagcattctggatttcagatttttggacttgagatgctcagccagtaagtataatgcaaatattccaaacgaaaatccaaaatttgaaacatttctattttcaaacgttttggacgaagaatgctcaatcagtatcagattgattgattttgagtcttttaactcattcagtttttgagtatagtccccacaaaataaatcccaatttaaatcaagtacttgcattgattctcaactggaaaaaggtcattcccctttgagggttcaataaattcctcagtggggtttcctccaacattctctactacagacctgattaaattactgaaattctaacactgtggttctcaaagtgtggttctttggccgtcagcatcagcatcacctgaggacctgttagaaatccggattcctgggtcccaccctagacctatggaattagaaactctgactatgggcctcagcaatccatgttttaacacattttctaggtaattccaatgcgttttgctgcatcgttttggagtgtgcatggtatcaaacaactctacaaaaatggtagcctgcttgcttttccattttaggtctctatgtctattgccaaatgtaaagggtagacttcagaccaaattttgcatgaagcattagtggtggtggggcagtctaattcttctatcattgcctgttgttttagagcttcacagtcttcaatcagaagttgcaaattaacatgactaagccattatcttattgttggctcaaccagccccacaacaatataattcttcaagaatggcattatatgccctctcacaacctctcttcttcactcctaaagatctcccttgctactactcacctgacaagtcatacttctttgattattacacatttctacatgcaattccttctgccttcatctttcttgaaattgtctctgcgtagacaacaccagactaaatgtcaccatattttaaaaagctattatcctctccaagcaattagtcattctgtcttctatgttcccacagcatttctattgcattaaagattatgttttattttaattatttgttgatgcaattgtttcctttctcagatgataatctcttggagagggaaaaccatgttgggttatgccttcatcactgtatgacagtatgattagcacatagctggcattcaataagtatttgttaaatgttgaaaggttattttagtaaacatatatctctgataggatggtaccagagtgtcaattgttcttttctaaataaaaatgcttcactaatgtccatgtatgttgttttgctagaaagcaaaataaaatcagataaataatggataggcccatcagccataaagaattggtttttttgctagcaactatcatgctaattggtaaatatttacatatgcaagctaaatatgcttggcactgagaccactccagagaatataggtgtaatcaataattccaattttcttgtatcaggacatgataacctagagaccaaaacatttaccttctaaaaggaattgtcaagatctcagtaacactgggttgataaacagcaacatatttctaagaaacttctttactattaacaataagtgatttgtctttctttgaaaacagtgagacctatcacaatccatttttgtctcactaactgagtaatatcctttgttacttaggtactttgcaaagattgtttcaggaaaacattcaagggaatggttctcagtagattaaaccatttagtataatcatcttgattccaaacacaaacacatcattcgacaagtcatcttaacaccaagtgtagatgttagggagttcacatgccagtaaagtggtattttgaatttcgtataaaactgttttaagttaatattcaaataatcatgtaaacacaataatttgtttatgagtagtagaaataaaaagcaatgtttgaaaatgacaatatcactttagataactctactgcaaactaagtttacttcactcaccaaaacgcagtatgtaaaaaatattaacatttaaagtacaaacagttctcgacttaagatattttgaccttataatagtgtaaggtgatactcatttagtagaaaccgtattttgagtacccatacatgcattctgtttttcactttcagtacagtattcaatcaattacatgagctagctttattataaaataggtttgtgtgaaatgattttgcccagctctaggatagtgttaagccagcacatttaaagtagggtaggctaagctatgttgtttcgaaggttaggtatattaaaggcatttttgacttgtgatattttcaacttatgatgggtttatagggacctaaccacacaagttgaggggcatttgtattagaaatcattcagaaagaatcaactaaaaaacttcctaaacaatggttgcattttggggttactaaacattcaaaggtagattaaatcctctgtgagtaagcgagcatttaataccacctgttattgagtcttcactgtctccaacccccctgcctgcttctcataggacttatcaatttgatgatttgtcccaaaaatgcattattgggtaggtggaatttttgtcccaacaataataggtatggaaatatcatgagttttagagtccattttcttgggtcctagcttcatctctcctatttactgtgagcaagccacataaattcacattttactcatcttgaatacttgtatcatatgattattggagcaactaaccatatacatataattttcagtaggattattaacatcatggtatacataaacaaaaagttcccaatcctcactatttctgaaacgaggatttccgtaagtttcctgtatcaatattcatctctccaaaataattgcactaaataattcaattgttaccaaagtcttgtgcaggctgctcatcagcatccagagacatagttcactgtacgtcatctgctctaatgatttaattcttcctattatcagataaaaacaaacaggaagccaggggcacaggagccattttagatctatgtaaaaccttccatggcacaatagctctgctcgattacttctgttaaagcaggcacattgcacaatagttatatataaatgtgttagctatatacagatttagaattcacttacacaatggaaaggtacatatatattgttacctccttcactgaaataatgttttgccactttgtcccagtatcatccttttttaaaaacttctaagctcattttaaatatagaatatgtttactgggtgtgtgtatatgtatgtgtgtgtgtgtgtgcgcgcacgcgcgtgtgtgtgtttgtgtgtacgtgttgaggacatgaattggcatacagagtgtaataggatagtaacacatgaataaatgctctgttttccctgtttgatgccaagaaggtagccaaaaccataatcaataaagaaatgaacaagtatccagaggaaaatcacccttcaaaaactttagttctgaaaatctagattcatgttaaggattgatatattgtcccaactgaacaggctattgggatatgggagttaagattcggggacagtggaaatttgcaatcagtcagattaaagagaggtttaatgagcttcctcaaacacagggaaagggatgaagttgtgaaggccaacatcctactccctttacagagtttccaaatgttgtgctgagacaacctacttaaatggctgtagaggccagataccaagcacagagcatcatcagcaaaaccttccgtgttcaagcaaggcagggcattgtggacaagctgtcctttatgtagtcatgtttacttggctattaagcatatcagctatgaccaaaatgcactgaaaaccaggacacttacagtattctggactctacctggccctttggaatggaagtgggaagaagtagaagaatgcaaaatgttacggagattgaatttctcaccagtcagattgttggggttactagttgctgcaggaacagattcaaccaatgtagagaaacaaggaaatatggcttattacaaactaggttatagaatcaaaattcatgtgcatttcaatagcatcatgaaattatggagttaggaacacaatgattacaattaaaatatcatgttctcaagaagaccaggtaacatcatggaaaagaatagaagtaaataagaaggagagattcagtagaaaaaaattcataaatatatgcatttttcaattcaattcagaaaatacattacataatgacaaaaatgggaatattttgtgtttatatgatttactatttataatgcccttttattatatgttttgttacaagtaggcaagaacatataagaaaaataagactcagagaatttcaattttatattcacctttcttttcaaataaattaaagtatggatataacgttttctcctaaggtagagagtagtgtgaagaagcctgctttatcaaaaaataacgtgctggtggggctgcggagaaaatggaacacttatacactgttggtgggagagtaaatgagttaaaccattgtggaagtcagtgtagtgattcctcaaagagctaaaaacagaactaccattcaacctagcaatcccattactgggcatgtacccagagaaatataaatcattctattataagacacgcatacatatgttcattgcagcactatttacaatagcaaagacgtggaatcaactcaaatgcccgtcaatgatagactggaccaagaaaatgtggtacatatacaccatggaatactatgtagccataagaaagaatgagatcatgtcctttgcagggacatggatggagttggaggccattatccttagcaaaatgatgcaggaacagaaaaccaagtactgcatgttctcacttataggtgggagctaaatgatgagaacacacggacacatagaggggaacaacacacactggagcttatcggaaggtggagggtgggaggagggagaggatcaggaaaaataattaatgggtactaggcctaatatctgggtgatgaaataatctgtacaaccaacccccgtgacacaagtttacctatataacaaacctgcacatgtacccctgaacttaaaataaaagttaaaaaaagaaaggctaccttactgactcaaaagtttagtgttaatttaccctacatcatgcttatcatgctggctaaaaggtaaattaaaaagaaatcttgcaagaagtatgtcatatcaatttattttatcacatgatattgcccaaagagggtgagtcctggatttttaatgtggacatatatgttgcggcaatgaagaggtaaatgaactattgtggcaggccaggtctcactaatgcaggcctccacaacaactgtttcagcactgactgagtggtaaagttacatattaaaagctgatagagccagcgcccttaaacaaaggctggacggtaacaaaagcccaccaagagttttgcccaggcctttcctgggccttgaagcatgacaagataatgaaggaattcttaacaggacccttttagaattaaaaaagctttattgggggtctgaagaaactccccaggactccacaaacaagtttactgggcatctgaaggaactcccccaaactccatgatttagccggagataagataagggtaatcatcccagcacctggacccatttagataaagtaaatttactgaggctccagaggaatgtcttcaggaatcagatcttagttacagatcagaagaagttaatcatttatgtctttagatggatacacacttacatgtagacatacagcgtagaaggtatataagctctggaaaactttatagttttgagttggtctggggataatttccaggtcttctccctgtaaccacttacagaaataaaaactctctccttttcccgttcatctgcatctcgttattgggccacaagaataagcagcccaatcctcagtttggtccaggaacactatcatatcatgggcttttgtgaagacattagacaaaactaattatgcatttctacttcatttaagtcaaacatgcatactatgttggaaaaaaatcagacagaagagtgagtatggaaataaagatgattactaaattcagtataggatcaaaaccatcatatcactcattgggagatagtttatctctctcaattgagctggcagtaaatattttttcccataaaattttttctcaaacacaaacatcaagcacattttatgacaaaattatttttggtcatgttttcaaaactgtacttccctttattaagccggcatggatgagcaagatttttataatgcgaatcatatttgtcatagagtatacacgaggctttttaaaggattataacatatcaataaattacatggaaagaatatttactctgaattaatcttatctagaaatggttttgtgtttatgtggagataaatattgttcagttatctctatataatagatgtgataaatcacattctagtagaattttttggaatcaaagttaatagaagacttattttaaaaagagatagggcttatttttaaaatggtaccaggaaagtggaaaatcagttagatttactgcaaagacacatttggcttcaaatgacgccacaacaacaaggatacatttaatcacatttatttcctttaaatatcccttccgtagctttacaaaataacaaggaaatattttgttgtctctctataatttacaaatattatataaatgtgtgtataaaaggcaatgaaaaattatcatctgtctgtgtggtaaagtagacacagatagacattaatacgactataaaaatgaatatgagttagatttattagtgaggcatttttatagttgtatgaatgtgtgtgtgcctgtgtctaatttaccacacagacagaatttttcattctcttttttctctttttaaagtcttcttcaacacaatttttccacccagtttttcttctgtttctacagttagcatagatttaatgatttgtactactgacctagtatatttattatatttatatagtgtactagtaataaacaatgagattatatagaagatatacattcctgcctttgatgggctcacattttagagctttcttcataaaggttaccagattccctctagctcagattactgccttctcagaccacccacactgagcccactcagttctaactccatttatcaattaaccaaaaactcccaaataactgtgtaggttccatgagttcaggagattccacttcaactaatctgtgtatcctacagggctagaattctgctgaaaggcatgcagcgatgcaataaattgccaaatgatatatatatcacaattatgtttatcttttggtttcaccaagtggcttaaactgaatcaactagcttcctctaaattcccatcttcttcaaaagtgtctaaaagaatgcagtcacttagctaagttttgacagaaaagaataagaaaagaggaaaaagattctttgcaagttctcaaaattagaagttagtgcacaggtatatatacattttacctttaaataagttttctcctctgtctttgtaaacttttatttctattcctgacacctaggatatgcttgataatagaatttctgtacttgaaagaatggtgactctcctgatcagttataacagacttagggagaacatttgtaatataaatgaaaagtgtgagttgagttagaggatgcaaatattttggaagaaaacaataaatgtgctcatatatgtgaatattttacagttttaagatatgggcattcataaggacagaaaaaaatataccgaattgctctgaggcagtgctaacaatatataaatagaggatggattggatatcaagctttgatttctatattaacaggtgagttgtgataaatgataatggaaaaggttaatgcacagagcgaagatctatttcaacttgcgggaatgaggatacacagtacttgtcatgtttacacaccttttaaaaattactctagttcaattcaaagattcagagtattgttacatttactatttcagaaaatttcttcacaattctgatttgtctgtatgtttgtttgaaaatatgtctcttgtctgcttcagaattccaaaacttaaaaatgtcaatgatgccagtatatacagcaattaaactatatataaccatcttataaatattcggagaattatgaataactttcctaaatatcctaggtttactttttatttattcttctatatttgtgttgttatattttatttcacttagctaaaaaaagttgaggatttaaaaaacgtttttaaaatacatgtttctgtttacgtctgtaatagaaatttgttaattattcagcaagtaaataaaatgaacttttattagttaaaattcagtaagttaaattaaagagtacatggcaacattctactaccaaataccacaaagaatagacgatattctaaaaatgtttgtcatagaaaagggagaacttttgagattggatctcctagtggattgttttggctccattatcatgaattttacaaaatcagacccatagagggagtaattcatagctattaagagtttcaggcattttagtagaaattttcacttttagtgactctttaaatcattacaataagaaacaaaatatccactatcaaaactatgccactcttaaagccttgggtttaagggccatattttattagctttatttttccattatctagatttgatgtctcaattaagcaatcaatatatacatatacaaacattcatgatggaaacataagaaaaccgactcaccaaacatttgattgatttacccaaatcgagaataataattaaaatgcaagtcttttaaactttgacatcccaataaacctccatatattgcattcctaatactagttttcaaggtaagaatatcttgctctgtgtccacctataatcatctagagtcacgctattgattaaaaattgagttgtatttgcaaattaagtaaatattaagagtatggattgaagcctgcacaaaaacaagatgaacttattgtctttaatcatttgaaatatgctctaaactatagtggctgaatacacccaaagcaattatattgcttttcttgaacttggtaaagaccaagagggacaaaaaaatgataattttcacaacaaaattccctcatatcttcttctgctgggtgacatattctagctacttgatggaagattgcagctataaactctgaggactcatgtcattaaagaaactcacattgtcaagaagaatcaaagatatacattttatataattaaatagtgtatctttgccatatcttctgctgcttactccttaaataagagtgaacataatatttccagatttgcacagctaaaataaaatgacactatgagagaaataaaacggatttttaagatacacaggtacatagtccattttgaaaatttcacaacttagatcttaaaagtaaagtaacaaaccattcttaccttagaaaattgtgcatttacccattttgtgaatgttttcttttgaacatcttctctttcatctaaaatgcaaaataaaaaaataaaagttaggaagcaactttaaatataattcatattttacaaccaaagtaactttccattatgatgtgttagtgtttttttacatttagtattacattcattgataaatggaattaaacatgagtgatgctggtttggggcatccaaattaaaattacttctgaaaaatggccaggcgcggtggctcacgcctgtgatcccaacagtttgggaggccagtgaggacggatcacttgaggccagtagtttgagaccagccaggccaacatggcgaaaccccatctctactgaaaatacaaaaattagccaggcatggtggcatgcacctgtaatcccagctacttgggaggctgaggcaggagaatcatttgaatccaggaggtggaggttgcagtgagccgagatcatggcactgcactccagcgtgggcgacagagcaagatcccgcctcagatttgtaatatctgaaaaacaattaatatgaccaaacccatagtcgttcaaatactgtatgattataaaaaaatagtctcctctgaataacagtatttattcgccagttatgaatagatactccagtataattaaaagaaactctcagctgtcatttactccgaaaaactatttcggagcctttccccatgccatccacccaaccatggagaaatgattattccttcctttgcagcatctacatactctaacatgggcctgatctcactatggaagaggtttcctgatgagcaggagcatggtttagttatctttgcttcccagaacttagcacactgtctgaacaaattaagagctcagaaaatacatctgacaaatacgtgcatgctttaaggaaggggagattctacaactctaaaatttctaggacctcttttcatctaaaagtcagaacatttcaaataaaaatgcaaatgatactcttcatgccttacatataaatactcaaagaaaaaagtccccaaagatttatactaagggattagggagaaaaattattaaaaaacagcttcactgaattcatgcttctacaaatgatctttttgcccctaaactggaaattagtattaagtcaaatggacagaaaaatcatcaatcttgatatattaaaatgtttttctccaagcaaaagactatttttttaattattgtaaatataatcatattagttaatgttcagtaaatgaatgcatctgagagatatttaaaattgataaattttatattttatctacttggattaaaagaaccgttattaaaatgccctttacaaagtaatcatatttgctctcatatatttttcagtagtaaatctccgttgcttctcttaaaaacataaggaatcactttcgcataacaaatatatgcatgcaccaaaaatatctgtttatctttaaatcacaatactaatctataagtagattcctttagtcaatatgagaaataacagtgaataaataaatttcaaactgtcatcttaggtgagaaattttatttagcattacaaaatacatttttcttatttaattatgttattcacacaagcttctatatgtatgttcaatatcaacattattcatatggtatatgataaatcttagctacaatatggaagtatttcctttgttgacaagggtgaataaataaaaacagatagtaatagttttcaaacctattctagcctccttcaaatctttactttcataaaattaatactagcccttccaaaataattttaaaaagaaatggaacatttcaaatggtcaaaattaaaccatcttcatagactttatggaggaagattggtcaacgcatcatttatcagtagtatatacatatattcctaaaagtaaatgaccttatttgcaattccacttatatttcctacatgtgcatgcgtactttctgtcagaaagcagagagtaaatgagtcagttgaaagcatacattcagatgtctttgaaacatacccaaaaccctctgccaaaagctcaatatgaggtcttttgaagtgatttaatctagaggcttttaagtgaaaaatacgtagtagaataaaatttttattcttttcaattatatggacaaggagtaatttttaggtaagcatcgaaggcagcacgaaaaccttgacattatgtgcaaagtgttacttatttactgtgtaaataacactaaatgtgagcttcaacatataaacatctttgctagttgtcctctctcacctctacgtctttaatacaagaaaaatgtcttcaatgaattattgtcttattttggtatagtagcatatattttcttcaacataataattattaatacaattaattgtattattattataaaatacataacaattcttagtgccttactattcataagtttgttttaattatgtcttctcaatctgtatgtaatttactactttatacataaacacaagctgagaaggaataaagctattaagtgacagaaatgaacttgatacagattttctgaatcaaagtccatggcttttcacattgaccagatatctatcatttacattataattgcataattaacaatacagaataccataagataatcagagtcacaaaaggtgaacatattaacgcaaatgcaaaacaaccatgaaatcagagcttctattttgaacaactcaaggaggttccatgtatgttgtaacctatgtgaatagcgtcctggaatttggcaatgcataacttatttgtctgtatgaactgatctagaactgaataatgagccttctttaatggtgctggatgatatggttgttaatacttcaaataataatgcttttacatttactaattgatatttggtatttcaattttcgtcttatatatcattatggaaacattttaacatccaaaaatcaatcaaaatttttgtgtccacacttttaaattccccataaatacatatttcttataaccaaaataatattctttctttttcacttattttatcataaatctcatataagctgctctttccttttgtttgctattagagactaaatcacaataaacatgctcatgcactcacttcttttttgtttttataattgtcttcgaaaaaattatcagttcaacattatgaaaacctttatgacttttgctaaatatctttataatactttccaagtgatcacacccacttctactggtagcagaaagaatgaggttgggaattatcatctcagccgcaggtatgtcattcataggagtttcgttgctttagtcttttacggtattgctgctttgtttagatgtaaggagatccttgatgtttgctttaatcataattaatttgattactaatgaagtagaagatgtttcatgcatttatttattctgtatgttcctatttttgtcaaaatacttgtttacatcctggctcatttatctattgagcatttaatattttaaaattaattggaatgagataattatatattggtaattcttaaacatttcaagtcatgggctccatttgattatctgatgaaaataatgaaccttctctatagaaaaatgtctacacatacatatttgcatatagtttcatagagttcactgacctccttgcagaaaactcctataaccataaaatccaagttaacgatcaaaattaagctactcacttttagtcagtgaatggacatattttcccaagtggtcatatgccttttaatttttattttagtatgctaaaattttatacgtatttacttgaattgatatatttttattgctatttgtcatattgcttaaaagttgactattttaagctgtatacccttagttaacctaaagccaccatacatacacatcacacatatataaattgttctagaaactattttgatacgttaacatgatgtctatttctgtagtcacatagtctatagtaaaacatattaatgtgcaatcagcaacaaagcaaatgagaaaagaataaagtgatagctgttttattacaaaatgattatatgctcctgtttagtcatttcaagcagcacatattctatttcatttcctttagggtttgtttataactgattttattttactaataaaaacatgcatgtgcatattaataagagaggcaaagaagaaaatctctcttaggaaaatttacttgaaaactgttccctggagatgtcaagaagtgaagaaccactacttcataaattgcaaaaactgaccaacgttttattttattctctctacggggaaatcccatataaaattagctttctaacatgacataaaaattgtatttcctctcagtaatctttaaccccttctaataaagttatttttattcagtatatgtggcctttcatattttttaagattagtacaatgaacttttaccctgttattaacttttatattccttagtccctcaggaatataaatgtgggatatattaaattgcaatattcttgattcacaagagcaagttactgcagaagaatgatactgggcaaactgagggaacattaaatctgtggaactggcttccagtggctttgcaggacttattagaattgtggccttaaaattgccaagccttagcgtctttaactgtgaaatgagaatattaattgctctttaactcatggagctattgacaggatataatgagatcatttactcgtgtaataatttataaaataaatatttacagaatgcttactatgacctggacattgcactagttactgaaaatataaacaagattcagtctgggagagctcttagcctagtagataatagacacatcatagataaatatgaaacattttgcataaacaaaaatatatataaatttaaagcgtattataggagcatggagaaaggaatatgtagccacatgggtgttagaaaagatattttggagaaggtaatgggtaggttgagttcagaaggatgagagaaagtaaagaaggaataaaggtaggaggaggataaagatgaatctcactgagcagacagtaaggacaaggacagagtgataagaaactgaaagtacacgctcattcattatgcaattctgttttgttgcactctaaaatgtgagaaagggagtggcatggaatgaaattgcaatgagagttaggagcgagatgctggagagcctccttaagacctcttctctgccatcagataaacaatgtaagtgaaagcatttaaaaactgggggaaaaaaaaaaacagaaaaacagttctataaacactaacaattattcccattacacaaagcaattaaccataatctgtacaagaaaataaaatttttttgacacaaggtctcgctctgttccccaggctggagtgcattggaaccatcacagctcactgtaacttcagacccctgggctcaagcaattctctcacctctgcctcctcagtagctaggactctaggcacacatcaccacatctgtctaatttttaattttttttcttttgtaaagatggggtctccccatgttgcccaggctggtctcaaactcctggactccatcaatccttctgtctcagcctcccaaagtgctaggactacaggcatgagccaccacattcggcctagaaaaacattttttaaatgatatttccttgggggctagttaatatgttaattgaagatcttcatccctaatgtgacacagaaaatgtatctttaaaaggggaagggaatattaaagttgataccagtttagaaactcacgtagtgaagaaatgcaatgggatgagttaatttcacttaaagaaagaactatgaagccgggcgcagtggctcacgcctgtaatcccagcactttgggaggccgaggtgggcggatcatgaggtcaggagatcaagaccatcctggctaacacggtgaaaccccgtctctactaaaaatacaaaaaattagccgggcgtggtggcgggcgcctgtagtcccagctactggggcgtgaacctgggaggcgcaacttgcagtgagccaagatcgtgccactgcgctccggcctgggggacagaggagactccgtctcaaaaaaaaaaaaaaaaaaaaaaaaaaaaaaaaaagaaagaaaagaaaataaagaactatgaagtaatatgggagagcaattaagttcagtctattctctgcttccatcaaacatgagaaaaaaatgaaaaatatggaagattaatgataaacattagataaggttatgtgatattttggagcattataaaggaaggaaacaaatttaggacatatttagaaagtggatttactgtgccattaatattacaaaatggcagtgcagagtggaggaggctgcaatggaaaatggtatgaaaaatgctttctattaaatctgagtaatagtctttgattatgggatttttctaccgcctgaggtgacgttagtggtcagcttacaatgaggaggtctaaaataattaaacttctgcacgaagaacagaaaagctgttcatgtcaaagatatttctttatttcccattcgctttacagtcaatgtaatgcagtcttcactgctcatcatcctacaaaagttgttcttaataacatcacctacatcctttctcatttccaagagagtgactgtctggatcagagctgtaatcccagcacttagcatagaatgtgttacatagtagtgctcaataaaggtgttttaagttaacgaagaccagatttactttttagtcctcttctcatttttctcctctgcagatattaattctattaaactctggtaggcagaataatgcctcctcaaaaatggccacgtgctaatccctgacatctgtgaataaattatgttacatggcaaagtggaattattgcagatagaattagactttctaattagctaacttttgatagggagattatcccagattatctgagtgggcaggatttaatcacaggggtccttaaaaggggggaaatgttggcataaggggagaattagaaagcactatgagaaggacttggtccgaggtggctggttttgaagatgtacgaagaaggccgtgagccaaataacgtgggaattctctagaaaatggaaaaggcaaggagacagattctcccctggagcatccaaaagtacacagcccttctggcatcatgatttgagtccagtaagttccagtttggatttctgacctgcagaactgtctgagaataaatgtatataattttaagccactaaatttgtggtaattttatagcagcaataggaaactaataaattacatttcatatttaaggctattaagtgacaaatgtgtactgacacctactaggtggtagaaaaacaactgtgagaaaggcagtgtctctagcttttttccttctagcttagtgagagaagcagacacaacaaaagggtatgttgatacaaatatacagataagttgcctgatgaagaaactacagtcatgtgacaatcatatattaaggaaactaccttgaaaaatccagagcttccttgatgaagtgacatctcagctgagttttgaaagttaattaagagcagagagacaagtggtagaaaagagaactccagaaaatcaaaagagcaggtgaaagtgtcaggatgtgagagaaagagtatggtcctttcccagacctagagatggtggaggaggataaaaatggcagagatgaccctagaaaaagtgaaattatcatcaacctatttatgaagagcctgaaaatatagccagagggcagttcgaaatcaaagcagaattttaagtagggaaatagcaatgtcaggcttggcttttagaaataaatttcacagtgtagagaatatttggggataaactgtaaataagaagacacatgagctgattatacctataatccacgtgagaagtaagcatgacttgcattaatgaatggcagtggggctggaaaaggagtaggtgcattcaagatgtgtttacggggtagtattggtaagtactaattattaattatatgtggagttaggggagttggatcatggataatcaatgataaagctaaattccctgatggagaaactacagttctgttacaatcatatattaagagaactaacttgaaaaatccagagcttctctgatgaggttacaggctagattattcagaatggcatataagggccttcacaatttgactccagtgtactcctctaaacatattatcgattaggcctgttggcagtcacccatatcccaaaccttatatacatctaccaggtctgccttagtcacacaagccaaatttctccataaataaatcatatgctttcttgctttagtcctttgttcatgcactccctagaatgaggacactcactattaagatctaggtcgaatgtgagggttttcacaatcacacttatctccctggcataacttatcaatcaatccttctgatatatacatatgtgtaggcttttttctaattatgcatatgtgttacacacataaatactttaactgtatgtgtatggacacacagatactttaattgtgtgtgcattataatttataaagtgatttcaaatatctcatcttgcttacactcacacatacacacatacacacacacaaacagaaaattagtttgttgtcttccaataatgcagcccaaatcccactcattacctcctaaatgtgaccacacttagatgggagaattattatgtctttgcaactcctggcaccaaacatggtatactgaagcagaaataggtacttagtaagggtttgttgaataaatcaagtgactaatcaatactgtaattaaatctcagatctactaagtcctagaccaatgctttccccctgcacttcatcatactgctcaaactactctgttaattatagaccttctgtcaccaattcatttcctaaattatccattgagcacccattagacataaaactaactttcaatgacttctccccaaaatttagccttggaactgaaatattgctacttattttcatcactacaatgaataaaaaattaagagaaagaatatttcttgcaaacaatctgcctttatttctctaggtgaatttcactctgtaatatgatataattgccctttacttcatctttcatgactgtcatgcttctgacacaatgtaaaatgctatggatgacctgtctgttcctttgcctccactgcaaacgccacttctttctcaggtaggtcaattgcttttttattgtagggagttgttggactcagaaaccagattggaaagccatgtcagctcatattgaataaaagttctctcccattccctgccacttaatcacagaatttatgctccattagcaaattggagttatggtgagaacctaacataatcgcatagttgtatattcataaaaattgcaatgctctatacattggaaacatagcacaagtattgtagaaatatacttgtgaagaattaatcgaagttgcatgaagtaggacataatgacaatgagattgaagaaatgtattagagtggaagaatgatcagaactccaagagtatatgaaaaggtgttaagtggtctcagttggaaaaacagtgccatctggtagattgtgcaaacagttaattcttatcctcttaaaattgcatgtgttagatacaatgcaggccggggttacatcatacactcatttcagagtcaaataacctgagttccaactccagtttcacatctcattatctctgtggccttgagtaagttacttaacctctctgtgtctcattgcctctatttgtttcatggtaatagtaataaagatactgaattgtgaagactaaatgtgacacatgtatgacatattaatgctgagaaagagaaaaaaatagacaaaacctataaatctttacttccaaatatattacaacttcccgtgggtcttctgtataaatgacattatttcataaaatagacacgattgctacgtggcagccatgttaataattagtaggatttttatagtatttgtaaatatgcaaaaaattcaagtcttctcgatttgaaagataaaaacaaaatatgaaatgatattcacataaattatacctcctcatgctcaaaagaatgaagtaagtttttagtaataatggaaataatggatatttctgtggtgcattataatttataaagtgatttcaaatatctcatcttgtttaaacatgagtatgtgggtgtagacttgttaggagtaaaaataagttactattaattagtatgcagacttgaaatgtgctttggtagtgttcatgagaaagatgacttatttttgttaaagtaataaccatagactaattatgacagaataaatcaaaataaggtcaaggtctccagtgtaatttagaggtgaaattaactacttggatattgtagcagaactgctaactagatgcctgtttccatacagctgcctactcaatattacttttaaaagattcaaattctcccctgaaaatttaaaaaaatacattgttctgtggtgtatatttatctatttttatgggttgcaaaatacttctttgcaaaccaaaaggaaagcaaacagccaaatgtgcacgacacacaacagccatttccaaacatactgttaatgagatgctttagaaacagacaaatggtcaaacacagggcctggattataaggggatatttaaatcacaagatgtatttactcaacttacactatggagtaaaggttaataaaatggcatagtagatgaggataatgcctcatcccttatttcaccgagccatccctgagttcacctataactatagtgaacggattctgtggatgctgaagattcctcaccacaagcatccacatctctctgtttctttgtgttaaggctttcttcagtttaggagggcttggtaagcccatttgcagggcagtccagaagtgatagagatttagttctcccaggggcaaccctcaataaacgagggacagaagtctatgtattaaaaaggacaaaaaaaaaaaaaaacaatggaacaattgctaagcatgccctgtagggctcctcaattgttgcatgggatatgtaatccagaatggcccataggagcatcgttattgtctgctctctgtagtggaatttgggcccacatttcttggcttgatcatgcactagttatgcagtgttagaaaagactcataggccgggtgcagtctctcatgtctgtaatcccagcactttgggaggcccaggtggacgcagcatgaggtcaggagttcgagaccagcctgatcaacgcagtgaagccccgtctctactaaaaataaaaagattagccgggcgtggtggcggacacctgaaatcccagctacttgggaggctgacgcaggagaatcacttgaacctgggaggctgaggttgcagtgagccaagatcatgccactgcactccagccccgacaggagttcaagactccatctcaaaaacaaacaaacaaacaaacaaaacaaagaaagaaaagactcataagccacaccaaacccaagatttccagtctgaaaagaggaaataatcgtggtaaaaaaactcttagcttcactttgatgaggtatcctgtaaagcatcgaaagtagtcttaagcaaagacttagtacaaagtaagtgccaatagagatcagtattattattcctgactatatatttaattgcattagaacttcttgaacaagttggtagtttacattatttgctcatcggtttctttttcttcctcctttccacttgccatggttcaccatgggtggattacacatcccactcactgatgtggccttggtcatgtgacttgccttgaccagtggaacacagtcagatatgagagtgtgtcaattctgagctaggggcttaagaatcataaagtgttttcacttttcttggtccttcctccctttgtcaggggaagtacacgcctcaggtagcctctgttcctaaaaggagagatgcatagagctgacctgtactcaatacaaaattgaacctgacatgtgaataagaaataaatgtttgttcttataagtcattgagatttggatttgttttttacagagcattagcctataataaagctgactaatatagcaggtaaatagtaaatgtggcccatagaataaaattcaataatgatggaatgtatataacctcttcatttaaaaaagagagggttgtattccatcattaaatttaaaataagctgaagaatgggttttaaatgaagtattaaaagctttccaaaaattgccctttcagaatatattatcttttaaatcttggtctttctccttaccataccattcaaaatttaaacattaaaacaagcaggttgttctcatacatggccaagtattagcacagacagaaatcaatgtagaaaacaatttaagtggaaaataagttttaaggaaatgcagtgagttattgtaatagcaatggtcagtactgagcctgctcatttccaccttgtgccaaatactgaaagcacttaaaacagaaataaagtttcggagtaatcattcactccctgttcaccaaatacggaagtcttaagccagtgtttatgaaagatcaagccaaaaattataaataggaatgaaggccaaacatgttttcagcactgacgggaaactttgcagtcagtaaaagaacattagagtcagtcttttagaaaagggtttggaaaattattactgagaatacaaaagaaatcctgggagctaatcaaaagaggagacagttttgagagttaatcaggtgccaatgctaatagattatccaagtggcagagcaaagaaggtccagagtcacacaatcaatttttattcagcttgagttgctaatactgatgacaagtggttaacgactgcttcttccaagattcttaatgaaagacttctcttttctcaggtttattatgccactggattaaaaaaggtatttatttctgtactaagatcggtgacaggactacaccgagaacacgtccctcagtgtacattgccaatagatgagttttgtctatatcttgattgactaatcatttaatagatgtgagtgtaggttggcatgcaaattaagtaacttttggccaggcgcggtggctcacgcctgtaatcccggcactttgggaggccgaggtgggcggatcacaaggtcaggagatcgagaccctcctggcaaacacggtgaaaccccgtctctactaaaaatacaaaaaaaaaaaaaaactagccgggcgtggtggcgggcacctgtagtctcagctacttgggaggctgagacaggagaatggctgaacccgggaggcggagcttgcagtgagccgagatcgcgccactgcactccagcctgggcgacagagcgagactccgtctcaaaaaaaaaaagctctcatactagccttattgtttgcacttaggtatcactgagttgaacttgtagaggaaaatataacagaattacaaaagatttagacattgtagaaaaaatttggatttttattatataaaacaaacaatagattttgaggttttaagggaattttctgtttcgaaaaacagcattttaagtatagttttatttcatcttcataaattgtaaactttattttaaattctagtcattacaaaagactttaagtcaaatggcaaattgctttcctctatagccaatttaaaatgtttgaatggttatctatatatacatatgtattcaggttgtgttcatatacatattgttatatacatacataagcttcatacatatataacatataaagttcatatatgcatgtgtataattttatattctgatatgaatataaaattcatgaattgtagcacactgaaaacattagtttttgattagagaacattaaaatgattgtaaagtagaatctccagaatttccaaagtttgtaaattgaagacattcgaattttctaatttaaagatttgatcattccgagcgcctactaaacgaattataaagggaatggctttcctgaattacagtaatatggtagttttagctttgaacctgcctatctgggttcgaaaggtagttctgctacttattaacagtgtgcctctgtttcctcacctgtagaataatgataataatatcggtgtagctttgtcatgagctttggatgaatgttcccacttgaaccctggctctaacactaacttgctctatgggcttctgttaatcatttaattatgtggaatacaatttcctcaactttaaaacatagaatttggaaaagataatttctatgtgttccgccagttctaaaactctatcatctgcttctttattctaggtttttgtttgtttatttgtttctgcaggatgcagtttacagtccttgttggagtatgctctggaatcatacggcctggatttaaagtccagttttgccgcttactggctgagttttctcaatttatttacataacttttctttcctttagttttctcatctgtaaaataggtactaaaataataactatctcatagtgtcgttgtgaggactaaataagccattatctttatatggcatagaaagtgtctggccccaaatgagtaatcaacattgttattcctatcctgaaatctatgggctttcaatacgactatggaataaacccctaaaattgtgggcaaaattttatgagtgtgtatatatgagagtccacagtcatcagcagattctaaaagggctccatggtttgaaaaatgttggatgaaaaatatagacattattctggctcttatggatattaatgatctctgttttacttttttctggaacagtggcattaacagcaatagacctgtttttattatttttctttactttgcttttttttacatgtttatttaagagatctgctcttcatctctgtcaccattgtaccattctttttatggatatacacacagtaattggcactgaaagaggtataattatatacactgcagctatgccagagaaagccagggctccttatctggcctagggaataaataatgggttttcttcatattctcttagatattactcttcagccacctaggattgggcactatttttttgttgttgttagtttcttgtgcttccatatacacagatgcagtttcttgtcacccattatattgcaatgccctttctgaaaagagcccagcctttttctgtaatgtactttgacagtaagtattgacataatgtaatacagtaattggaactcagaaagatttgtttgctacctgactgcttaagatattttaatgccttaatcggacacatatttttaatgcacatttttctttagttagagcagcccatgtcatgaaggaaccactcaaatgtggaattgatggttttcacaggatataaaaaacatcatgccatacaagaaacaaatcactcctttctgcatagatacagtgaattcacagcttggaaaccagtattttcaaagcgtggtatgaaagtgtctgagaataaactctcagcagagatcagtagaaataaccagtaaccgctaaaagaggaacattattgattggcaaagtaatccaaaaaagagaaaagatgtgtgtgaacttaatactaaatttagacaagtattcattgattaggaaatcaaaattcaagataaagaaacatcttcagagattaaaagtagtctttcattgtttgagtaacctagctgaggagtcaaactaaaaccaatagattgtaattagtatgatgctttaggataaagttgaataaagagagcgagagagagacagagagacagatgcattatttaccctgatgtttatacaatgccaaggtcaattaatttataaattaaatttatgtttattagccaaattttagaaactagagaaaaagtgagtattaaaagctttaggatttaaagtttgatatatttcctttgcattttccttgcataattgtaattgcattgcacaagtagttagacaccttactttcttcatttaaaataacaggttttccaatgttgttcaaacacaatttaaatatctagaagcattgtcttctttgttcccataaaaattaccgttctgcttttttttggaaccttgaaaaatggtctcataatttttgctattaaaatagtcttgcaattactatcaatatagataaagcctccacccaaatgtgggattattaccttagaaaagagtctcaaaaattataatggatttaggtgaaaaatcatctccgtaagttttggtacatattttcaaattacttctcaaaaattccatattaaaccacattcctacctgtaatggatgaaaaggtctataacgttgcattgtaacctacattgaatacattaaatagaaatgtaattcatatgtaattcaatgtaattcacatatatgtctgtgtatgtctatctaaacatgaatgcatgtgtgtgtatatatatatatacatacatatacatatacacatacatacgtatgtatttaaagaatttagacttgggtcttagaatcaggctctccctgaatccttcaactgcgagatataaatataagggaatgttggcaatcatggtctgctacatgaggaacagcggaagccaatctgcaataaaaaagatagtttagagagaaggagatgtgacagagagtcctggaaggttttgattgcattttctgaggtgtactgcaatttgccctaacctgccttgagaaacattttaatccttagaataaacgtatcctttggaataaattccacatttgataaagatagttcaaatttggtataagttatttgtagccaagtgtcctaattaatactcaagtaataagtagtttactgcttaacagtagaattagttctatttcatataatttttccatctctcattcagatgggaagttgctctccttcctcttgtaaggtcatgatgctctatatctgcaaactcaagggagaaaaagtctcttaacttgaaactatacaggaaaaaaaaaaaaccctgatgtcatttctagtacttaattggtatttatctgccataaacacatgaagctgttttggtttgttcagttacccttgtctgcatagggccatttaaacccaaattggaattgtctctgggttactatcagtgataacaagaactttcaattcatgccaattataggaattcacaaacacagataggggtgaccaaggaatccaaccagaactttctgtttagtttcattagactcagacttaatgagaaaaaaaaatcattagcactgaaaaacttgtaagtcttgtttagtttcttgctgaaatttaaataatactgattgtgtctgtgatggaaactggtaaagaataaaatgaatatttaatttagtaaggtatacaaaacaaaacatgagagggagcatagctattcctaaatggaaaaataaattggtatactacaataggaagtatgatttccttttaatatgtttgttttatagaagttactaattgcagaaaccattttgatttaacatcatcaataaaatcaatgtgtgaacaatatcattacattcgaaagatgacatgtctaacaaaatggcactatcaatatatatgtatttaaagacagtctccctttaactttgctagacaccaaaagtttaaatgcacaatgccaagggcagttaagtgtcaaaatacaaatgtatcttaatattttatttaaggcttctattgttaaaaataatgcatctaacataataaagagggtatttgaaatttcatatttcaatatccccatggtttgccatagaagacaaatataaatacatgcatgaaattgtgattttattttcttggttactttttggttacagctcatcactttgcattagtgcatacctccaaacctccaataatctcatatgcatcattataaggagatgaaagggattaagaaataagtttaagtcagtgcatagaatattaaaagttcctttgcatctaatatgaatggaagtgattactattaatataaactcaataataaaataagcaaatgcctgcttttattttctcctaattaacaagtttaatcctttgcacttaatgttagttgtttgccccggagcccggcattggtagacatctcactgctcatgggccattcttgtcaccttgactcccagctcaactttgggatggatgtttcaaaccacctgcctcgatgtgttcaaactttgtgtgagagcatttttgaaggaatgtaattgagtatgaattatgtgacagtagatatgtgaattttgactgaaaagttttgtaaaacttgagaaatgaaccttttggctgggcacggtgactcacatctgtaatcccagcactctaggagctgaggtgggtgaatcacttgaggtcaggagttcgagaccagcttggccaacatggcgaaaccccgtctctactaaaaaacacaaaaattagccgggcatggtggcatgcacctgtaatcccagctactcgcaagtctcaggcaggagaatcgcatgaacccaggaggcagaagttgcagtgagccaagatcgcgtcactgcactccagcctgggtgacagagcgaggcttcgtctcaaaaaagaaaaaaaagaaaaatgaaattttttcttcaattttatagtaaatgaagaaaacatttcatttctccgaagactattttgattgacacccgtagcctatgggggtttcatattccctcttttccgttgttggagatatcatggtttaaatttttaggaagtatctcaatcattcataaaagtgtgagtattctaagttacttcaatgagatacaaaattttggagccctgcttccatgtttcaacttcaaaagtagaagtcagttcgaactccctggtgactgcacttgagaataaactatcagtcaataccacactccttatcttttctttttccttcctacgcccaccccaccccaccccaccaaacaaacaaacaaaacaaaaaggccaggacagcaggttctacacttttgaatgcaattttggacagtgtgccaaatctcagtttcaacatcacaaattaggtttcacaaatggattctgaatatacaaaatgcttttgagtcaccttttttcttcacctttaaattaaaagctctgaaatacaatgaagtgttttcttcagcttttcatgacttttcccattgggtgattcacagataacaggtcctcaatacatttttattaaattcaatttttaaaatatcacttatctactacggcctttctctaataaaaataagtattattcattgtttccatctaaagtaagggtaactgtaatgattaacatgtcgaatgtggatatcccaagagggtaaaatacttacgctttccatcataatcaagttcctcttctgcttaggatgtaaaaatgctatataagaacgttgctccacccaatgagaaaaagcagggtgatctataaaaacgtattattttttgagccatttatatagctgtggccacaaggcaacgaggtgagccaaagtacttcaatctcctccaaggagagactggatacatgaaaggtttacctttggcagggaactggaggaagaagtagtcatcgtaggagcaggaaaaagaaaatagctccaattgtaaggcattcttaaaagtcaggtgtgggctggtatgacatttcagcatccttggaaatgcagaccgaaggagtctgcactcattctggaattcttttccacaaacttctattgggaacttgcaaaaaagtaaggcgtaggacaagagataggaagaagctcccctcagtgacacacaaacatgaagtcaaacccattttccagaccctcctcttctaaaaggcgtaagatttaaggaaagatactaaactgaaggaaagatactaaactctaccacccatgggacccgcctgttcagaggggttggggaaggtagaagccactgagagagggtcaagataccctctttggaagagcagtatgataacctctttggcccaggattctgcaccaataaaaacagaatgatctgttaccactaggggagagacaggcatataaggcttgctgaaaactgaggatggaacaagaagatagaaatccctttaggaccgcagacactattacattaagcacgggatagcagcagcccatcagtggaggtctttgaagactgtagtgttctgaaggttgctacagcaacaacaacccccgcccctccaaaccagctcaatactaacaccactgactcaaaccccatactagcagtatgacagaaaaaaagctatacctatttccaagattaaacatatttacctcattctctatttttcttctatacatgacatctaacattcactaaaaagaaaatgagacttgcaaaaaataaataaaactaagcaaaatacacccattatcaagaagtaaagccatcaacataaccagactaagagataacctatatgcttgaactaacagacaaggactttaaaatatctctgactgataagataaggaatagattcatctagatactaaagaaaacatccaaaactttcacaaacagatgggatgtttcagcacagtgatggaatctgtaaaatgatgcaatggaattgctaacaataagcaataatcaactcaaaatgttaatgtagcaattgcaaaattatttctattataaaaaatgttaaattacaaagagaataacagtaccttaaaatgacacataatttaaaatactacagatgttaatattggaaaaattgtttaccaatgttcacacctgagtactcaatcctttgatggaaggtatgacactataatgatttattataaaaactccttaagtggccgcgcagcctgcgcatgcgcgccggcgaccaagcctaaatagctaccgcctctgcgcgtcgccctccacggttaccccggctttccgcccctccttctcgcggggctcgagggaccatggccgatcctcgcgtgagacagatcaagatcaagaccggtgtggtgaagcggttggtcaaataaaaagtgatgtatgaaaaagaggcaaaacaacaagaagaaaagattgaaaaaatgagagctgaagatggtgaaaattatgacatcaaaaagcaggcagagatcctacaagaatcccggatgatgatcccagattgccagcgcaggttggaagccgcatatttggatcttcaacagatattagaaagtgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgcggtgtgttcaagtagtatgagaatgtgattgtttttatctggttacatatatatttctttgtctaatttaatatgtcaaataaatgagttcatctaaaaaaaaaatccatacgtgatgtgtggtttatatttgtaactgcctatatgatatatattcttaccccaaccccatcccatcatatagataagaaaatgctacttatgtgctcaggtttacacaactcttagatgtctctgactacaaagtctttgttctttttaatgtacctctatgcctctcatactttaaaattgaaataaattaatctactgctccaaatgatcaattttccatggaaaaaaaagagaacttttgtaattgtaacaacctctgctatatgactaaacactgagccatgaggtgggctgccaggtaaattggaaggcttcatctaaaaagtacaagactgtgaggcatattcccttctcaacagcctaggatgattggatctacccattctgtcacattttcaatatataattcctgttcaaactttctattaatatatcatttcaagtttcattgatagtcctaaaatgcaacacaaaagacgagcagatgatttcagccattccaatttgcagccttttgtagaggggcatcaatagattttactgtacttgcataaagccctagttgttcttttcctattctatcatttctggattggcgaatgggataaaatgttcaggaaagaaaaaacaaatctcaacacaaacgtgaatgtcattgaaagctaaaaaagtaaacaaagttaatgatcacacccgtaagtgctactgatttttcattgaactcagaggagaaagttactggattcccaaaagtaagtgaagggtatatgtttgctaaatgcattcacagcctgttgctctaattatttgaggttttttatgtgttgttgttttagctgttgtttgtgttttttattctttctgcatttttcttctactgtacagttgttattcatgctatgagttatctaaagtttacattaataatcaaattccttgcaccatcccaactctgaaacacacaacttggatggagattaagactcattcaggactcaggcagacatccttagtacccagaaccacaacacagcacacacgaatgcatggttctataattattttatggagcatctatgaatttgctatgcaccggaccctgggaagtcaatgtacagtggtcaacaaaaacaattcaattgtattaatatttagaagccacaaaatgcaaatatattcttttttaatttgaagcttgttattcttctgcacaatctatagctcctattagaatcattaaagtacattcagcagcagtaacaaacgaacagggaaaatgtgaacatgacaaaaggctgccagagtaacacgggtgacaaatgtgggaacattttagaattcccaatttcccactctaataaaataatatgaacaaaaaggctttttttagtagcttcaactgaaactatcacctgatctatttcttaaaatcctcacgaaggtttcactgaaccattagaggtttgggcagtcaaacaaattaaacatgaaccaatctttttagaatgactactgaagtgctcagtatttccagccttccagttaccacagtgaaagaaacaaacaggtacttgtcaggtttataagggaatgatctattttctgcccttttttgcctactctttaaggaaaacacacacacatatgcatgcaagcatacacgcatgcacaagcagaacacaaatttagaagctatagagaaaataaatagaaaacaaagaagttttgacaaaaccaaactgtctttacttttagattataaaaacaatcaactcttttttttattattatactttaggttttagggtacatgtgcacaacgtgcaggtttattacatatgtatacatgtgccatgttggtgtgctgcacccattaactcgtcatttaacattaggtatatctcctaatgctatccctcccccctccccccaccccacaacaggccccggtgtgtgagggaattagaattttgtaattcatttgggtagaggagcaaaaggtatatattaggctcaacttttcagtcggtgatgagagacaaatggcctgccatccctgccctctctcacctaccccagttaatctaaatctgcaaaacgaaaggagcttccactaggccagaggggctgcaggatgggaaaacaatcagaatggaacactttcatgggcgttcctacagaccaatttgcttccagtcagcccatttaatttcatatttatgattgtttaaaagagagagcccaggcgcagtggctcatgcctgtaatcccagtactttgggaagccgaggcaggtggatcacttgaggtcaggagttcaagaccagcctggccaacgtggtgaaaccccgtctctactaaaaatacaaaaattagccgggcgtggtggtgcatgcctgtaatcccagctactagggaggcttaggcaggagaatcacttgaacccgggaggaggaggttgcagtgagctgagatcgcaccactgtactccagcctgggtgacagagcaagagtcagtctcaaaaagaaagcaaggagggaatgggacaattcataaaagcaagccccagcagttctagttaactgtgaactgaaccagtaagatgcacattgatttaacttcggaaataatttatgtgctggtttcttaaatgactgctacatattgccttcttacctgacgatggagtgcagaatatggggacaaaaataagagcaattccaaggaaatgctttatgcccgagtgctaattcagaaccatactgaaaaaggagatgcaagagaatgctcagcgtagattctaggccatccttaaacaatccagagctgaagagccgtattcagagataaatttattctgcgttcaatgtttcttgacctacttctcgtaaggaaaattctgcctgaataccagaaggaattcatttttcactttagcttgaaatttaccttaagataaaacacaatagttgtataaaaatatgccttatttggttatgcatataaagcagacccaagaggatttggggtaaaatatttcataagttgtactatgcatgaatataaaaaatgagaaacaaaaggatagttagtaaaaggctgttcagtcccaaataaaggagtaattgttgatatgctaaataaaaggggggtggggaaagtcctttttttacaagggaatgtgaggaagggaactcacatttgttgaggctgtattttgcatttaatcctcacaactaggctgagaacaaacattaggcattttatttcccatttacagattgtaaacctgaggcaataggattagttgcctgtgataacaattcacatgttgagaatcataatattataggcctccaccacctaacaatgccatcttcagaactacacacacacaggtgcgtacacacacacacacacacacacacaagtatttcgtgagattgtaaccacattcttaagttccatcctttgcaagtaaggtaagttaggcactgtttcctcactgccttagggttgtttataaatacagagctcttgaattacaaaatcaactcttgatttcactgacagaggtcaactgcttttagtgtaagtgaaccatgattctggcataaacagatatagaagaatcctgtttaaaagtttttacctgctctaggtgcctaccaagagaagaagagggggaagttgagagagttacagataagtgagagctagaagccgtgtgggggtgtggggagggtcctgaccctctgacacacacacacacaccttttcaaataagaggaacattataatgtcctcttagggaaccaaagtcctaaagaagagaaggaggttctggagctgctgaaaaatagtgcccaaccagagcaaagggactgggcatgtagattagcctcacaggggtctgagcatctcatcaggtttgtgataagcagctaacatgtgtcggtgcttgagaaggtcatggaagttaggaggagcaagctggcagtctttcaagggtgtggtaatcaggacacagacaccccaaatcctggaggcagaataggcagttcaactaagggcgggatgcaggtactggttcacttcagccaatgcctgcatgcaaagatcttcttccccacagaccacattggatgtcacatctctgtgtgtccttgacctagaatcagaagttggccctgatgccatgaagctaagtaatactcctgtgttattccaatcctagagtggaggctagagtcctaacaactcctgaatgtgaccggtagacctgaaaagtcactgaattttattaagatttcctgagaatggtatattaagaaacctgttaaattaaaagaggaaccaaaatagaaatttaatttagctatagaaaaattaataaaataccatttttagcccacttaaatttgtgtgatactgaaatttttttttcctgctacagatgtataatttagtgcaaaggtgtagggcccaaggcttcactgtgaggaatgtaaatgtgctccccaaaataatttatgattttgactaatgtctgcacaaaatactatagtccataacaggtttcaaatcttataacaactattaatactatcaacatgtagaaataagaaaactgaggcttagagtggttggactctatccattgattgcccaggataacatcaagtgactgactgggggctcaaaattgttctcctgattgtaaatatcaatcctgtttcctatacttgtccatatacttcctgatgcctatttggtgctcaataacttttagattgagtaaaagaatgaacaaaaacatgtatttatttagtgcccggaaggggcatagcaaataattgatatcctttcctatctcacatagcattcagtacagcaaagtaagcaaaattgaggagggaattttaataatgttgaacatctacaaattgctagacactgagatttttatgcactttttaagtttaatcttcgtgttaatccacattacatatgaggaaatggagagagaatatagtttgtcaaggtaatggccatagtccatataatttgagtgcttactatgtgccacctactaaacactttaaacacatgaacatacttcattttcacagaccttgtaagagaggtacttctcttgaccctattgtatggataggaaacaaagcttagcgaggttaagtaactgcccaagttcatatagctactttgcagtagatgagcacaaattgaaactcatgcttctctaactccattattaacccaatagcaggtgctgaaaatcactgatcgtgttgctgacaaaggagagtaaacaatagccacataataatactatctaagggaacattactgatgtacctagattttttaaactttcttttatttatgaaaataaaaatgaatatattcgattgtattttcattcttccctctgtttgtgccactttaaacactggtgcctcccttctctttgacccaaatactcaaaacaggtcacacatttaaatatggcaagccctccagccctgcaaatgatggactataaaatttgtttgtactactggcgatttttttttaaaaaagcttatgcacacctactttcatatttttaggttggacagtaccttagaaataaaaacaaaaattaaaacagatctttatcttttaaaaaatctattttccaaaaggaaacaaatgaattatttttgtcttattattaccatatagcttaaaaatcaattacctgaaatcattatcattcaaatctttaaaacaaggcacttaaatgtttaatcttttttaaaaacttagccaatgcaaaactgctttcctccaaaacgccctcagaattacctgcttctcctgcactcttagtatccccaagttattggcagtgaataaaagtgtaaaggaaatgaatcttgcaattctctgtgaatttcattccaaaaaagaattttaggcattttgatgaagcgatgtagggattagttttaaatagggatctctgatttgtgtattattttcacaatttgtaaacttactttcttccaaaagtgatttgaaataaatattctgaaacactgaagatcaatggaagctaagaattagaaatgcttatacaaatctattaaacctaactgtatatatgcatataatatttttgttaagaaacatagaattctttagaataattcaattttatataattatggatacagacacatagattcacattgtaatgtttattcagattttgtgtttatttgttgattgttcaggcaaacggaaactgcatttggtgtcaacagttgcatttctttatatttatattagctggttagctgtgctggcagaactaaaggaaacctgtccatagagccttacgtagtcgtaactacaacacaatcatgtgtcacaaatttatagcacagcagacctttacactgaaaattgtttagagaaagaaaaattcgactgggagcggtggctcacacttgtaatcccagcactttgggaggccgaggcgggtggatcacctgaggtcaggagttcaagaccagcgtgcccaacatggtgaaatcccgtctctactaaaaatacaagaaaaattagctgggcatggtggcatgcacctgtagtcctagctattcgggaggctgagggcaggagaatcgcttgaacccgggaggtggaggttgcagtgagccgagatcatgctactgcactccagcctggctgacagagcgagactccccatctaaaaaaaaaaaaaaaaaaaaaaaaggagagagagagaaaggaaaacttgaaaaatgaatgagaactggtaaacaactgcagggaaagtaattaccacactcttcatatggcaaactaaagaaagggggcaccgcaagaaaagtattgccagagcttgaagggcagaatgtgtaattaggatgtgatatctggcagtggtgattccaatcattggggattaaaactgtatctcaacttgtgctctttctgttgctttagggccagtgtattcactcaatcttccatgatatctatatggactcactgaacctcagatcttaacttcagttgagcagaactagtcttctctctctcagaccaaggaaggcataacttgtgttccatgaagcctactgtgtcaagtctgccaaatgaaactttaaatatgtaggcattgtctacttagcctgaacactaaaaagagtcctttctacagttcccaaggatttgtttggttgcaatgtttctaaagtcagtacagaaacttccctgaaaatggagctccaaacttatcacgattttcatcctggaatgtatttaggtttgtatccctcgacgtgcaccactcaattgacgtcacatactttttacctgaaatttatttcagtttctcagaagactgtatatttccccagttacagattttactattccttaaatatggtggctgccactttcttaacctacagtattaatggcagaaatgcttagatttataaaaggcaaacatggggaaaagagagacaatattaaattcaagtctctcgaaaggaaaggaaaagataatgaaaaagcaatgtaaaaaatgagagataggtggggcaggtttaagatgccattgaatctctgcatagactgcctttttttttgctctaaatactaaacttgcctaaattaggccacctccctccagagaacaaaaggaaacttggccactatggaatagtaccaaagtgaatttttagaagctattattacccactcataatctatatttttgaaaattaatatatatgtatatttgtaattatcaatattaatacgaagcaatagggtcaacatgaacttggatacttctgttaagttcacttaaatattgaactaatctaatcacttctcattttttctttaaccaaatatgtaaattcaatataattgacttagttctcaaattggttcaataaagtgttcccacagtatttgcaaatatattcgtctttagaatattcctccttaacctttttaagtagaaattaaaatagaaatattaaaacgtgtatttaaaagtggtcttttctcttaacagacatttactttttcttacatgaattggtttagtttttttttccagcactgaaaccattccaaaaaaaactgtagaaaagagtgaatatttattctattggatgtttgttatgtttgcataataactaattagtgaattgaggccaactttgatcaaaatgtttgctctgaatagatatttgctaataaataattttttcatgtgataagtgtgtaataataagttctctatgctgccttgctttgatagaatattcagacaacatttataaatgactaattcaaggaattaaaaggtcttaagtgccccagaatgtagaaatggaataaacatgtggtagtggtgagggtgggctagaaatgattaaactagattttttttaaaaaaagaagcaaaaataccgctggaaaaaatgcacgcagaataaatgtcattatgaaatattctgaacgtgtgtacttgattttccttcatcacggcttcattttgagacgtccaggtcaaccactgtcaaccaatcaatctctagcctctttgagcagagatcaagggcaacagcagagccttaatgatttcaacctctagccttcaagggcacagattacagggactgaaagtaaatcagtccatcacaaggcacttcagcccatagcccatgacaaagcttgattagaatggaaaagtgttaagccatcaaaaacaagacacagctataaggaaagaggaaatataaggctaatgaattttagtgttcataacaagataaaaatgtgtttctcaatacctgtgtagccatttagaaatctaaagagcaagaagaaaattatgatagaacattctgagcaatttcttcctcttttctcaagagcagaattgagatagacttagatgtcaagtctacccattcttctaggccgttctcagacccattttcaaaaaaacaataaatccaaaagccaaaagcaataaacttgtttaaatactgaagttcacatggtgctcatgttttcagaaatccacttacactttacacccataatgtaagtaacgtaccctttaaatatttaactgctcactaatgtttttatttgcatatcatttctttttaaaactagataacacacacttttttagcagatatctttggatcttcactatctcaactgacttttctttttttttttttttttgagactgaatctccctctatcgcccaggctggagtgcagtgtttcaatctcggctcactgcaacctcctcctcctgggtccaagcgattcttctgcctcagcctcctaagtagctgggattagaggcacccaccaccacgcctggctaattgttgtatttttagtagagaaggggtttcatcacgttggctaggctggtctcaaactcctgtcttcaagtgatccactggcctctaactcccgaagtgctgggattacaggagtgagcccctgcgcctggcctcaaccgacttttttagaccacaggtaaatgttagttttacttaatgattgtaattattttgatatactctatatggaaaataaggaaagtattttttcccttttaaaataaggaaaatatataattacgctctatttttttttttttttttttgagacggagaccggctctgttccccaggctggaagttcagtggcacgatctcaactcactgcaacctccgcttcctgggttcaagcaactctcctgcctcagcctcccaagaagttgggactacaggcaagtgccaccacgcccagctaatttttgtatttttagtagagacggggttttaccatgttggccaggccagtctcgaactcctgacctcaggtgatctgcccgcctcggcctcccaaagtgctgggattacaagtgtgagtcaccgcgcccgacctaaatatcctttaaatctagtgtatctatgtgactataatgatgagaagtcaggatgccttccctacagctaaacaaagacttttctgaaatgtatatttggagacccagaatttcaccttatttgaatgcaaaacacttagaggaaataaatcttaatagaaatgatttttacagcatttcgaacacaagaattgtagtttaaaatattgttctttaaagctataagtaaaccaatgtttccaaactgttttttctagagcaaaatttcctagaaccaaaataatcttgaaattttagattaaacaaagcaaaacagattaaatcacctccaagtttctcagaatcttcaacatacaaatggctgttaatatctcaaaaaggaataaaaactgtttttccaaatatatacgagaatgactttttttctcccctagaattagctattgatgccaagctcagtgtttctcatatagtttaaaacacacggaagtaaatttgctgttcccttataaacatatcctgataatatggaaacatttattcaactaactaataacaaaacaggcaacaaattaaaactgattcaaaggggaattcaagggactgaacacacatagtcacagaaagaaaaagaagctagaacaagattgctaagttagaaacaaaacagattaacatcaaaaagtgcaataaaattatatattttgagggtgccagaaagatattacttgtctctctactgaacaaaaatgtgtacatttatgtaaaatttctcagaatctaagccctaatcaatagtaaatactatagggtgactatagtcaataataacttacttgtacatttttaaataactaagagtataactggattgtttgtaacacaaaggataaatgcttaaggtaatagatgccccatttattctgatgtgataactatgcattgtatgtctgtatcaaaatatctcatgtgcttccaaattatatgcacctactatgtacccacaaaaaaattatcttttaagttagtactaagttatacaaagacgcatgtccctaacaaattaaactatctgtcggtagatcttttagacaatactttttagtatgataataaaagaacatctacttgttcttttgccttatttccaagttttagagtttaacaagcttgaatgtgtcataattactcatttaattactcacgtaattacttaagtgtcaggcattgtgctggggactagggagatgatagggaactggataaatgcccatactttttagaagcttactaatgagggataatgacatgtaaacaggaaattgcaaagtggtttgatgtatgttaaaacatagttactgtgggccgggcgcggtggctcatgcctgtaatcccataactttgggaggctgaggcgggcggatcacgaggtcaggagttcgagaccagcctggccaatatggtgaaactccgtctctactaaaaaaatacaaaaattagccgggcatggtggcacgcacctgtagtcccagctactcgggaggctgagacagaagaatcgcttgaactcgggaggcggaggttgcagtgagccgagatcacaccactgcactccagcctgggtgacagagcaagactccatctcaaaaaaagaaaagaaagaaagaaaacaaaaagaaaaaaaaatagttactgtgggatgttgagatgacacacaagagatattcctcctgtaacgtcaattctaggtatgttccaaaaaggagacatcacctaaatgataaactggagttagctgggtaaaaagttgaggtgggagatgacatttccagaagaataacagaagctagaatagtgacttgtatgacatgattagtacgtacaatgtcgttcttgagggatgggtgggttcggtgggtgggaaggggtgaatgtaaagagatagtgcagaggccaattaatggagagattggtagagcatcttatagaattcagatttcacttttggggcaatgagaatttggcataatgagtagcattatctgacttacattttaggaaaactctttttgataacaattgggaaagtggatttgggaagtttgaagaagggaacgtggcaaataaagagacaaggaatcaggaggctattgtaatcactcaggtgaaaaggtggtataaactaaggtaacagccatggaaacagaatgatcacatcagttaattgttcaacttacatacaaaccacaaatccaatcaactaatatttcaaacgtgcaaaatatgtttggcaggggtttattacgaatgtttctataaattatgtctctatacacatatctatacatatatatacatacacacctatatgcctatatatatattccatagttttgtgaaagtgatggtataacaacaaaaaatatattctgtcatatccactgatcacaatagactttgtgcctctggttattttgcaaatcatttaacaattagttttcatttaaaggaagtttataagttaaagtaaacataagacaaatttattcttgaatgttaagccctcagcatcgaggaccatgaaaatactgattaattagtgtgacgaaggaaaacattgaattaagtcaactagttattcagttaaatttattttgaagaaaccgcagaaggttttctagggggaagatgacacaatcgaatatgctttttaaaacattctggctgcatgtggaaaactgaatcacaggggtgggggaaattgaacatctgttttaggggaactgcaacaatcctggcaaaacatgatggctgatgccaaggtaatgttagaacagtgatctcgagggagaatgcaagaatgatacccccaaacctgagaagtttggcacatgatgtctttcaatgagctagagaaggaggaagaattgcttagaaggcagtttttgatctcatatatactgattttgaattaactatgtgacatacatgagcataactgatgggcagggggataggtctctagctcaaaagaatgattttggttggatataaaaatctgagggtcatggttaagagttgttattgctatggattttgatgagatcaagaaaaatatgttgattgagcattaagattgaagctcaacgttaaaagagatttacgataggagagcaaccctccaagaaaatgataaagttgccctgagacaggaaaactagaatagtggaatatcttagaagccagggaagaagagtttttccaataggaaggaccgatcaacaatcaatactacagagtggtaagatgaggcctgatgtgacttgggccgtgacaaaatcaatttcagttgaaggatgtggaagcagccggattattggtgtttgaggtagctacgtgagtaaggaagtagatacaatgagcatagaaattgttaaagaagtttagcttcaggagtggaaaataacaagtcggtaggagattaaaaactaatagcagaatgtcctatttgttactacaggcaacactgtattgcaagttaaaataaattagttaaacctgacacaaatgcctgaacgcaagaaaaaaaattaaagggtttcttcaaccagacatttgtattttaagcattttattttggcaatcaattggggaaatgagatattttctcctcaaaggtaatgctgtagcagttataattgtattccaggacttgcgggctactattacaaatactcatggaaattaatgaatttttatccccctggctctggaggagtggctgaaagcaccgtgttttatagtctgacaaatttgggttctattcccagtatctctggataccagctatatgaccttgaacaaaatactgagcctctttcaaagcctcagttttctcatttgtaaacaaagcagtaacaatagctcttttatagaatcatggagaagaataaataaagtaatgaatgtattgtctactacactgtctctcaacctagagactatatcaaaatcccctgaagaacttcttataatacctctcccagaattcattatctagtaggtctccgcacagcccgagaatttacatttcttacaaatttccaggtgatattgcgggtctgaaacatactttgagaaccacagctttagcacatagacagtcacataacaaaaaccaatgaatgtaaatattagcatttctttgatggagacagccccaggctgcctacagcaagatgttcccttaggttcctgaaaatagaaagtcccgcatggtcctcatcaaagtccgctggattccttcaatacctcttcctcttttctcacatgggcattaacatccccactcctctaccttctaactcaattatctgacccctgcgctcttttttttttctttttcttttcttttttcttttcttttcgagacggagttttgctctctttgcccaggctggagtgtagtggcacgatctcggctcactgcaaccactgtctccagggttcaagcgattctcctgcctcagcctcccaagtagctgggactacaggcatgcgccaccatgcccggctaattttttgtatttttagtagagacggggttttaccatgtttgccaggctggtctctaactcctgacctcagatgatccgtctgcctcagcctcccaaagtgctgggattacaggtgtgagccaccgcgccccggcccccctgcgctttttataaattcattcattcattcgttcgttcattcattcaataaactctgctacagtattcagagactcttttctgccatatttgctttgatctagttaacacttaatgagtttatataccataatatcccttttacagtatcctgtaacgaatctctttatcatttctagcttatatcatggagtctgtgacagacaacaagattgcctctgaaccatgccctctactgatgtgggtattattatactgatgagatttcttctttctcgttctctgttatgaaaaagcaagctcatggcccacggggctcataaaaaatgtactaaaggctgagagcaatggcaactaatgatatacgtgtaagtacatattgatcaaattagagatgattttttttttcacagctcagtgatgtgtctaacaatagtattctgggaaattccatatatacataatataagccatggctttattcagatagaacaaatgccagataatattgttaggagcttctacaatagcaaaattcaaaatcacattatcattttaaaacacataaaatggctcactttttttttcttcagtgcctgtccatcttgtttagaaaagacttgattaaagccacatccactgataggcaatggaagttagattagatacttgtgtatccgatactgtttaaaagactggttctgttttataatttgaattaaatggtaactaatctttttttttgtaggagcttgggctaggcaaagtaaggaataaagaaataaagttacattttctatgactagaggtattttagaagaagttgaatgcgtacttaataaaatgtgtgttctatggagattctacgcatgcatagaaaactaggtgaaataaaaattctgcacatttctgtaagcaagtatcaaggaaaaagagttctgaacaattgcagcaccctgtaagtctccttcatgctctttcccaattcacactatattcccaccagcctctcaggaagaaactgctctgctgacctgaatcattatagataactttggccagttctcaaacttcatatagatggaatcacacagtaaatgttcatcttctagtcaacattgtgtttatgaagttcgttcatattcttccaagtagcaggtttttattactatataatattccacggatatacccaatttttgttttttgtttgttttttgtttttgtttttgagacaaagtctcgctctgtcacccaggctgaagtgcagtggcatgatctcagctcactacaacctctgcctcctgggttcaagcgattctcctgccttagcctcctgagtagctgggattacaggcgcctgccaccacacacggctaattttttgtatttttagtagagacagggtttcactatgttgaccaggctggtctctgactcctgatctcaagtgatccgccctcctgggcctcccaaagtgctaggattacaggcgtgagccacctcgcccagtctataccgcatttttaattctaattctgagggacacaagttatatcaggttctgctattatgcaaaatgttgctattaactaccttgtgcatgctattttggtggacttaatttctccccttttttgagacagggtctgactctgtcccaggcaggagtgtagtggtgcaatcacggctccctgcagcctcaacttcctgggctcaagccattctctcatctcagcctctggagtagctgggactacaggtgcatgccaccatgtcaggctaattttgattattattattttattttttttttttgtagagatgaggtcaaactatgttgcccaggatagtctaaaactcctggcttcaagtgaccctcccactttggcctcccaaagtgctgggattacaggcatgatccactacacctggcctactaatttcttttgaacacatacatatgagaggaattgctggctcataaggaaggcataaatttagatttagtagatattggcaaatattaatttacacttaaaccagcaatatttgagagctccagctgaggcaccaattctccccaatacttgatattgtcttattatattttaaccattcggatgcatatataggggtattcaaaattctttgattactaatgaagttaggcacctattcaaatgttttttaccatctttgtcctcttttatgaagtgcctgttcaaatattttgccaacttttaaaaaatgggttgtctttttattgatatgtatgagtttattatatattatggatacaagttttctaatcagatatacgtcttgtgaatatttttctcccagtccatgacttttcttttcactgttattagtgtattataatagatagaattcttagttttaatgaagctcaatttatcagtgtttgactttgtacttagtgcttgttcggtcctaattatgaaatctttgcttagcctgtatctcactcgtagattattttacttatgactggagattgcccaccagatgtaaccacttacacactaatggtcacagccatattctccttgactatgtttacttaatcaccattggcagagactatgtctcgtctaatattcttttatcccttattcagagactctcatattattgtgactgtaaattttcttagctaaaataatttccctctatctctctctgtctcactttctttctctctctctctctctctctccaactcccaaagatatataagtcggatttattgggcacagctaccaggaaaaggggttcaagaagggttacagagcaaatgaataatcttttgctagggctgaggagtccaactcatggcctcgatataatttttgagaatggaagctgggaatagaagatgtcagggaaccctggggttgttaatagtattgaaacaacctaccttgcagtacttttgagagagatataaaaccatcaccctgttctgaagctcgagccctagcttattattttccctttatcaattcacaaataaaagcaatgaatttcctacaaatacttcttcttggttttgaaggtatgttatagaatagaaaaagtcttacaaaggtgtattttcacatagtggttggtgatggtggacagaaatttttaaaaatcatatgtacccttcatttcatatttttataacaaaatgacaatttaatcaatgtattaaattttcaaaagaaaatgcaaatatctgttctacatagattgaagaccaagaatttctgccagtgatacccagccaagattagttttcagttagtctttttataccatctttcaaaacaaatggtaatgtgcgatccttatactgttaaagaaaaaattattcaatgtcacttgctgaatcacggtaaggcaggctttattcaagaccatctcaataggtatagggaccgtgaaaatagggtcttgcagtaggggagagagattgagctcaatttgaatacagcacaggcaaatgggaattttataaccaaggaacagggtaggggtcagtggatggaaaattattaagaggaagcatcatgggtaagggagactcctgctgaaaatagtccagtcatcccctggaggatggtggatgatgaggaacatgatcagatatccaggataatcaaataccaaggatgagtgttttctggctaaactgatctggcctgctaaaactaaattttaggagaatgtgcacagactgggctatgagaaggttgggaagcctgaataaattttggccgagcaaataatctttgtcagtactaacatagttaataaacagagagtaccccagtaattcatttatgaaaatgtgtttcaaaaaattccagtctcgaccaggcgtggtggctcacgcctgtaatcgctgcactttaggaggcagaggcaggtggatcacctgaggtctagagttcgagaccagcctgaccaacatagtgaaacccctttctctactaaaaatacaaaaaaaattagccgggcgtggtggcatgcacttgtaatcccagctaaccgggaggctgaagcaggagaatcgcttgaacctgggaggcagaggttgcagtgagccaagatcatgccactgcattccagcctgggcaataagagtgaaacttcatttcaaaaaaaaaaaaaaaaaaatccaatctctttgaaagttatgtatcacttgacaaaaacatttcctttgtgacgtaggttcagaaacattgggttaaactaagttaaacaatttttttaactacaaaacatttcagggttgagttgtgactcgctaaagaaggaaatgaaattatcacattttaacaatttgtttttcattcaacatcttacgggatcaatgttctttacaatttccatttggaaatgctgttctagactcatccgttatataaattatacatttaagaggatgttggttctaaatactttaacttgctatcaaggcagaaatttaaaagcaaatttgctcttgttacgttattctcttttatatccaagagaaaaagaatgttaagttgaaagttattttgctcagggacacttacaaagatatatacacattcagtagacacttgcatgacattacatttgaaattggatatatcttttagctttttatacacagatcatagtatgcagattttaagtggtggaaaatgaatcttttaacattcaaagtgatgagctttggagaaggctgttttaatctgttatactgcaggtgtaactcctggtacacttgtaggttagtagtgatattgtaggcatattcgatggatcaatatatatggagtacttgatattcagatattcagttctccccgatgccttaatctgggtgttgtttttgcagtggttaggaggaaggagaggaggtgccaagattcagacactgcagaagaggattatataagcagaaataattccatgatgcggttttgtacctgtttactacaaatcaaaggtggctgacacaactttgtccccaggaattctataatggttagacgatagctgtaaatacgctcctgtgttccttccagaggtgtgtgggaaaccctgagaatggggtgtgcatttgcccctagttaagggtcaacgaaatctaaggcagaattcagctacaggtttagagctatagtctctttagagttccaggtgtcccttttacttaaaactctttttttccctgacattttaaatataagtttccctattcactttgcaaagcttagttaatactgatatgtaacaaaaattattcgctacacttgagcatgtctcttctccataaagatccagctttagatagcaactcttctcatagatctgtaagtattgtgagaagataattaaaagtttgattattgtccatataaatagacggtaagaaaatacacattttcagtattgaataaagactttccttcttctcagcagaagttgattgtattccagaaaaggaaagaatccttcctttcataagggcaaattaaaatgcaggaactctgaatttgggagtctgtttttcaagatgaataatcatctttggcaataggattcaaatggcacaacagaaggaattgaattgatattgaataatctgaattcttgatccaacctctatttttgaatatgtacatttaagatcactttgtgcatttaactctcattatgcataattgcataactggacaacaatatttgtttcttcctggaattcaaggagtttattctacaatttttgtttttatttatttatctatttatttttgaaagatggagtctcgttctgttgcccaggctggagtgcagtggtgtgatcttggctcactgcaacctccacctcccgagttcaagcaattctcctgcctcagcctcccgagtagctgggatcacaggcgtgcgccactacgcctggctggtttttgtatttttagtagagatggggtttcaccacgttggccaggctggtcttgaactcctggcctccggtgatccacccgcctcggcctcccaaagtgctgggataacaggcgtgcgccattgagcctggctattctacaatttttagaaaggtagcaacttctttccccacatgacattaagttttttataatactaaatatgaagctttaatgcaccaaacatacttgcaatcatcaataaacatatgacatatctctactaacaagcagattggaaattatggcatcaattcaccatctgtgccacacagactctagttttgaaactcttatttgaaacagaaagttatatatgagcataagaggacactgcacatggagttcttctaactttatgtgtaaatttctacttaatagaatatatactgttataagctgcttcacttattgttaaacctatatacatatacattaataaaaagtcattaatattgacctacaaataatttgagttttaaaaaattattattactgtacttcatttttggaacaggaatcaaattataataaaactagtagcacagaaacagacaagattactttggttaccagagactctgccaaattttcaatgataatttacatatgaaaaaaatagaagaaaaagtagaaaatgttaccatggcagtaaaatatgcatgtatttgaggatgatattcaacaggacttacctgcaacaaatataaaaagggaagtggaaaaattcactaaatcccttaaaatgttaagtactgagggtggaaagtaagatagataataattataatttttcctagaatgagggtaaggctcgagttatgaaaacactaacaccgtcagagtaagtcttaagggagaaccacttctggaattccctggttttgctccccggctgatgtacagaacatatgtctctagaagaataatcaaaggcattacaaagaaccctctcactaattgctgatagttacagtacagtcctagacacccatagaggcagttctttgcccctactacacatcagaaccacctagagagccataaaatattacctaagcccataccccaccccagaccaactgaatcactatctctatgccggggcttgggcatatggttgaaaattgcagtcctagatgacctgctacaatacacacacacacaaacacattttcaacttcatgtactctcatactttccacttcacgcactagcacttgttccctgtaccttcctaagtccacttagaaaatcagattttacatttttaattttttcgtgtgtgcattttaatgaaagagtatcactaagataaaatgtgacagtaggcaaccaatttctttcttcacagagcattgaaaatagacataattgattgccttagattcatgcccatatatacatatatatgcacatatatacttcaaactcattttgatagggcacagtagtgatttcctggtgtaataacaatccgttcatttttcatgtaacattgtctatatgattttattatactttttatacatagaatgaaatatttgttaataaatgaagaactaagggcactcactctatagcaaaaatgccacctctactagtaagaaaaagaaataaacattttctattattgcggcaactttctaaaaggaaaaaaaaacacaggaagactatcacataatgaaatcctttaattgttacttctttctctatctcactctcttttgtttcatccaagaaaactatttaactattatatagtgatatgtaattagagtctttcaattaaaattgttaagctacagattgttgacaccaccgaatatacttgattaaaataagtatagatgtaaacaaatgtaaacagaattgcacttaaatgatattcattatttagttcatttatttaaaatgcattgatggccagacgcggtggctcatgcctgtaatcccaacactttgggaggctgaggtgggtggatcacctgaagtcaggagttcaagaccagtctggccaacatggcaaaaccccatctctactaaaaacacaaaaattagccgggcatggtggcaagtgcctgtagtcccagctacttgggagactgaggtgggagaattgcttgaacttcagaggcggaggttgcagtgagccaagatcgcgccactgcacttcagcctcggggtcagagagagacttcatctcagaaaaaaataataataaaataaaataaaataaaatgtatggaatggccaaccaccattctacgaagtaagaactgaaagtctaataagcaaaggtctctacttctcagaagctctgttggatgatacaggtttgtgtacaaatattacattaacatggaaaaagtgctaacatgcagtagaggaggcataaacttgctcgattaggtttggtggttggaggttttacaaaagagatgatgaggcaaattggtgtttacctacacttgacagcccccacccatagttagtataaaatgtaattataattttgtgtatacagtacttgaaaaattattacagccaatcacaatagtggatataaaaattccaagtctatttacaaggaaaacattctggccaaatatgaccataaatatttgtgcttacaatacctagaaatttcaaatgtttgatatgttaaatatttttatttgtagagttcttcactttcaaatatagattacttttaatgagatagaaacaattatcagtttgattcattaagggacaatatcactttacagaaatttacatgtatttattaacatgtgaagcactttagtagataaaaaggacatttttgtatcacttaaaacattaggatgaaattatgaaatgtacatgctgcctactggcaccaaagattataagccggtctcacaattggcttttcattatataaagaacacccattatatgcttggaattcctatgccagcaggcatacagcaaatgctggaagcccattgttcataactttacttcttgccaagcatttcagttatattttctttggttatataaagggccagagctattttaagtgaaagaggtagccatcctcatctcactatatgacagatgtcatattacaatgccctacataatagtatgcaagggcaatgctacctccttcgacctggtgtaaaattccttagaattacaactgtgtgtttagacaataaaaccgaaggatttgcctcaaatatcaaaactaagtgcaaatgggcaatgctatatagatgagcaggaaacatttctcactctcctctaagtgaatgctaatatgatttcatgaattgacacaactaaattttgctttataagaacatacatagccaaaggatttaaaaaaaaaaaaaaccaccttaaaacaagttacagagggttaaacggaagcaaaagtaggtagctaagtattaggaagggtggaataatgtctaggaaacgagagtaataaggccaggtgcagtggctcatgcctataatcctagcactttgggaggccgaggcgggcagatcacttgaggtcaggagttcaaaaccaacctggccaatgtgatgaaaccgcgtctctactaaaataaaaattagccaggcctggtggtgcgcgcctgtaatcccagctactcaggagggtgaggcatgagaatcgcttgaacctgggaggcagaggttgcagtgagacgagatcacaccactgcactccagcctggacaaaacagtgagactctgtcaaaaaaaaaaaaaaaaaggaaggaaggaaggaaaaagaaaagaaaaaaaggaaacaaaagtaatagactaatcttaggaagctggctggagtagaatggcatagagcccccaacggtaccagcaatgtggggtaggtaggactcagctcctagatcttcttatggtcctcaggacataagaagcacactaaaaggcctatagaggatagatgatgcccatttaaacctttaattctgcctaaagttctgccaggtttatgtacgggcatagtgcacataaagcatgcataagaatgcatattttttgccttgcctttagtttttccaggttttcatgatattaacaccaacgattatgtcagagttatgctttgttttttctcaatgggagaaatccaagcataggccccctaaagaatgaaatgtaaaacaatgactcctgcctgatacaaccagaaggaagattgacaatacaacatgaaaagtcacggagtaaattattttcatacaagtggagaaattattttcagggaattcgtagaccgacagctattcacaggccatcaaacacccataaggacctttgtcatccttcaatcacttcagtagagagagaacatgtatgaaagagacagaaaacacagttaaataagcaattcctgttcagtaagtgtctgcagggagtttttcagagtgtgtacggataacacgtatacctactcgatcctacaagtgcgtggttctgaacagaagcaaatttgaagtattaataacaatgaagatggaaatagggttgttgaaaattctgtatttaatgagtgaactcagcgactgcagacacaaagagtgtggattctccgaatgattataaaagccttaatagaaataaatgattactaattggaatgggacatgaaagaagataaccttgttacaaagattccaggcaaagaaagaagagatggttccaattacaataatcaaagaggtgattttcttagaatatggctaaggaaacacattttcattcatttgtttcattcatttttttagtgcagtgtttgggaactaacctcagtactagtgaacatatgatgttaattctttagcgaggccaggagcggtggctcacgcctgtaatcccagcactttgggaggccaaggcgggtggatcacctgagatcaggagttccagactagcctggccaacatggtgaaatcccatctctactaaaaatacaaaaaaaaattatccgggtgtggtgacgggcagctgtaatcccagctacttgggaagctgaggcaagagaatcgcttgaacccgagaggtggaggttgcagtgagccgagatcacaccactgcactccagcctgggcgacagagccagactctgtctcaaaaataagtaagtaaataaataaataataaaaataaaaattctttagtgagatgaactgttaatggttgattccataatactgattctcattataaattactgtaacttttagttgtcttaaatattaaacaaaataacaacaatagtgccaacaagtgctgctagtgctgaaaatttcttcagattgttagaggaacagtatttcagtacatatattttgttacaatttcgagaaagaattcaaaacccagaatgggaataacaaagaccttttagagttgtgtttctcaaagaaagaccccaggaatacatgacttgtaaagacctaccagaagaatatcatttagaatggggctttagaatctgcatttttaataagcattctaggggattctgctgtattctagagtttgggaaggactgcctagtagattgtaaggccaaggtagtgattaattgatctaggctagagtaaagctgtggctgaaatatttttctaagttctcccagtgagtctaacagccaggagaaagaacacctgtgcattggcagtgacagcggaggaggtattgtactttgccaaggaagtatgcacagaatcatttttatataggtaataactgtatatctaacaaaactctatttcatttcactcttaaattcagaaaaaaaatacatgtaattcaaaataaacgttatcactggatatggtagcaaaacaacagtgcgtagatatgtgcttatgtttccgtgtgagttctatctatgtgtgtgcttatatatgtgtacacacacatatacacaacacatacagtgagagaaagagaggcagtttataatcttccaacatttttggcttatgtcaacctgtaggttaaaaatctgactttgtgatgccaaagaggaaaggtataggaaggagcagagaaaataactcaaatatggtttacttaggtatgggaggtgaaagattatttgtggcatcattacagctttgtgaaacaattggcaaggttgtgcaaagtaccatcttgatcagtgaagctttttcccttaaggatggattacaagtgtgtaattcaaccttgacttgtagacctccatttcctctctagttatgtgaatgtgcaccatacaatacaaagttctatacctattactttaaaccagtaacgttttattgtacttaataatagtcttaggctatctaggtaatctctgtttataggtgtttacaaagtaatattattttatgtaaactaataaaaacgttggtgctaattgctttacacattgcttggaaaagcaagccatttttgcagttgagtagttgctcagcactattggccaatctatttctatagcttcttgtttttcatctccttcaacaagttcatctgccaatattttgctccccgtgttgctctaatctcaatttctatcttaaaaaaatacaatggtaagggggtactttgcaagttaggcctaagaaggagactgatttcccaaggatgttcacgttgatttattgccttttaaaatactagttgcacaatgaaatgacaaattctgccaatttacatactattcctagtgtcattctttcaatttttcaaccagaattcatatacacagaaaacatgcttttcttgtttcctgagttccttcaagcaaaacataattctataatgagcaattatagcctaacacctgctgctatgaagaggaccttgtcaacatctatctaaattgaagaacaacagcattccttgattttgggaaaatgagcaataaacgaagtccatttcttagcagaaaaactcataggcaatgtattccaaggtagctcacagaataatcaggatttaatagaattagattttttaccatcatttgagagaaagttttgctctgggctaagtattatggttaaggaatccaagaaaaacactaaaattcctggatcccttacaggcaatatttacttaaaataaaaccatccataaaagtccttctctactatagtatctcttcctgtttttcttatgaaacaagaactctgctcaagctgaaaggtaaacaaatcggatagaagcatcatttgagctcaagccatatcaacaatcttgtggatttacattgccaggaaatcttttttcaaaattatgccgggataattacatcaacaaaaatggaggcagaaatcttggtataatatcaaaaagatgggggaagaataggttgctggaaaaagcctgctagcagattgcctagaaagaaaaatgaagccattctaatatgttaaaatctcatctaaacattgaaataaatgattattcacttacagagtaaacagatatgtttaagtgtatttttttacgtagtcacatgtatatatgatgtttctgtgtgcctatgtacacgcacacatacatacacacacttgaacgtcaacttgtacgtattaatagtgcaataaaaaatgttgtcagggatgacttcccctctggcattcccagcactatgactgacagctcttactgcatcaatagaagaattgtatttaaacaaaagttatggtacaattcctaggttgatgcttaatagacagtaaatactacaggaactaccaataagcttccttattaaataaatgtatttattcatttgatcttatgtaaagaacacaaaaggtaaaagaaaaaaattaaaaaagagtattttatttttgtataattaaaaaatctagttccttcttcctggatttgaggtatctatatctgtatctatccatctctctctctctctctctctctctctctctctctatatatatatatatatatatatatatatatatatatgttcatatctatatcaatattgataatgtttctttacttcttaaataaagaattacctaagcatcttttttcaagcgggagaatgaaaacacaattattctaagatggcgaatattgacaagggaatgaaatggtgaaagcaaatctatctagaaaaaagggcccccttagcctgaatgaatagaccagtgaatgaggaaacaaaatgattaaatcaagtcttttgaaagcacagcattattgtgagacatattgtaaagatctgtgcagctattctgcccttcctacatactcattgctctctattatacaaagaaggaacacagagaaaagaacattatacttgaagttagaatacctgggtttgagtgtgactttatcacttactaattatgtgatcttgaacaagttactcaacctctttgtgctcagtttccttttctaaaaaatggacatacaggccggacttggtggctcacacctgtaatcccagcactttgggaggccgaggtggcagatgacttgaggccaggagttcaaaacaagcctggccaacatggtgaaaccccgtttccactaaaaatacaaaaattagccaagtgtggtggcacatgcctgtagtcccagctatctgggaggcagtggttgcagtgagctgagatcacgccacttcactccagcctgggcaacagagtgagactctgtcctgattaaaaaaaaaaaaaaaaaaaaggatatacaaatatccagggctaattggagattcagatttgataatgcataggaaagatcctagtacactataagacaccttacatttataaagtagtataattgtcatccacataccattattattacatcatagtgaaaaaatacaacttacaagagttcagctgagcttaaagaatatattcatttgaagcccaatcattgttgtgtgagcttcttcatattatcttatttcaattattatgcttttatcttagactctaattatatatccagttttacttacgccattaaatgaattttaaaaggagtcacattaaataaaggccctttaaattttttatgagataaagagttgccatagacacactcttttgcatcttacccggtacagtcaaactcaattaactattcagactggcaaagcatcttttacatttttcgtaaagattctaagtgaaaagattgtactatttttcaattaagttatatatctttcaaaaatagctggtagattaaagcaaaggcactgtcacaatcacagattctatttagtgccatttagaggacaaaaatgaagccagctagacttgaaaatgtgttcatagtgatttttcaatgtatcaaaatctactaaatggaacattgaatggcaagtccaaaggcatgtgatggttaagaaatctggtcacaggcccagcgcggtggctcacgcctgtaatcccagcactttgggaggccaaggcaggcggatcacctgaggtcaggagtttaagactagcctggtcagcatagtgaaaccccttctctactaaaaatacaaaaattagccaggtgtggtcgcaggcacctgtaatcctagctactcgggaggctgaggtaggagaatcatttgaacctgggagatggaggttgcagtgagccacgatcgcaccactgcactccagcctgggcgataagagtgaaactctgtttcaaaaaccaaaaacaaacaacgacaaaaaaatctgggcacagataattacacaaggatttcacataacctctctgttattcatttagagatgtctaaaagtaattcctgagaaatttggaatttttattgaacatgtcagaatcttctctaaataacttctgaatcacctgtaaatgcaccattgatttggataatggtggaatctagctgtggaataagttaaaaggtcataaggcctccaagggtgaaatttcagtgaggtaaccagccaggctacggagcagctcggtgagcatttcatcagtttggagtagaatatggggagatgataccttttctcaactcaggtaaaaagaatttgaccaagttctcataccagcttttatgttacacagctgtttattaccatcaatgtttttgaaaactgggcagcataatttccatcatgctatgtccctggttctacttattatttggacctcctgatttactgactaaaactactatttaattatctgtatacaaattcaccggccattttcctttgaggtatccctatttggccagaaaatttagagcaaaagatgttcaattcagaaatttctttttaatgttatttatcagttttaactgatatacataatctttcactttactgtcagagatttataacaaaattatccagtgatatctactgaataaaaaagtaatgtttatcctcagtataccaattgttcagttttggtgcaaggtggtttaatatgtcacagctctaggtaagaatatagtaagaaaccctgagagggacatgtttaattgtaaaactgtgaagcacataaatacatacttactattatcaataataatagttaccatttaaatattgcctgctatatatcacaaagcactaagaggcttaaaatacatttttctctgtcctgtacaattctatttaaaaataggcaaaatttctccactttgtatgtaaggagaatgagtcacaaaaatgttaagcaacttgatcaggcccaactgccaataagtttgaagacaggattcaaacctcagtttgcctctccaaatctcaggaactataccaagccatgagttacatattaaacagctaaggcaggtgggcgtggtggctcatgcctgtaatcccagcactttgggaggctgaggtgggtgggtcacctgaggtcaggagttcgagaccagcctggccaatgtggtgaaaccccgtctctactaaaaacacaaaaaattagccgggcttggtggcgggtgcccgtaatcctagctactcgagaggctgaggcaggagaatcacttgaacctggcaggcggaggttgcagtgagccgagatcgcatcaccgcactccatcctggacaacgagagcaaaactctgtctcaaataaataaataaataaataaataaataaataaataaataaacagctaaggctaacagtcaatattaaaaattataaacactaaagtgtttctctaacttattattttgcatttaacaaaataccattttcccataaagtctattgttaaagcaaactaaatacggcctgagaaggactccgtacttctatatttgagtccctgtggatgaactacaacctatctcaataggtagacaagattgaaaaactaacttaggagtatgggcctgtgacaatcactcagtcttggccaatcccagccgccattcttcagccagttatacactgctgattgttcaaactgtgttcaaataaggcaaacagcgagctgtaaccaatccagctgtttctgcatctcacttccgatttctacatgtcactttacttttttttgtctataaatttattctgaccacaaggcacccctggagtctctctgaatctgctgtaattctgagggctgcctgattcgcaaatcgttcattgctcaattaaactcctttaactttaatttggctcaagtttttcttttaacactatattttttttttttgtcttttagcatcatttttaaaaatagcatttaactcctttgattcagtggttgctatggtttcactatttatcccctccaaaatttaacccccagtgtggcagtattgagaggggaggcctttaagaggcacttggatcatgaaagttctgccctaatggattaatgagttaatggattaatgcattatcatgggaatggcactggtggcttgataagaagagagacctgagctagcaagttagcatacacagccctcctgccatgtgatgccccaggccattgggaccctgtagagagttcccaccagcaagaaggccctcaccagatgtgtccttttgacctgggacttcttgaaatggtctttgcaaaaattataacggtgagaaaatgatggaagtgaaagggatctaatctagccaactcctctcttgcctttagccttcaagctgctcttaattattcctgggcttatgccaagctaactttgggagacatttatagtttaaatgacaatagcccttccccaaaactcaaccgcgtttgtagagctaatgagagaccaccaggctaggaggataggggaaactaaattctgctgcggtgtagacatacaggattgccagccattattccagaggtcacaagacacgcgacttccccaactactcttgcagacaacatcactattgtagaacttaagattggccttttgagatatctgttcagatatatttcatgtctgatgactgatggctccacctgcacctgccaactgctcctgtggccccgcccagaagagactcagtgcacaggaggacccttgcccacagtcctatgattgcaatccctaccagtcagcagcaagcacctattgcgtagctttccacatgcctttccccaaaccgatcttgaaaaccctagcctcagacttcttgaggagactgatttgagtaatagtaaaactctgatcttctgcttagctggtggctgtacatgtataaaactctccattgcaattcccttgtcttgataaatcagctctacctgggcagcaggaaagaagaacctattgtgcagatacattctgagcctccataactgtaagaaataagttcctttttgaaataagtaacctagtttcaggtattctgttttatagcaacagcaaatgaattaataccgagcaaatgaattaataccgtattgggatatcttagatgttttggcattgaagctttgtcttacgaaaatgcattcaggtattgaaaccaccattgcaaaattataactgaaatagtgaaagagatctgatgtaaccaactccctcttgcatctaagccccaggctgtccttgctcattcctgggggtaagctgaaataactttgggaggaacttagtttatagcttatggtttaaaacaaaggcaatgacaacccttccccaaaaccaacctccttcttgcctggggactagactgcctttgtaggactaacaaaatagccaaaagattagaaattacggtttagtagtcatgcagctagagactacaagatactgcttctccccaaattgctcctgggcataaagtcaccattgtaaagcctaagatcagtgcttgagacgttttgcagaccctgcactcgatggatcaactggtaccacacagatcaataaactggctcatctcatcctatgaccccccactcaggaactgactcagggcaagacagctttgactccctatgatttcatctctgatccaaccaatcattacttctgaccactggctgctccccacccaccaaattgtccttaaaaaccctggtccccaaatgctcagggagactgatttgagtaataataaaactccagtctcccatacagcctgctctgcatgaattactctttctctattgcaatttccctgtcttgataaatcaactctgtctagagagtgggcaaggtgaacctgatggcaattgcagtatgtatgtatacccaacatcttgtatgtaattttaagggatgcaaggatcccaaaataaactagaactttagggtgatcgagtgtctggtgtgcctgggggctaagcaggtttgtgggatatgggactttaaattttaaaactgagaaattcctgaaaaacaaaaacaaacaaaaataaaacaagaaaagttggttaccctaaaatgtaacgtttatatagcactttaataaatactatttactagaagctaaggcttttggttatgtatattataaattaggccatagggcaaagcaagaaaatgaaagctttactaggtcaaaactgtgaccgcccaagaggttcaactcgcctgctgcctggacagagccgattcatcaagacaggggaattgcaatagagaaagagtaactccctcagagccagctgtgcgggagaccgaagttttattattactcaaatcagtctccccaagcattcggggagcagagtttttaaggataacttggtgggtggggggaagccagtgagccaggagtgctgactggtcagagatgaaatcacagggagtcggagctgtcttcttgcgctgagtcagttcctgggtggaggccacaagatcagatgagccagtttattgatctgggtggtgccagctgatccatcaagtgcagggtctgcaaaatatctcaagcactgatcttaggagcagtttggtgggggtcagaatcttgttgcctccagctgcatgactcctaaaccataatttctaacactgtggctgatgttagtcctacaaacgcaagtcccaggcaagaaggaattttgctctgggaaagggctgttaccatctttaaactgtaaactaagtttctcccaaagttagttcagcctatgcccaggaatgaacgaagacagcttggaggttagaagcaagatggagtcagttaagttagattgttttcactgtctcagacctaattttgcaaaggtggtttcaatcccttcctttgggttttctaacactttaaccctaaggtataggctataaagatgggaaaaggccgtcgatcgctctggcttcttcctgctgatgggggaagtagcgggaatgggaacgaactccaaggtgagaagagtggaactgctttgcaactgtttgagtggattcatgcaggcctaattgggcttccaaggcttgcgtggcagaaacattattactctcatctatagttttactacagtgtttatgtgaatagcctactataaggtataatgagtcctaggatgagaagtacaattcccaattttaaaagcaaacatttgaaatcattagtttgggaacttctaacccacaaacaatttagaatttagtctaaactgaagaattaacctcaagaatagctaatagtttactatagattttcttttgaagcataatatttctctgttcagtccccatttttattaaaaacaaatcatgatagaaatgatttgcttataaaatgcattttagtcttactgtacttggcctgattatttgcatgaagtgcagcaagaataattatttttcacttaggctttttaaattggctttgatggaactctgttccatgaagaatctcagataagactttttgaaagccgagcccagccatgggtttgtaccctcaaatacctatgagttgaccaaagtcctctcctcttgaggtcccaagataacttggggttcctgggcctgttagaaagtgacattctttacttaccacaggtcaggaaccttgtacagggactctgtgtggacaaggtatgaggccagattccccaacgggctttaaatggctctataagtcaactttgattctttaaaggaagcatgccattccagtcaaagccttggtaaaatgaccaatttctccaatggtgtcctgttacaaaagaaaacagattcttattgcacgtatgcaattaactatactgtcataaattgagaatactcacaaatggtttccaaattctagagaaatcaggtagagagaaacaaatttgctccaaaatttgtcactgagtgtattttactcactcggtaaaagtggcaaatagctctaaagaaataagttatgttgactctgaaaacaaaaggattagcaatgtttaacacatcagtttgccacatttagatgttttttccctctattccaagagcataatttttaaagttatctaagacctgcactcagagtattatatccgattataaactgccttttgaaaaggaccaaagcaagataaaatgtctgtggatgacaaaagtctacagccattattaaagctacaattgactaggaattttggttacttccgtggcacacaacaattttacataacaattataattattaatagtgaaatcatatcagaattatagaagtttcccataatttttggaacacacactaataacatatttatacaaatacagtccaaagaaaaccaaacaccattcactcttctatttgaaagttttccttctattctaacgtcacaatctccagagttattaatcagaaacctgcatttaagaccacctgttacattttacagctggtattaaaaccatttttttttgagacagagtttctctcttgttgcccaggctggagtgcaatggcatgatcttggctcaccgcaacctccgcctcctaggttcaagcgattctcctgcctcggtctcccgagtagctgggattacaggaatgattttgtatttttagtagagatggggtttctccatgttggtcaggctggtcttgaactcccgacctcaggtgatctgcccacctcggcctcctaacgtgctgggattacaggcatgagccaccatgcccggcctataaaaccatcttttaagaggacaaaaatgagacaacaattgcctgtggacgacacaaacattgtagagtagccagagttaaagacacaatcgacaaggaaatttgttacctctgtggcacatagccatttaacataattacaattattactgataacatatactaagtcatattagaattataggagttttacataatctcagaacatatgtcaatcatatatttacacaaatatagcccccaaaaagccaaacaccatttcatatttgacaatgtttcctgtatgatttttatgcaaaatacgccaaatgtcatttttggactttagaggacctaatatctaaaagattaggccagaaagagacataatttataatttgattttggaaagtttgccaaatatcaaaggtttaaaacactggatatcacaaaatagaatcccaggtcaccataagtcattcatttgaccaaaacgataactccaaaatcttaaaagaaaaacctttattctgacagaggagacttagctttccaaacaagacccaataaagacagcatgaggataactgaatttgtctcttctctctccccttttcccctgccatttacccaaaggagaaagccaaaccctttcattatcttttaacgttacaaaaaaatcgtcttcaaaagagaaaaccaaatttcatgttcgcattagtgcatctttaatgctaaagctagtttttaaataaaattttatgtatctatccagttttaattagtttgaccacaaggtgacattctcataaactttttagaacgctttataattttccattaaacagcagatcaattttctaagaagaccctgttatttggacacatgggcccagattctggccccacagtatgactttaatattttaacctatagaaaaagctaaataacctttttcaaatcttagccaacttgtttatacccacagaattttttttttcaggatcaaccctgtataaacccttttcactttgcttaaaccctcagtttcgttccgttactcttttagtttaagacagtctttaaaacctctgaactagacaaaattacattctcttcaacaaaagccatattcctatgccttattatctttcaccaaaaacacattccctacacaccttgtatgtaaaactgtttctccagtaacctcgatttcatgttacaatgttaactcttagcaactttgatttttagtgaaaaacctgataaaaaagctattttaattatatgctagggatggagcctaggacatcagacagaagtgaagataaggtctgactcttttcagcatagctaggggcatagctctccacgtgtccccaggcctcatctataatataatgctccaaagtaaataaattgaacaattttccaaagtcaaggaaacagtttgaccttaaagaatttagcaaatctgatagctgaccttaatttagaccaaatgtctacattttcaagatattttactttaacaataatctttaaaattgtctttattgccaaaagattactaaagtcatgtgaacaaaaagtcatcaaagtttctatttttctgacaaaatatttttttatttaagcacttattttccaagccaattaatcagagctcttttataaacatcacacacacacacacacacacacacacacacacaaaaacacatgtaaatacagacagaagatttggcactgataagactttttatttgccagtttcttaatcagattactggcttcagggtggagcctttggaggaacagggccaggaaagtatgcatttctaaggcttaatcacagctgaaggcaaagacagaactcccaaattaagggcaccattttatactgcaacccaaaaggagagaaatactacgggagaagacagtacagtgcttctaccctacatttcttttcttatttttgtttctttctttctttttaagacggagtctcgctctgtcacccaggctggagtgcagtggtgctatctcagctcactgcaacctccgcctcctgggttcaagggattctcctgccttagcctctcaagtagctgggattacaggcatgtgccaccacgcctggctaatttttgtatttttcttagagacggggtttcaccatgttggccaggctggtctcaaactgctgacctcaagtgatccgccctcctcggcctcccaaagtgcagcctcccaaagtgcttggattacaagcacgagccacggcacccggccataccctgcatttcattgcaaggcaacccaaagtcaatcagcccattttgtaatcagcccgtccttcatgggagtctgatctcccagtggagggtgaggaatgtttccttatcttccgggtgaccaaaagcatgcttctctggatccaagtgtgcaaagagtcaagtatccctgtataactaccattagccatcccttaaagtatatttcctatctagttattacacactaaagctccctcataatgtgaagtaatttctgatatccccaaaactcaaaaccatcagataacacaatgaaaaacagagcagagtctttgattttgagagggatccatctgtttttaattcctggggtttcatgtggaaaacagttttttttttttttccctaaaacgggttctgtggtgcctcctctgtttttcccaatgagtcccaggctaccagaagttatcttagggactcacgtgtgcgttaagagtggcaagacaaaaaaattaaaaaagagaaaaaaatggagaaaaataattcagtcggctgagaagaaaaaactttttccaaaaaaacaagttccaagaagagaaaaacataaaggccttttaaatatatctatagcttgtttatccactcttaattaagctgacttttaaccatagtgctctttaaaaaagaaattcttttagatctcttattacctaattttagccatgccaagtggacaatatttttagcttctgaactttaccaaaggaaacctcctaggtgctgcaaagacatagtaagaagtttctttttacaagatttagaatctccacaaggtagtccagagaaaggaaaattcaagagaggaaatcagaaaagaaacttaataaatggcaaagctacacaaataacaaatcagaaaggaatcattccagaagccaacaattgaacccaggccaccactgtcaaaagacaaagccttagctactgagctatatacagcgttgagaaatttctactgcttttcccagaaggagcctagagaagccagtttcaggcttgcaaggcttttaactgctcaagaaaaatcttaggagtaactatgacatgaaccccaaaattcctgtcctctggatggtagaaaccaaaagaaagtatccccacatggtcacaaggttaagctcttaaggacacaaaacaagacagagaaatttcatagagtattggtttcagggacctgtagcaaagtttgtagctgaccagcctcccaagctgacttgaaaagcagacttatgggtgtcctaacccacgttctatcacgtgatatccctctctccattacataacacagaaagacaaattcttagcacaaactacatcagatgtgctaagattagtctcacaaatccttctttctattaaccaaacccttgcagaggagacaaatagtttactatttaacaatgcagagaaagagagagagagagagagagaccagaaacttgactgataagaatttcttacccttattgctgggatgccaggtttctgggttccctttctctgcagcttccagaagaacggagtggcgtcttacgaccctgcttgcttgtgctatagctgtggggtttaagccactttacaagataaaatcaccctttaccattttatggaaccataaacaagattcttaatttgcaagattctgcccaacgggctgcatggggaactgaattaacattttccaacccagcaaaatacacataacaaaacagacattagtcacctctttccgcacccaatatcagcctggcaaagctcaaaatttttcatcttggtccctgttgtctttgatccacaccaggtggggacggatgacctctgaacggtaattcacaatgaggtctctgggcaagggaaagagcagatagtcaccctgagagacaggactgttgagccttctttagagctcactgaatgtgaccagacaaataaggagggttctctgagttaggcatgctggacttctatcagcaaccccttctgagatccctttcacatatttaaacacatgcaaagacaagagggacagaaggccttccaaatcagatccctaaccaagaagtccaagagtatcccttccaaactatcctcctattttctgtatgagaaacctcctcaaaatcttcctgattgaagagaagtctcccaaaccagtagtcttcctactagttagaaagagcgaactgagacctcccaggagctgaacagacaccccacaatggagtaacagacagagacaccccatgctggatctacagacaccccacaatggggctacagacaccccaccatagggctacagaaccagtcaggagaatgaagcaggcattggcagcacctaggatactcaccaatccagacaccccaaaacggagctacagatagacaccccaccatgaggctacagataccctgtaatagggctacagttaagggacatctccccatgactatttttccattgcaattaagtccacgcacattgggttggaataccccaccagtagacagagtaacagagtcagcccccagtccaagagaattaggcagccacttgggctgccttctggatccatcactgaaagggggccaccaaacaacaggcaggtagccacaggggcaatcctgggtgagcccccaaatttgtaaccacccaaggggttcaccttgcccactgcctagacagagctgactcagcaagacaggggaattgcaatgaagaaagagtaattcatgcagagctggctgtgtgggacactggagttttgttattactcaaatcagcaaatcggtctccccaggcattcggggaacagagtttttaaggataacttggtgggtcgggggaagccagtgagccaggagtgctgactggtcagagatgaaatcacagggagttggagctgtcttcttgcgctgagtcagttcctgggtggaggccacaagatcagatgagccagtttattgatatgggtagtgccagctgatccatcaagtgcagggtctgcaaattatctcaagcactgatcttaggagcagtttggtgggggtcagaatcttgttgcctccagctgcatgactcctaaaccataatttctaatactgtggctgatgttagtcctacagaggcaatctagtccccaggcaagaaggtctgctttgggaaagggctgttatgatgtttgtttaaacgataaactataaattagtggaggttagaagcaagatggagtcagttaagttagatctctttcactgtctcagtcctaattttgcagtggtggtttcaaaacccttatactttattttaccataaacaaatgagcttttagtaatgaattctaatgactgcaatggggtgggggtggtgagttaattgttatcagttgtacaaggttgttttattgtagctcaaatgttggaggaaagggaagctttatggtattatgtttcattaaactaagataggctttcagaattgtacaaaacatttttaaacctatatgtattactgatgatttaagtgagtgtatcagggaaataacttgtttggtgaaaaatggaatatggcctgaaaacataacaacaacttcgtaagttgtccattttctcataaaaataatattgacttacttatatattaaattagtgattcaatttctaaaggccttacaaagatataattcagtattttatggtaattattttctaattagaaatttacttttactatagcactaagtgccaccagtattaattattgttatttccttacaccatacttgttcctagtaaaacaagcttcagccactgttctctataaaatatggtgtcttctagatgggaacaagaatattttacaacacataacctcccatttctagggttgtgacaaaatgcattttatttcaaatggcacgcaatattaaaacaactcagtttatgtttcattaatcaagaattcaaaacaacctcattttgtaaatccataatatgcaaacttggctacagactgtccaatcagattttattctcctttcaagtcagattttccttatcctctttacttacactatcttaccaataggctgtcagatgctagtatgttctgagacattcagtatctcttatcactcaccactcatatactctcagggataaaattctgtagaggcactcaattcgcatagaaacaaccataaaacccagttttgcaaatattaagttagaaaacaattggcatagcattacactatggtaatacttactatgcactcctaaaatttagtgttgatcttatgccatgatgtaaaaacaaaaaaagaaaaaaagttattagtacaaagagaaaaatgtcagatgtgtataatataacctctgatttgactaaaatatgtgataacattcacaagccagaattgagtagagctggcagttcacagaaggcctgaagcctagatgtaatcaatgacatagctgaacttgataaatcaacacatttacataaggaaaatatccctgattatcataggattgaaccttctaaattatctgttgacagtcaatattctgatcattttcttcactgtgaattcagacagactatcattcaaaggtttgctatacagaaagagaaaaataccaaaatgctaaggcacaaatatcaaatctctttcccatgaaaatcagataatttagaattttttaaagttaaccttgaaatgtgactatgtaattaaaaaaaataaaatacttttttgtgataagtcaaaaactaattataaggtagaacatttgctaatatagatttcaaagcaacacctgttaataacatatgttcccattttaaaagtaggtaacagaaattaataactcatagttatataatggggttccaagattttatagtatgaaatgtggtaaaaggtttggtatttattataggatgtgaaaggccccctaaagcacttttaattactcattcatgaattgctaattaatacttccaaactaaaatattaaacactttagaaagactgacccaatattaaaatccaagctgttagattttaaagtgtatgttaaaaaatatttaaactataatatctcttagtgtatatatacacacaaatatctgttttcatatatatgtttatatatattttatatatgtatataatatatatacatagagagcgatagagggagataaaggaagggggttttgtttgtccaatatattttagctgaccacatcattttatgtatttttttatttaaagggccaaggaataaaataagaatgcgaaggtagaatgcagcactttatcctcaattagaaaaatgcagaggaatttaaataattagacttttccacaaatgttatgtttgttgccaggaaacacaggtgcttctaaactcactgctttaggccatgcaaaatttaggagacaggccaattcccctcctctagggaggaaacttgtcagtcaggaaagctcaagagattagcatccaaagccagtttacttctggggctggttaaaagctttcagaggattcctgtgtaattgctaaatattgtaggctaaattaaagttgttatttaaaatgtaaacatcaatagcaactaacatttgattcttgctcttggtataaaaaagcaataaaattattaacaccttggaaagatttgaaaattcattggtagcattaagcaagtaaatatctagcatttagttcatatggcgagaccaattgtgagaacttaaaatacatatttgtgttgatgattctggctactgtttgagaggttatattgccctcttccccaaggatttctcaagaaatgtttatttgatttgtatgatacatttccagctttgttctcagaaatgtcttttctactcacattcattcattctgttcagtacaatactgtgttcattatgctgaggctttaaaattagaaactgtgggggtttgaatcttgtttttgccatgtgatagctgtgtgaccttaggcatatttcacagcctcccagtaaaataaagataaaacagatctttcttcatagaaattatttcaagcattcaatgaggatattaaaatacagaacttagcacatggtgacaaaggaagtactcaataaagttggctcttataattatgatgtagctaccctcaccttcttgattatttctgagttctttttggatctttatgacttctttatattcactagtccctctgcttacgatgaattttttctatgtctattgaaattctagatgtcttcaagatgtcacctcctttacgaaactaatcttagctcccccaaactgaatgcatcattctctgctttgcggcccatagcttcccaaagttacccctatttcagtattcaactcaatatattttattttatttttattgctttttgagatggagtctctgtcactcaggctggagtgcagtggtgaaatctcagctcactgcaacctttacctcccggaggattcaagcaattctcctgtctcagcctccagactagttgtgattacaggcatgcagctaatttttctatttttagtagagacaggggtctcaccatgttgatcaagctggtgtcgaactcctgacttcaaatgatccatccgcctccgcctcccaaagttctgggatcacaggtgtgagccactgcatctggctttgactaaatatattttaattgagttaatatgggatctgccttactgtgaattccatgaaggctgtgaagttatttaattcttctgtactttgtccaaagccatggaagcaccttgcaattggtagaattcaacactgggggaggatcttaaagtaacgaataaatatgtcacaatcgtatgtgcattagagagctatggattctttaattaagaagctgctaagagctactcgggaggctgaggcaggagaatggtgtaaacccgggaggcggagcttgcagtgagccgacatcgcgccactgcactccagcctgggcgacagagcgagactccatctcaaaaaaaagaataaatattaattaccagatgacatattaaatatttttataattctgatattaaaacttataataaaataactttaatgagtggcttggaaattaactgtttaattttcaaagaaatattttgcttttttgaaatgaaataaagacatttcttgttcattaatgactggctctggtaaaagtgacacaaaaaggtgagtgtaacagtgttatggaaaaagatgaaacaggatagtaaaataactgagagatgagcaaatagcctggcccatccagcaacgtagacacatatatctaaatgtgaagttggcgggttcaaacgaatattggcgccatgaggaggctcatgatatctattgctactcaattcatttttttttttttttttttgagacagagtcttgctctgtcacccaggctggagtgcagtgtcacgatctcggctcactgcaacctctgcctcccaggtttaagcacttctcctgcctcagcctcccaagtagctgggactacaggcacgcaccaccacacccagctaatttttctatttttagtagagacggggtttcaccatgttggccaggatggtctcgatctcttgacctcatgatccaccagcctcggcctcccaaagtgttaggattacaggcgtgagccaccgtgcggccctgttgcttctccattcttaactgattgctccagctttacaaaatgataaacccaggaattgtgtctcacgcctataatcccagctacctgggggactgaagtgggagaataacttgagcccaggagttccaggccagcctgggcatcatagtgagacaccatctcaaaaaaaaacagcctgataataaacgtcagtataaaggagatacaatgtgactctcggaaaaatttttaaaaaagttatgaattaaaaaactttgaatcagccttgctaaaagtaaaagaacctaaagtacacaggggtatttgatgaggagcccttagaagtaatcttgttgacctaagcatattacaaaaattgaaattaatgagctaattattattcttcacggtaagatacagaagtagagttcagagaatatttacattttgcctctacaaaaggacgtttaaaaaaaaagaagcctctcgggagaaaaatgaagtagagcaaaggacttactcaagtttaaatttgcagtaactctgtctcttgatttcacaaattaaggagaaggagcaagaagttcccagtacatccaatcatacaactatgaagttccctgacatatttaagtatgtatctataaaaacccctaagatactcaatcatgtgagcacaaagttactgtgtaatcttccatagatgtaaactttaaccacgaagtaagtgatagctacaaagcttgtaaaatatgtttattaaaggaaattgattttttttcagtcaatctagaggaaatggcttcggagatacatggaatttgtttgcttcgactggccatctcacaaagctcattggacttataataatttagttaacaccatattcatgtctccataaaaaccctcataagccacgtatatataccaaaattacatacatgtatttacccacagctacaaatatagtctatgtgagtttcatattaaatgatagtatagaatattattctattctatactatattattatagaatattctattctatattataacatatatattatatataactcgatattatatatatacatttctttaggagatactcatggctgctctgtgtccaactacatttgggagtcacctcttactgaatccttttatatactgggtcacttgcaaaggcttaattgagcatttgactatcatatgccacagaatggatcggacactataaataaaacacaaaagagagtttgtcttttctgggcttcatcttcttaaaaaaatcagctattagacaagcatatgtctaattatatatatcaagcatatgtcatattatatatatcaagttatatatgttaaacatcatacatatactgtaggtagctttttgtggtcacaaagctttactattattatttttatgtacttcttgagaaaaggctatctataacaggataattttaagtaaaaaaagcttaaatctttcagtcaatgttcatatattatcctcataagaacaatttgtgttaggtattcttttctattttaaagtagataaaatataggtacaaacatgttaagtaatttgtctgaggtactagaggtatggcgagaagctgatctcaagccaaaatgtaaaggcctatgtttttctgattctcctattattttggttctatgagagaatgttaaagaaaacataactttttcccaactctcagtccaggactgagaaatctcaaacactaagcatatgagtttgtgagcgaaggtttgcacataaatgtatatactcacatttatgggaatatatgatctgtacttaagccataaactaaatttaaaatttatagtttaaacatgatatttcaaaattctagtaaagcagacacacacttctatttacttttctatttatatttatgtatcttctggtccttttactattttatcaagatacttgaaagcagggatacttaaccaaaagctggtttaggaatggattatgaatggcttatgaatggattgcaggagcatttgaactgctggatttttatgtaaaaggttgtatgtaaaggatattcactgtgtatttttctgaggagtcccacagcttttatcagactgacaaaggatgcatgaactaaacaaattaaaaagcaattaaggtctttataacctctatacatagaaagttctatgttttttctactttttatttccagctggacaaataatgtcttgtaaaagtttagttcactgttttctcccttcaagcccccagtgaagtaggagatgatgttatctatttagtacgggctggagataataaattgtgaacaaagtgaagaatagtcatgaaggctgctttacagaattggaggtaatttggtgtcttttatttactgcagctaaaaggttcttcaaaataagcataatctttgcttcagctacatgtgtttcttccagattttctaatgctcttccacatcactgttttcttggttcaccctttacattttagataaatattccacagtgagaccttcctgatcccaaacctgaattaaataaatactcttacgctctctcatgcacttatttttatttagaaaatttatcataattcttgactacttacatatgcttgtctaatagctgatttttttaagaagatgaagcccagaaaagacaaactctcttttgtgttttatttatagtgtccgatccattctgtggcatatgacagtcaaatgctcaattaagcctttgcaagtgacccagtatataaaaggattcagtatgaggtgactcccaaatgtagttggacacagagcagccatgaatatctcctaaagaaatgttccacaggctgaaattaaggcataatctctagaaaaatgttttttaaaagttgtgctttataatatcacatttatcatggaaatatatctgatcattatgtatcaataacagaaatgtgtgctttactattttctttaggttttgctaaaacttactaccaaatatcctgaaattaatttcactttaaagctaaataaattggtctatatacactaaagtcataagtgaacattttcttttagtagacaattatacaaaaaaattcccttttcctgaaggcatttcttgtctctgaaaataagaattttataattggtcttattttccgttttctttggcttctaggggtcccagaataacatacgaatcaattatttatcttcttagccaacacccttaatccaagcaactgacctcttttgctttgattacattactttcaatacattctcataacctcaccaataaagagctatttgacagatgaatgtgatcaagacaccctttgcttacaattcttcaatagcatactactgcttttaagatagatatccgaactcaggagctttcatttcttgaatgaagaggcttctgtgtagttcctcctcgtcttgtagcaccgtaattttcttttttatttatttattttattttatttatttatttttgagatggagtcttgctctgtcgcccaggctggagtgcagtgtcacgatctcagctcactgcaacctccacctcctgggttcaagcgattctccagcctcagcctcccaagtagctaggattataggtgcccgccaccacgtccggctaattttttgtatttaaagcagagatgaagtttcactatgttggataggctggtctcgaactcctgacctcaggtgatccacccgcctcggcctcccaaagtgttgggattacaggcgtgagccactgtgcccagcctgtaattttcttcttagatatagttaccctggcctttctgttccttcccacaataggagctttgcataagctctttactccaacagaataggcttccttgatattctctttctgaatacagataatgtaaatattactttacgttgtaaatattaacatttctctgactgagtgtacgtcttccccattgacagtaagtttcacaaggataggaaacatgttttcagtttttgtcttgttactgttttgttttctcatcatactccagcaactagcaccttttatgtactgtttttaattaaaatttgaatgagtgaactaaaacatcaggccttaaatctgcatacatatttggctctagtcaattatatatatacttctttattttcactaatttggttgcacattttattatgtctccaaatcattgtgaaagacagtaagcaaaaactgacaaattagtacaatcttggaattcatgtattataaaaggctggttcagattgttttactcaattgtaacatgttttgattgaaacggtgtaaaacaggaaaaaattatctagaaccaaacttttattgcatgttggctatggaaaagtacaaataataactaagacgtaatcaactaggccataatcttgatgagttttcagatttgattatattatatatagatataaaataaaggaattaatattttaataaaatcaatgaaacttcaatatattttacaatagattttaaatactatgttgattttttatgaaagttcagaacatcaaaaagactaatgcaacataaatttgccatgagtttatacgcaccttaaaagaaatgttcgcagattctacttgtatcatgatgggttgcttttgtgacataactattgaaaatgtgtgttttttttttctgcagtacaatcttcacattcagatttaattgtaatcttagccaacttttgctcatagaaggattaatcatatgactttttgtttacacacaatcacctgtagaaagcagttatcattctattcatttcttcattcattcaacaacactgacttttatgctactctatgccaggccctgagtgagttctgggagatactaatatacacttaagttctgccatcaatgaacttacagtcttttgagaaagacaaggcaatagtttcagcatgacttgacaaatcttaagaaaaaagagccagagaaacatagaaagagggatctaaattaggctagaagaaatagcaaggagtagatacagggaggaagggtgtcccagacacagaaatatgcatgtgctatataaaattacataatatatttaagaaagagcaagaaggccgggcgcggtggctcacgcctgtaatcccagcactttgggagtccatggcaggtggatcacctgaggtcaggagttcaagaccagcctggccaacatgatgaaaccccatctctcctaaaaatacaaaaaattagctgggcatcgtggcagtcaccagtaatcccagctactcgggaggctgaggagggagaatcgcttgaacctgggaggtggaagttgcagtgagctgagattgtgccattgcactccaggcagggcgacagagcaagactccatctcaaaaaaaaaaaaaaagaaaaaaaagaaagagcaagaaatttcatgtagttgggatcaagggcattttgaggtaagtaagacagattttaggttaaaggggtagccaagatttttaaattctaaacatatttgaaaggaaaaaatcataatctaattttttattactctttattacaaaaacaaatttggttttaaagatcaataaactacatttttaatacaaagtagtatatacaatatgcatgtaattaccttttgctatttcaagctttgctctgtgtgcatacaaatatatcaatacacatatataatttttaaaatacataaaatcttaatgtgtacaacacacatatgacaacgttttgaatatttaaacaaaagcaaatgacttgctaaattgcaaatatgtacatatggaaaatagatatatttgctcatgcaactgctttttaaaattccattacttctgccaaatcaagcaacactcacacgggtggtataagtacacagaaatagcgaacaacataaatgttagcattcatagatcagccttttatgggaatgtaatttttcatgtacaattcactcaacatattaaaacaatctttttatgtcccttgttatggttttatcagacaagcagaacaatttcaagggaacctaagagtagactatcaatattagtcattgctcatgttgtgtttacaggaagttcactaatttacattcgatttatattaataatcaagagtggaactgcaatgaagtgcaaactttctttttaattctcttttctgtagtgtacaaactcatgtatcagtagctttgggggctattagcactacctccagaatataaacctgtcatattttaaatttgcctcatttcagaagttttgtcttcttatattcaaaggagcatgcttggtatgagtcacagtatcaacttctgcattgaatgttttctaagccatctcaaaatgcatacaaattgttagaaatcaatctcaatttatttatctaacatatttacatgatatccaaaaatgaagacaggatagataatagaaatctaatataaacctgtaagctattttaacaacatcaaatgtatggtgtcccttaagagtgctaaatcaaacactacttcttccagaattttttttttttttttttttttttttttgagatggagtctcgctctgtcacccaggctggagtgcagtggtgcgatctcggctcactgcaacctccgcctcttgggctcacgccattctcctgcctcagcctccagagtagctgggtctacaggcgcctgccaccacgcccggctaactttttgtatttttagtagagacggggtttcaccatgttagccaggatggtctcgatctcctgacctcgtgatccacccaccttggcctcccaaagtgctgggattactggcgtgagccaccgcgcccggccttcttccagaatttttgggagatgtaaaataaagagatgatttaaaaagctctttgtgaatgcatattttaatctttactctggctctggagattttatagaggtaggtaaactaaagttgtgtttctaaataatgtttctgtaagatatatttttaaatctataagttaaaatgtttcagagagataatgcgatctgtttgaagccatgctatattttggagacgactttttttttttttatttttttgagacagagttttgctcttgtcacccaggctggagtgcaatggcaccatcttggctcactgcaacctctgcctcccagattcaaagattctcctgcctcagcctcccaagtagctgggattacaagcatgcaccaccacacctggctaatcgtttgtatttttagtagagatggggtttcaccatgtgggccaggctggtctcgaactcctggcctcaagcgatttactcgcctcagcctcccaaagtgctgggattataggcgcgagccaccgcacctggccaaagggacaatatttctttaggtcaaagggaaagtttacaacaaaccacgtaaccacacaaactgcaagaacaaatatttcccttctgagctgccttagcaaagggtatctgggaatatcaaacagaatgattcataagcaaattataatgtccagaatattcaaattttcaatatcaagtttgtgttttaccagcagaatcaaaattataagaaattatcgagtttggtctcagtatagttctatgtgctataaggatcctccagaatgtaaaaaataatacctgttctcaagaatcttatttaacagttgagagaatgagctggatctgaataaaacacataaactatgattcttagacttttatcacctcagagatatgctaggaaaatactgtattttttaagaatccctttaaaaactttccttaaagcaataacacaagcattctagatggttccacatagaagcagaaaaaaaatacaagaaagaaagctctatataaccaatccctgatttaaaattgtgaaacaatctcaaataggtccagtcccatttcattaccaaacatctacaagtttatgctctgggtttaccatcttttgatatctcctccctaataccagtgaaagggatatggaaatttgttgatacagatgttactgtagaattaatactgacagtgatcagtgaaatttacattggggtggtaattagttattaatgatttaaaatttttacagtgtcacctttactgtcttctaacgatgtgtgtccaaaacagtatttatacatgagactcttttttttttttttttttttttgagacagagtctcactcactctgtcgcccagcctggagggcagtggtgtgatctgggctcactgcaacctctgcctcccaggctcaagcaattctcctgcctcagcctcccaagcagctgagattacaggcactggccaccacgcccggctaatttttgtatttttagtagagacggggtttcatcatgctggccaggctggtctcaaactcctgacctcaggtaattcatcccctcagcctcccaaagtgctgggattacaggtgtgagccaccatgcccagccccaccagtaacattttaagggctcaatagtcacatatggctattggctactatattggtcatgatagatacagaacatttctattgcagaaagttctattagcactatctgagcaatataactttttattgtcactaagaggaacttacctagttatttactctggtctgctagtatgattttacctgtaaatataatacagcatatttggactgcaacacataattgaatctttcccagataggacagaatatatgtatttgttctgttcagaaagattcatcccagtttagcggaagagaaaacgaagcctcaacacctataatagctttttaaatatcacaaaactggtgcttatctatcaaagaatactgacaatgccattaaaattgttgttctctgcgctgtatataaatatactgaataatattggttaatatgggtatgcctaggagcaagttgctaactttctttgaattatagtttctcatggtgtaaaccaattctgcttgaatgggtctgctgtcattggatgtggtataaaaattgtgaggagcttagcataaccataacctagggcaaacccaagcccttctcttaagtagcacggcactaaagacttataacttgagtgcttttcaaaggtgtgtggaggctgtatcctctttactgctccttccctgtgttatatgtaaacaatgtttatttagaaacagaatgcttgttccctggtgctgcaaagaaacagcactcgaacataaatttaactctctcagcaaggtcatttttactttttgcagaaagggtacactcgccagcagttttgccacgagagtacaccgaacaaaggagacagggtcatttataacctgacatgtttactctactgctgtgtccggtttccattggctggaacaggaccacacattctgtatttgtcccgattggctagcaacttagaacttttcaaaagagacaaaggcagaggagaacaaaggaaggaggaagtaacttgtttccacaagttacttgctgagaaaggtaaaaacaccttcaaataaggaagaggaacaggctatgacctaatgcgtgcttggaccagtataagcatgccagggcaaatatttaggctaaattgtgggaactaagaacataaagtacattgatttctttattacggctagtagatatttaagaatgttagcacaggtcgtttaataaattttgcttctaggagacgttactatttattcccatttagatgggtaggaaagtttctttggagagaaacctctactttttacacctgcaagagctcaggttgtaagtggctgtatttctttttcaaaggtcacagctcttgttgggcggtctctcctcagctcctccatttccaggatctagtaattgctccctcacattttaccttttttaggcctagtggtgggttatgtctttctattgtccccagagccaggggccacctgcatcacagtattcattagtttcccttaaccctacccacaactttgaatattgtttcttattgcctctcatagtttacccattttagcatgccgtgtgtttgttttcttgctgatctctgatagataagcatccagagatgatgatatgtctgctattaattaaggatttgttcgtcactccatatgagttaataaaagtccaaaatatgacttaaaattaacaaattttgtatgaacttgtggttgttccatatctatctagaaacatatctctagaatagttctcatttcatgtcgagattaagatatttagtatatagtggcattaactcttcatcttgcccattaaaggcaaaacagattgttttttaattatttcttcaaatggaacttcctttcataaagacaacgtgtactgtaagcattctttactgttttttacagccaagaaaaatcgacatagtttacacacctattgatttgtcataagatgtcaactagagaacaaaaaaaacccaaacagattaatggacaagagtgttaattgcaatgatatataaaaaagccaaaattacataatagctctaacgtaatagctctgacacgcaacataagaagataaagaatgaactatctataggtaatatttaaaaatatatgtagaaaccattaaggcattgttgactcaaggacactggaagagatgctggcccaatccaaacagatgctggtttaaaatgactggactattcttacaaggggcacaccaactcagtatcagttctacagcaaaaccatatgacagaatattatggagcaatgtaagtaatgattaagttttacaatgcaaagttagacaccaaaaaatatctaactttattaaggaaaaaataaactgtttagagaaaggatgttttagctgtgggtggctttccctctgttttaaaattatacttttaaaatttctttaaatatcatgtatttctttgttaaagatggaaacgatgaagccgggcacggtggctcacgcttgtaatcccagcactttgggaggcagaggcaggtggatcacctgaggccaggagttcgagaccagcctgaccaaaatggcgaaaccccatctgtactactaatataaaattagtcagggatggtggcgcatgcctgtcatcccagatactcgggaagctgaggcaggagaatcgcttgaacccaggaggcggagattgcagtgagccaagattgcacagttgccctctagcctgggtgacaagagcaaaactccgtctcaaaaaacaaaaaacaaaaaatgaaaaccatgagtaataaatgaaaatcaattaactcagagtgtattaatggaattatatgtgtatcaagtacaatatttaactaaattataattgtaaaactcctgaatttggatagaatatctcagaaatctacccctaccaattttttcatgttaatatcacctcttctaaaatctcatcagctcctaggaaatgcctagattttaaaaagcaactataacctatggataggatggtccctgtgtggccactaggaagctgctggaagagaaagagagatatagtatattctgtagccatgtgacaagtgtgggaccagaagagcagttagtgaggataattttgcacagcatttgaaattcttacattaaagatactttgttggcaatcgcagcgtttatttgtttatttggttttacatataaataaaaatgcattcctaagcatattaaagaggcacttgtattgttaatgtcctactaaagctaggaaaatacagtttttggatcagatctaaatttaagtctagattctgccacctaggagctgtaaaatcttgtgtaaattactgaaaaatctctctgaaccctattatctatattgatgaatgggcataagagaaactacttcaggccaggtgcggtggctcacgcccataatctcagcactttgggaggccgaggcacgcggatcacctgaggtcaggagttcgagaccagcctggccaacgtatagtgaaaccccgtctctactaaaaaatacagaaattagctgggcgtggtggcacatgcctgtagtcccagctacttgggaagctaaggcaggagaatcgcttgaaccagggaggcggaggttgcagcgggcagagatcgtgccactgcactccagcctgggcaacagagcaagactccatctctcaaaaaaagaaaagaaaagaagaaaaaaaaagaaagaaaaactacttcaaatggcttttgggaagaactaatgtgatagtgtgtgttgaatgcgtagtgcctgatagtgcataattaataaatgtttattcccttttctaaaatgaggaagtaaataatatggtaaatgacattttttctcttttttaaattatattcacaaggtagacttgtttccctctatatcagtaagcttgtttatttttaaactggctcaaggcaattgaagatatttcagataacagaagttaacctttccatcctcttggtattcaaattctttctcctttgataaaactttcaaagaaggttttcaatgtttattccaaatgatttcaagttgacgttataagttcaaattaaagtttgaattcaaatccaaacttcctaaacttttctaagacagtaaaataaccattgttctttaggctcacggacttcatagactgtcacgttttatttatttcaggtttgttgtttgccacaatagacattcttctctttgaaataaaataatatttcctctatttattccttgagataactctaaaatttattcattaaaagaatcgtcctttaagtataattttggaaaaaaagaaacttccaaagaggagatattaccccagaaggctggttttttttgtttttttttttttttaagtattccactttaaaaactcaggtgttacagttcactgagcataatgtattggatttctgggaattaaaggcaatgttatttgacaaagttctaattaactggttgtacagttaaaatttttttcttcaaattttctcatcagataacctctcaaatattttctcatcaaataacttcttagaaatggaggttttattttaaaaaagacagtgttacatttaatgctaggattgaaatcttcctaaagtgggagaataaataataatgatgtatttctctgaatgctttattgattccactacaatttgtccatgtgttaccatgtgttaccatacttggtatattatttcatatccagagtccattcagtcttataagagcttattaaatacatactaatacatatcaaattataaatgaatcagtgggcattctacattttacatcgtatatatgtacatatatatctacatataaatgctcaagcatttagttgttaagtgaacgcttttcattggcaagaaaaacttacttgatgtttaattggttcaggttgcatctcatgcacatacttaaacccgtaaatggcaagtggtatggaagcatataagcgaattaaagtatgattcattttctgtgacaaggggtagtctcatttctttactgaagactactgtgaaattgtgaggatggagatctgagcaaaatcagagttctattggaatggacacaggaatgagcctatctggtaggtgattaaggtatctgttacaacttgatacacaacaagaaatccagtaatattaattggtaagacattcttctagcatcacgatattaaatacgtccagaattcctataaaatctgtacattaagttaatttctttcaaaaattaacttttggttctagagtactttgatgtgtttccataactgacctgtcaggcctctgagcccaagctaagccatcatatcccctgtgacctgcatgtatacgcccagatggcctgaagtaactgaagaatcacaaaagaagtgaaaatggcctgttcctgccttaactgatgacattccaccacaaaagaagtggaaatggcctgttcctgccttaactgatgacattaccttgtgaaattccttctcctggctcatcctggctcaaaaagctcccccactgagcaccttgtgacccccactcctgcccaccagagaacaacccctctttgtaattttcctttacctaccgaaagcttataaaacggccccacccctatctcccttccctgactctcttttcggactcagcccgcctgcacccaggtgattaaaaagctttattgctcacacaaagcctgtttggtggtctcttcacacggacgcgactgaaatgacccattagaaaagcatacttacttatgtcttgcattttttgagctataatttttaaaaaatgtaaactcagaaatgtatggaatcactaaaaaaattatagaaaatgggatctcacagttatgtctttgtaactcatgcacattaaaagcaatcccaaataaaaataatgataaatctagcataataaatcattatttctttaaatatatttttcctaagaacagaacgataactcaaatttaagtgttccaaactgataagtcctcaggggaacactaaaagtgagagtaatttaaaagtagaatatcagtagattttagcaaaagaaaaattgatagtgctcattaggaatttatataatttattgaatcataattacactattgatttacataacagactcctttcacaggtaaactttctcctagagttttgtcatattttacaaattctaaatgagttagcccacttaaatgtttgtttcttaaaattttctagcacagaaaaatatgttaataacgttttaaaataataatgtagtgtgtttcttttgaataaagagactatcatgtagaaactgtcaggcctctgagcccaagctaagccatcatatcccctgtgatctgcacgtacacatccagattgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccctttttcctttatctacccaaatcctataaaacggccccacccctatctcccttcgctgactctcttttcggactcagcccacctgcacccaggtgaaataaacagctttatggctcacacaaagcctgtttggtggtctcttcacacggacgcgtatgaaagaaacatttaaccattcttaattcaaacacagacgcccaagtaagaaaagtgaatttataaaattgggtaaaattcacaagctgaattattagttcacaaactgaaatatcagtaataacctaaaatagtgtttattctcaaagacaatgtgaaaactctcattaggcattagaatctacttttcaaactcaaaagtgaatctccttgtaattatcagagctaaatatatgtaaacaaagtaactgatttagttaaagtgattaaacttttttcccattctcccccagttaaaatgaacagtggctaaaaattattatcttaaaggtttatccatagttccaattgcaacattttaaaacgtctattcctacatagaccattggaatagaatagagaagccagaagtgaagccaaatacttaaaaccaatttaccttcaacaaagcatacaaaaacataaattgggcaaaggacagcctattcaataaatggtgctgggaaaatgggacaaccacatgtggaagaatgaaactggatccctatctcctaccatatacaaaaattagctcaaggaggattaaagacttaagtctaagacctgaaaccataaaactcctcaaagaaaacctaggaaaaactctcctggacattggcctaggtaaagaatttatgaccaagacctcaaaagcaaatgcaacaaaaataaaaataaacaaatgggatctaagtaaactaaaaagcttctgcacagcaaaagaaataaccatcaacgtaaacagaaaaccgacagaatggaaaaaaatatttgcaaactgcatctgacaactgaccaatatctacaacctacaaagaactcaagcaaatcagcaagaagaaaacaatctctttaaaaagcttggaaacgacaagaatatacatttctcaaaagaagatatacaaatgatcaacaaatacatgaaaaaatacttaacatcactaatcatcaggggaatgcaaattaaaaccacaatgagatacttccttatcttagccagaatggccattattaaaaagtcaaaaaacaataaacgttggcatggacaagataaaaagagaacacttatatactgctggtggaagtgtaaattaatacctctctggaaaacagtatggagatttctcaaagaactagaagtaggtataccattcaatccacgaatcctaatactgcatatctaccaaaataaaaataagtcactatatgaaaaaggcacctgcatacatatgtttattgcagcacaattcacaatcgcaaagatatagaatccaccttagagtggataaagaaaatgtgagatacacacaccacacacacacacacacacacacacacaccatagaatactactcagccatataaacaatgaaataacgtcttctgcagcaacttggatggaactggaggttattattctaagtgaagtaactcagaaatggaaaatcaaatactgtgtgttctcacttataatgggaactaacttatgagtatgcaaaggcatacagagtgatataagggacttcagagactcagaagtggagggggtgggaatgagggataaaaaactacatattgggtacaacgtacactactcgggtgacggctcaataaaatcccggacttcaccattatacaattcatacacgtaagcaaaaaccacttgaaaccctaaagctattgaagtacaacaaaataaaaaataaaatgtatattccaataagaggaagtttgtagtcttatattcttattgctcagcaaattgtacattaagggcatattgaatattccataaaatatttttcactaatttaattactagtaatcatgtaaagccaaaacataaacattcacagggcttcctggtgatctatttcctcatattttttcctcctcattatttgcctcataatgttttgaacacatccactgtcttcaataagcttcccttacaacatcaaatgtgatttcacctattttcccctattcacttccaacagagattttagttggttatcagatcctgttgtggctgacaggcattagaaatagaaaattatcaagttacttgaggccatgaaattgagggccaaacacagatttccaaaaagcttgctgttttcgatatggttatgtcttcagcccacatcctgtcatgctagggcagttttccatttacagaagcaagtggctgtaaggttttgtggtagtcaggtagatgtcacagcgcaaacaggaattaactcaatacgtataaaagagaaagctttcgaaaagaagtttaaggccgggtgcagtgactcaacgcctgtaatcccagcactttcggaggcagaggtgggcggatcacctgaggtcaggagttcaagaccagcctggccaacatggtgaaaccccgtctctactaaaaatacaaaaattagctggctgtggtggcggatgcctgtaatcccagctactcgggaggctgaggcagaagaatctctttaactcaggaggcggaggttgcagtgagccgagatggcatcattgcactccagcctcggcaacaagagcgaagctctgtcccccccccccccccaacacacacaaaaaaaacagcaacaacaacaaaaaacaaagtttgtgtataatacatgccaagagggtaggaataaaataccatttgctgtcaagatatatttctaaacaagtttattaggaaggcagtagcagatatgaaaaaaaaataggatagggcactggaaataataaatttaaatcagcatttttttaaatttagaaattcataatctccaaccaacagaactaatacttaagtataatttccatggtaatgattatttaaaaccccatattgactatgaatttatagatggtgattccatatgcaaaaaagcaaacttgcatttataatagaaatgagaacaaagcaacagaatgtgtaatatgttgaaggagtcattaactttagtggaggacagtcaagttcctaaagattcatttatttattcattcattcagcaaaaaaatagaattatttagttcaggttataattccagattctttataaattaataatgactttaaatgcatgtgaatttcatagtactgtatatttttttatctaggaatatttttccttaaatgatactattctccgaatttaataaagtaccatttctactgatagattatgacttttaaaaaattggtttataattaaggaaaatatgaataaaaaggacaagctgattgattcattaagaggcaaaattatgctagatattgtatcaacaatatattgttttactaacaataaaactaatgtttccattaactaaaataaataattagaatgactaccatttttgaaatacgtagaacaaataacaaattttagtgcatttaatccctattttaattttattaggtttttttttcagttctactttacatacaagcaaacatgctgagctaagctaatacaaaataatacattttctgttgctgttgtttgtcttctgttttttgagacgaagtatccctctgtcacctgtcacctaggctgtagtgcagtggcatgatcttggctcactgtaacctctgcctctcggtttcaagggattcttttgcctcagcacccccgagtagctgggattaaaggcatgtgccaccaggccggctaatttttgtatttttagtacagacggggtttcactatgttggccaggctggctcaaactcctgatctcaggtgatcggaccgcctcagcctgccaaagtgctgggattacaggcatgatccaccgtgctgggcccagaataacacatttaagaagtgattttggctggccgcggtggctcacccctgtaatcccagccctttgtgaggcccaggagggcggattacctgaggtcaggagtttgagaccagcctggccaacatggtgaaacctcgtctctactacaaatacaaaaaattatccaggcatggtggagggccaactactcatgaggctgaggcaggagaattgcttgaacctgggaggtggaggttgcagtgagccgagatcgcgccgttgcactccagcctgggcaacaagagtgaaactccgtttcggaaaaaaaaaaaaaaagaagaagagagagaagtgatttaaacctaagtctgttcaattttaaaacttgtaatcttaaataaaaattatatttagaattatagtatcaattttattggccagttaaaattttaataaagtagatatatatgcaatttgtactatcagctatagatggcttgtttgaccacattttaatgtgttacatattttcatttagtatagttcatcctggaatattaagttccctagatcaaccactttttaatatatactcatgctattgttttgaaaattagagataactgtttagctttaacataaggctttagactggttaactagtagtgtccattcaggtccctgctggtttctgtttgaaatcaaggccaataataacggtcttaaagaggattattggaaaagttaagatgtgaaccttcttgctcaacaaagaatgcaagcaaaattgtcttaatctagaacagtttgaaaacactatcttagtctattagtgtattttttcagtccggtttgtttcttctgcttctttaaatcatagttgtttttctggatgaacttcattataatctggaaattcacattgacatttctcccagaaagccaaataaagcacacatttagaaagcctaagtacagcatctaaagcttccttgaccattataactgaataacagccgtgtagtgtagtgctaaaaaaaaaaaattattccagttacatggttcagtctcttgagatttacaggtagccaattatggcccacaggccagacaagtgactgatcgttgtctgaaaacaacgacgaagtggggaggtgaaaaagatttacggttttttttccccttacaggtagatgttgtttgaaataatgagatttaaaacgctaatgcagagctttgatctcttctttgatgtttcttgcctgttgtctatatgaaatatagtcagttaaaataaaaagccagagaatagtttctactcactaatgattaataaaaactgcttggcaaatgcaatcttgcacattgacaaatgaaaacagaataggatgcccaacaatggtttaaaaaaaaaaaaggtttttttgtttgtttctttgtttgtttacattgccacagtacactgctctttgttccctgaccctgcaagctctcaccgggtgacttcgactttgcacctacttttctcttttttagaatgccctctctcacatgttaccactagagaaacaatcacgtgtgcttcaaggccaaatcaaaaatttcctcttcagtcctttggactgagagagttatgcccaatttcacagcatatggtacaagcctctgttatttttctgtaccatggtattatatgtacttgcctgtgtctcttctagatatggggtccttaactatttttgtgctatggatccctttggcatctggtgaagcatatggaacacttcccagactgttttcaaatgtgcaaaatgaaaactaaaagcatataaaaaacaaaggaaattaattatattgcaattgtaaaatactgaatataatactattatatgctattaatacattagttataagcataataattaatacaaattaaaagtagtgattagtatactaaccactggtatatattaacatatgatttttcaagatatccaaaacaactaggatttgatataaaaatattggtaataaattcacagatattgctaataccgttctgtgttgcttatcttcataaagggaaagaaatgcaaattttcagttacaggttagtgaaaataaagatgtaatttttttcctatcatggttcatggaccccagattaaggacactgtattttgactgtatggcttcaagggcagagtttttatttgttcatctttgtgtctttagtacagaacagaaccatgggcacaatccaagcctattgaatggtggccgaattgtgtattgaacgttcaaatgtcagttctatcactgcccttatcacatcacaagagagaaatttgatgttcattaaaattaataattttaaaaaacattttaattaaaatatttattataattaaaatctgataaacttgtcaatgggtatgatacgtggcactgtgtatattcttttgcttatacacagatgcttgaaaattaaaattaaaaagctactgcaactaagcactcagcaattgtcatatttttctccacttttccctaagtcaataggcaaccatgaagttgacaatgttgctgataacattgtcatactcaacatcatttcccacaaagcttaaacctctacagaaactcagcagtccctacaacacatccttgaagaatgagaggggtgtcaataatttcagctgctcaaatggaaggctctgacatcaaggaatattaagtggcacattgaagggaattctactattaagtaatgaaggtgaggaaaacaatttctcaatccacggttatttctttgttatactaagaaccgtgcccaatacttatggaacaaaataagcctatcatttggacgtctcctatcagcctgaagcctgatgtcatataaaccaataatctgtgattgaatttttcagctttcagtgttttatttttagcataatatttggtattgccatacgtgacttattattctgttcaatttaatcaaattagagaataaacaaaacgacaaacataatttctcttaatgtgcgtgtgtgtttttcttttttgagacgaagtttcattcttgttgcccaggctcgattcgagtgcgatggcatagtgttggctcactgcaacctctgcctctggggttcaagggattctcctgactcagcctcccaagtaactgggattacaggtgcctgccaccacgcccggctgattttttttctatttttagtagagaccggggtttcaccatgttggccaggctggtctcaaactcctgacctcaagtgattcacctgcctcggcctcccaaagtgctgggattacaggcgtgagccagcatgcttggcttaatgtgttttaatgacataattccaacaaccatataactatattagtacaaaaagcaactacatgaaataaaaatctcaattgtttgccaaatggatacaaataatatatattacatatattatatataacatgcatataataaaatacacagtagtctgcctcttatccatggttttggttacccatgatcaactgcagtccaaaaatagatgagtacagtacaataagatattttgagagatagagaccacattcacataacttttatcacagtatattgttataattgttctaatattagttattgttgttaatctcttatggttcctaatgtatatattaaactttgttatatgtgtatgtatataagaaacataatatatacataaggtttggtattatccacagtttcaggcatccaccaggggtcttagaacacgtatccctacagataaggggagattaattatttctaccattacagaattaaaatgagtctgtgttaatcttcctattcaaaaattatttctaattcagagaaattcaaagagagtctataacgctatgcggtttattgacattaaagacattaatagttaattgcttgaagaagaaaatagactttttcagtaataataacaaatttgcagcataattggaagtgtaccgtcctatccccctttgaactataaaataatattttggtaaaatatggtgaaggatccttacagtgtatcttgatcatagtcctcctgagttataattatctacattattatactaaaattgtggctcttcctcataagatattaatatattcactatatgaaattaactaattgcatagctccaataaaatattaacttattcaactgttaaagtaagaatatcggccaggcgcggtggctcgtgcctgtaatcccagcactttgggaggctgacacaggagaatcacttgaacctgggaggcagaggttgcagtgagccaagactgcgccattgcactccagtttgggcaacagtgagactccatctcaaaaaaataaataaaataaataaagtaaaaatattaattgcatacaaaaaagaaatatgctggataccgtccattgtattagcaatttcaaggctaaacattacttttttttttttttttgagatggaattttgctcttgtcgcccaggctggagtgcagcggctcaatctcggctcactgcgacctctgcctcccaagttcaagagattctcctgcctcagcctccctagtagctggaataacaggcgcccgccaccatgcctggctaattttctttgtatttttagtagagacggggtttcaccatgttggccaggctggtctcaaactcctgacctcaggtgatccgcacgcctcagccgcccaaagtgctgggattacaggcatgagccaccgtgcccggcctcaacattactttcgatctcaagactggaagtgcagtactcaacaaagtaattggggaaaaaaatagtttttgatgtaaaaattttagagttcttgatctttgaatgaagttggtctcccaataaatttcaaacgaataagaaacattagatttgtttccttctggctctagtatataggaaagacatttgcaaagcaggtattccaaaatatgaggcaaaatcatcattcttgcccccccccccaaaaaaatcttctagcaactgttgtaacacagagccattataatgtaattagacagactaagaaccagatgctaaggaagcaaaatataaaagatgaagcatgatattattttggttaatgaatttaattccaaatgttacaggagtgattcatggactttttttttcccaaaagatcagttgtcacatgtacatattgcattttaacatgatgtttatgtaatctaatgagaaaagtaaattctcatgtaatattagatgtttcgaaatggataaactgcagacacttccacgggtagatgaataattcgtcaatagtgataagttaatctttaaacttacccctcaaaatggttaagagttaggttatactataaatgtaatataattccataaaaataaccaagacaaaaaatactttagaaatattgaaaatataatatttgttttcctctaatatcctcaatctggtattattgtgtaattcgaatatatggcaatattattattatttttttttttttttgagacagaatctcacttttttgcccaggctggagtgcagtggcatgttcttggcttactgcagcctccacctcccgggttcaagcgattctcctgtctcagcctcccgagtagctgagattacagatgcccaccaccacgcctggctaaattttgtatttttagtagagacggggtttcaccatgttggccaggctggtctcgaactcctgacctcaggtgatccgcctgcctcagactcccaaagtgctgatattacaggtgtgagccaccaccgtgcccggccagcaaaataattcttaaaattcaacttaaaaattactccaagaaatgtgtaggtaaaagtcaaaacactttagtaaatccacattttgtatttccatttatagtaacctctagtgctcattattttgaagataaaactttcttatacagtaagctttttaaaatgtgagaccaaatcaaacaacaagagcgtaatgaaaaacgatagaaggaaaacaactaaaataagaacctcctagctcagatttattctaaaaagttgaaaataaatataatgtagaagttattattatgaaaacataaataataatattttttcatagatagtaacactagctttactctgaaagtagaatctgtgcttcattaatagtgcctgtgtttaacactttgataactcaccatacagaagtatagcctcagtgttcccagattcctgttcctagggatgaatgatcacattaggaaggtacattcctgttaatttggctaaatctgccagcccaaatcataaagttctcctaaagatgctctatctcaagagcaaacacttaggaaaattgttaatgtttataacaaggcaatcaacatctcatttaaatattcagaaattgatccttccacttcatactttcagttaggatgagcattgaaaacatgtagtaaagcacaacctcagcattcataatgaatatgataagaacaagccttttctcattcatgtttactaccaaacatctgttgaataaactacttaatccttacaaacataaccagattattttcagcaacaatacaaactctatagtgataacagctggtcctttactttcttcagggatatacactccacatatatttcatttcttctcaagttaagtgacaaaaagctaaaatggattgtgatgcagtcaaagccacgaatgacacagttttctaccatagacaaggggataattttttttttctttcaatgtaagccacaagtgtaatggggggatctcctaaacgaaaggcattatggtagggggaggttccttttcaagaccacgcctaaactactgataaatatgataaatatatggttgtaaaagacaacatttctttttttttttttcgagatggagtctcgctctgtggcccaggctggagctcagtggcgtggtctcggctcactgcaagctccgcctcctgggttcacgccattctcctgcctcagcctcctgagtagctgggactacaggcgcccgcaaccacgcccggctaattttttgtatttttagtagatacggggtttgtatcactgtgttagccaggatggtctcgatctcctgacctcgtgatccgccggcctcccaaagtgctgggattacaggcgtgagccactgcgcccggccaaaagaaaacgtttctatgaacacagtattacttatacaatatttaaaaacatattatttgatgctcaatgttttataaacaatgattcaaaaatgcagagctgggtgagcacggcggctcatgcctgtaatcccagcactttgggaggccgaggacagaggatcacctgaggtcagcagttcgagaccagcctggcccacatggtgaaacccatctctactaaaaatacaaaaattggccaggcatggtggcgtgcaccagtaatccctgctattcgggaggctgaggcagaaaaatcgcttgaacccaggaggcagaggttgcagtgagccgagatggtgccactgcactgcagcctgcgagacagagtgaaacccagtctcaaaaaaaccaaaacaacgacaaaaaaccacagggctggccgggcacagtggctcacacctgtaatcccagcactttgggaagctgaggcaggtgggtcacctgagctcgggagtttgagatcagcctgagtgataaggcaaaaccccatctctacaaaaagtacgaaaattagctgggtgtggtggagcgctggtagtcccagctactcgggaggctgaggtgggaggatcacttgaactcaggaggtcaagggttcagtcagccatgatcgaccactgcactccatcctggatgacagagaaaaaaaatgcagagctactgaggtatttacaaagaaatataaagcacagcacgtgctctcaggaaatctataaaaaagttaaaaagttatggaatcaaagttaatccacaggaaataattagcaagcaattatgtcgataactgggtagaaataactatgtggaacaaaagttcatagaaaaaagaggtgtttcaagccgttagagaaagtgttgtggtaactaggacttgaattgaatttttgaagatgggaatgctttagaaccaaaagtcgatggaggaaaaagattccagaaagggggaatcagactagaaaagcaagaataaatgagctggcctgtataggagagagaatattttatgcagagtatatagataaagtaacacagttcaaacccttaaaagtgtatagccagcatagttttctgccaggattcatactgctctcaaatcagaagatactctactagatttaagaattacatagtcaatcagctgaaagccttggaactttcggctacatagtcattaaaaacactactattatagctcaatttcaccaggccacattatatatatatatattttttaacataatgtacacaatacatatatacaattttgccaattaaacttgtttttcaaaaagtaactcattttatctaaagaagttaagctcatcaaagcaaagtggaacagtggtagccagtaactggggatggaaaaaaatggggaaatgctggtcgaaggatagaaactctcagttataagatgagtaagctctggggatctaatgtacagcatgttgactatagttaatagtactctattgttacttgaaatttgctaagagagatcttaagtgttctcatcataaaaaattataatggcaactatgtgaggtgaaggatatattaattaacttgattgtgataatcatttcagaatgtatatgtatcaaatcatcatattgtacaccttgaatatacccaatcgccatttgtcaattatacctcaataaagctgggggaaaaggtacctcatatttattattacattttattgttataacacatatattttatctcatttgacccttgaagtaactgaacctaaaaagcagtatttttagatatgaaaactgaggcccattgaggattaatgattctcaaagccacagggtaagcagtaaagttacaactcctctcatgtgtcctgattacaaatcattacctaacgtctgtaatttccttgcatcatcgagaacctgaaacttttatcataaaaacatttctaggaaatctggtaccatacgctaatcaactatggaaagaaaatccatttttaaaggagtatctcaacttgttgcaatttgcacataaaaatatcctttgtctcatatactacgggacaaaacagaagcagaaacaatgaaataggttcaccattagagatctgactagtcttgaaatgtagacaattcaggtcattagtcatggagtcctaaggggaaaaagcatgcctgattccacactagtaaagccagaagctatctaatttacatcctatacttggctgaggatatcagatgtgttcaggctgaacaagttcaagactcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtggagacggggtttcaccgtgttagccaggatggtctcgatctcctgacctcgtgatccgcccgcctcggcctcccaaagtgctgggattacaggcgtgagccaccgcgcccggccaagactcttgcttgagtaatttaaagggatgtgacacagtctgaatagtaattggttatttaataatcctgcctgcagtggcaacataagcttgctttactcttaagcactggataggacaaactgtcttactcagtcctaggaaaagaaacgttcatctgaacaaaagatttaaagtcgacctgatgtgaaatcctgaaatacattttgaaaatgaatggattagcgataaaattaatgagaagactaaagtctctgaaatgaaacatttttggcatgtgataacctgatatgctcccctcaaaagtcccttggaattagcctagctatctcagcatagcttttcttacatcatgggtattacattagccaagccaacttgtctatttgtccttgtctcacatcacttttcaccctcaacttttactccatttatgccaatctccttatccacagcaagatgctactttgactttttggcctttctcagcatgcttcttcaccactgtggaagagcttcccagtacaactactactactgccaaccacaacctccatatctgacactaaatccttgcctactaaactgctcattatctttaaaattggcatcactcacttctacttcacacatccactgttcgatatccagccaagcctggactctgactgatcacttcagtgctacatacaaagacaccttagactttacttccttgaactttattgaacatctttacttccttgaacacattgtatatataatagagaaggaggcatataacatgacatatgtcaaaaatatgtcatatatgtcatatatatgttttatatatatatatacacacacacacatataaaatgagctcaaggaagtaaagaattgtaagtattgtcttctttctccaatacctactcctctttgctaaggcatcagatgatgttgtttgtgactcagtaaatcactattatccaccatcaactgaaccatgctgttactctttcccattagtttattccgcaaatacatattaagctactactgcgtgactgacaatatgcatgttagtgtatattcagtggcgatcaaggcagttagaggatggatgaggagagcattccaggaagaggcaatagcagtacagagactggcatttgagaaatggcagcaggtcagtatggctgaaatgcagcaagactgcagaagaaaaggaagaaaaatgaagtgtggttcttggtaaagatattggacgcatcagagcagtaacgaattttaatcagagattgacacaacctggtttatgtttttaaaagctcaacctttaggccatgtagagtatggagtgagtagaaaaggacaaaagcacaagtggcaaagatgagttgggggattattgtagtatctaagggtaaattagactaggatggaaacaaaatatatggatgatatatgtccattttctctgctgttccatgagccttttcttcacttactgggctatctggtccatctcccataaccagtcttctaacccttcctattgatttgcaggttcactaactgtttcctttcgatccacctcctgttcacttttaggtactaaacagagtgaagtcatcccgtgtgagtttcctcaccctccctccctctaacatcttaagtgcctttgccctgttttgtttaagcatgtgaaacaatttctcgctaaccttctgtgttactttagattctccccagacagacactgaggcaaggatttgaggtgcaggtacacagtttatctggcaattgattacaaaaagtacaagtgagaggaaagagaaagtgagattaggaaaggtaaggaggcaatcaaaggtgtgtcaatgagcacattattctggggctcagtcctgctggtgaatctctgagaagctgtgaggaacatgcctcagaattatgcaccagaagatgagatggctgcgtgcttttttcaagtacttccatcccctcgtagttaaaggtcgcttctggtgacattaacacaacccctcatatttctggcttactcctgtttatagcaaagcaagatactgcatggaactcgggtggggaaagaaatatgcggcagaacatcagcaacaacttttacatcttcttatcccttcaggatcttgtttatttctctcctctattgaaacactttttaggccaggcacagtggctcacgcctgtaatcccagcactttgggaggccgaggcaggcggatcacctgaggtcaggagttcaagaccagcctggccaacgtggcgaaaccccgtctctactaaaaatacaaaaattagccaggtgtggtggcgtgtgcctataatcccagctactcgggaggctgaggcaggagaatcgcttgaaacagggaggcggaggttgcagtgagctgagatcgtgccactgcactccagcctgggtgacagagcatgactctctcaaaaaaaaaaaaaaaaaaaaaaaaaaagactttttaaaggggttattattaggggctatatactggatcttataaatcatctagtccaaccctattatgtgaagattagaaaacaaagcattcacattattctatcgatttttggaatgctatttgcaaacttttttctgggcccacttaaatgtataagttttccatattttatgttggttaataagattaaaaccaattttaatatcttgacaccacattgccatttatcaatatgtactacgttttttactggttcctcaaatctcaaatctgtgccagcgtctgttgaatttttataattttgactcaatttatcattcttttttttttttttattgagacggagtcttcctctgtctctcaggctggagtgcagtggcactatcttggctcaccgaaacctccgcctcccaggttcaagtgattctcctgcctcagcctccctagtagctgggactacaggcgcatgccaccatgtctggttaatttttttgtatttttggtagagacggggtttcaccatgttggccaggcaggtctcgacatcctgacctcaagtaatccgcccaccttggcctctcaaaatgttgggattacaggcgtgagccaccacgcctggcctatcattcttttttaatttgcagacttttaagaacaggctaatttgagacacagaaccacaaaagctacttacgttccaaaatgctctgcagaatctctttttgcatgtgctacgtatggcctttgggagaagtacattttttgtagttgttttgtggttttttgaaatgactagaaatatttttagggccctagaaacctccaaggtaagtgtttagaaattgtgcttctaggaatctgtcagtacttttgtaaacattatctgaagcataagcataaacaaatttgaacagcaggctagctcacacagaaatgattttattcattggaatgttctcacatgtggtatactttatttttagtttggtttcatttatgattaataattatgattccaaaggtgcttaaatcagccggccatggtggttcatgcctgtaatctcaacactttgggaggccgagatgggcagatcacttgaggtcaggagttcgagaccagcctggccaacagggtgaaaccccgtctctcctaaaaatataaaaattagtcaggcacggtggtgcatgcctgtaatcccagttactgaggaggctcaggcaggagaattgcttgagcctggaggtggaggttgcagggagccgagattgcaccagtgagctccagcctgggtgacagagtgagactccgtctcaaaaacaaacaaacaaacaaacaaaaaacaaaaaacaaaaatcaaaggtggtgaaataattttgttgaatatttggcactgtctacattaatgcacacactcaatgtatatattttaacttaatttatacttaaaattgtataaaattattttagtcaaagaacctaatgcagcttagccttgattgataatttcattatctttaattacatggcagaatttctcctcattactctttaaccaaaaggctgtggtagaaatcattgatgctcatttttattggaaagtaatttttctagatttcctgataattgagtgataacttcagcactccttagtcacttttcattatgcagacaaaatctgactcttaactttcaaaaaaatatcttaccataatgtattttcaaataacatgagtttaattaaaaagaactttcccacaggttcatgtttaatcttggtttgagtcttgaatatagagtgaagcgaagtacaactttttctgctttggacaaatttagagctgcttgaagagataaaaacaagcggggacctccctctaaaccttccacttctctttctctccctctctcaactgtgttccgaatgctttctctaaaacacagaggctgagttttgactggctggaaaaacatcagtttatttcatgttcttcctttctccagcttccatttcaattccaagtgtggcccaaaagaaaagataggaactgcataaggatgtttcagtcaatgataaactgcatataccgcagtggtcccatttgattataacacgggatttttactgtaccttctaatggttagatatgttttagacattgaaatatttaccattgtgctacagttgcctacagtattcagtacagtcacatgctgtacaggtttgtagccaaacagaaataggatataccatacaacctaggtctgcactacgctataccacgtaggttagtgtaagtacactctgtgacattcacacaacgatgaaattaccttagtatggattgatcagaatgtatccctggtgttaacacataactgtatatatcctgtgtgtgtttgtgtgtcactgaagagatatgattccttcaccatgaggaatcagaaaactgaaaaggtaaacaaattattgtatcctgaaagtctcaaatgagtttttgttctactttcttttgtttttttttgagacagaatctacctctgtcgcccaggctggagtgcaggggtgcgatctcggttcaatgcaacctccgcctcccgggttcaagcaattctcctgcctcagcctcccgagtagctgggatttcaggaacctgccaccacaacctggctaatttttgtatttttaggagagacagggtttcgccatgttggccaggctggtctcaaactcctgacctcaagtgatctgtacacctcagcctcccaaattgctgggattacaggtatgagccaccacgcccggttcaaatgagtttttttttttttttttcagtccaatattaaaacaaacgaaaaccagaatgccttttgttctcacattcaattcataatctaatagctatcagaataaaatgtcatatttattattcatttggaagaaaacaaacagcagtaaaaattgaaataaaaggctgggcgttgtgagtcactcctataatcccaacactttgggaggccgaggtgggcggatcacttgaggacaggagttagagaccagcttggccaacatggtgaaaccctgtctctaataaaaatacaaaaaaattagctgggcgtagtggcgaatgcttatatcccagttacttgggaggctgaggcagaagaattgcttgaacccaggaggcggaggttgcagtgagcccagatagtgccattgcacttcagcctgggcgacagagggagacgctgtctcaaaaaaataaaataaaaataaaaataccctggccaggcacggtggctcacgcctgtaaccccagcactttgggaggccaaggcatgcgaatcacgaggtcaggagttagaaacaagcctggccaacatggtgaaacctcggctctactaaaaatacaaacattagctgggcgtggtggcaggcgcctgtagtcccagctattcgggaggctgacgcaggagaatcacttgaacctgaagggcggaggttgcagtgagccgagatcgtgccactgcactccagcctgggcgaatagagggagactctgtctgaaaaaaaaaaaaaaaaaaaaaaaaaaaaaaaaaaccgaaagaaataaaaataccctgtctttattttcttccttggcaaaattgtctgtaggattcactcatccatttatttaattaatttattgaattcccattacattccaagcaggtattaactactaaggattcaatgatgaaagacaaggtgtataggagacctagtacgtacagccttagtttcttttctcagatttatgctctaaaattccgttaagaatggatttattggctgggtgcggtggctcacgcctgtaatcccagcactttgggaggcagaggcaggtggctcacctgaggtcaggagttcgagaccagcctgaccaacatggagaaactccgtctctcctaaaaatacaaaattagcttggtgtggtggtgcatgcctgtaatcccagctactcgggaggctgaggcaggagaattgcttgaacccaagaggcggaggttgcggtgagcctaaatctcgccattgcactccagcctgggcaacaagagcgaaagtccatctaaaaaaaaaaaaaaaaaaaaaaaaaaggctttatttttatgaagaaaaccataaattaatgtcataaatcttatctatgttaataattatcagttgctttaatcatgaaaacaaaagggaaaaactggcaagtgagccaggctgaaataattcaatataatatttaaagattagaaatatggtacacttgttttctaaagatcagctccatcttatcaaactggaataacatctgaattaaaataatgtgacattgtcatcaaagctctgattattgctgaagcatgtgataggtaggactggccaaaaattaatacattagaaaagttaaataaaaaataatatatatttccttgatatgtttaatcaaaaacatggagaaaataattgtaataaaaatgtctacatccttaaaggcatgttcacccctaactctcagttacgaacatctagattaaatttcattaaaagtcaattatccatattaaacatttaatctaaacgttgcgccccattagaatacatcaaaagcttacattttactaaaagaaagtgactacaatgaatgaacatataactttatagcaaaggttataatttttgaatgtttgactttagttgttaacatttttaaagacgttctaattttttacgaagcattataattaagcaaaatatccagttttttcatagtttcagttttcaaactgtggctttggtaaggtaagttggaaaacatcttagttttaatggcccaaaaggggagactttgatgtatagtatagattcaagtgcttatctcatggatcatgctttcattttactaaaaatataatagactaaaactttacatagggagaaatcgcagagaataagaatcaaaggagtaattaaaaattgagggttttgggaggctgaggcaggagaatcacttgaacatgggaggtggaggttgcagtgacccgagatcgtgccattgcactctagcctgggtgacagagcgagactccgtctcaagaaaaaaaaaaaaaattgaggttttacgtatttgagacctaatgaccaattgtttacttttgtcaacagtaattttactgctaagtaatttaagtaattttactgccagtttcagcaggaatacaatttcctaacatagatatttaatattttattcaatattttaatatattaatctttagtagaatatatgcttcaattttgtgaggatatgtgtttattttcttgtacagtgtaaactaaacaacgcataaagagaacacaggtaactagattaagaacaattattttctgctctttgtattagaacactcattttctgttcttagtaatctagcagcatcagcatctcctaaaaaatctgttaaaaatgcagaggttggggccccacttcagaaggactgaatcagaaactctgggggtggcatccagcaagctgtggtttaaccagccctccaggtgaatctgatgcccactcaaggaagagtgagaaccactgttctaatctatcgtcttccaagagtgtgtgggaagatcaaagaaaaatcaggtcatggggctttgcggagaacaatcaaacaaatacataaatcaaggactctataagcataatttaataaatagacggatgattgtttttaacttatttttcaatttcctccttagtttgtacatgcatttagagataatctcagcaatgtcagcgagcttggtggcatagttcaagctgtgaaggttcaataaataggtcggtaaacattgcaaatcaacacagcttttgatgaaatgtcaggcaagacagggcttagctatattcggctcagcttgaactcataaaccatcaactggcctctgtacttccaggacaatctgatgaataaaatacagatataaaattaaaaaatatatttataaagagattagtaaaacagcaatctgtaagtgagaaatgacaaccacttagtccagaccaaatgagagagaagacttgcaaaagggtaacttttcttacaaatcaagttatgggaaaatttgagatccaaatagacttttaactttggattgtctttattcccaacacacgtttttaatttaatgcggtgtactttatcctaactcttttagctcacccccctgaaaaaaaaactagctgtcttcctaaagatagagaaaacttgtccaagtcagaaactctttggaattttaataaaagtaacataatttagaaattaatatacttcaaatatactgacagtatatattggcaacagaatatatgctaatttagaattttaggatattctataattaaaaaaaaacctgataaatcactacaccttttcactttatttagaagctaccatttaataataagtgtttaacctctaaaatcattctgagatatttcagataattaggcagcctggaattactgtttacaattgtcccagtttgcttcctaataagttgtgcttgtctaaacatgtctaaattactattcacaaggatccttgttatttccgtcttctttgattaaaaacttcttaaaaatgtgagtgtatatgtgtatgtatatatatacacatacacatattcatatgtacatatatgcataaataagcccatatatatatgtgaaacacaggtttttctattgttaatataaaaatccctcattagttttctaatgagtttatgaatgtagtctacgtccttagaaatttaatttgaggtaaaaatattatcgtttatagattaaggtctggatatttttttcttttcttcatactagaaataattttagatacctgaagacaaagttcattaaagccacaacccaaaaagtagaatatgggttccttcttatttcagtgatttgcattatcctataggttattggtgtcaaacccctttcttcccttcctcacaacaaaagccccaatttaacttttatagaaaggcatatggaacaggagtcatccaaatatatcccaggggttgcaaattgaccaaaagagtcacctttagggaagcctgcttctgaatgcttgtggaatttatcattcttctgaatggctgttgcatttatctgcagcttttactcaccagatgagacctcagacatttcaaattctgcggaggctggctacacaccttcataggaaagctttttgctgatttccctgttggtacttttctcttacacattctatggggtatggtaaacctggaggtagagtcatagccaagcacagataaagcaggcacagaatctctgaccagcctcacaaaagcagacaaacacacaatctttttgcacctgtttcttccactccggttgccgtgaatagtgaggtgttctcacagattcagcttcacagacagcat

SEQ ID NO: 1865 - DNA, 890001 bp, Homo sapiens
tgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctttgggcaaaggaaacggaaaaaaaatgctgatcagtgtggttccatcactccaaccatcccaaaagttagtagagctcaaatgagccaaccgtgctggatttcctcccttcttccgttatcgcaaagttcaagggataaggaaaggtttctcttcccttaacctcctgctagctccgcgttccatgcctgcctgatctcagccagtgctttttccggagaagggcccctggttcagacagaatgcactgggagctgagcttcctgggatggagatgctcccagccaccgtgctcggtgacagtggctcatctctgaatgcagtgcctcggatttgcagtataccaagcaccccacgatacgtggctctgcgttctgccctaggcagaaggctccagttggggtatcttgcaaccaatgggcaccggtttaacaggattgggagttttggcctaagagtcatggaccaatgttgttaaccacaagatcaatggctgcccctattacaggaggaagagctttgatgcataccccaccccaaaaatctttgtgcctgtgaacactaatgagtatgcactaagtgtacactctgtcgtccaagctctaacctcggcaagtgtaggacatttaatttaataggcaagaagcctgggctcccggggatccaccaactgcactatatatttaaagaatccagtccgtcaaacttgaataaatctctggagctatgagaggttcaggctcaattcctcagctgcctctctaggcagagaaagggaagtttttccagctctgggacttcctaaatgagaaagaatgcaattaagccatctgtgttgtttccaaagatggtttatcaaggtccctcaagtttctgggcttgctcccatatcccttatccctgtcatgaagctcagaaatattacccatattggaacagttttactttttagtttttgtaatttgcactatcatggttggttagagaacagtaggaagattacttaccacatagggacctttctacctcactctccacccagttaggtcctagaggaccctgtgcatttatccccggagttatgtctcaagggaagacaattggacaaatgtggtgtatagaaaaatgttcacaactgagccagtgtttctgtctgtggtcggaagttttggagggccagcatctatagttagtcataatgccttataccgattgtattaaagtttgtgttctacaggaaggctaaagggatcatcctctctaagggagtatccaaagggccctggtttagaaattatttcagagaatatgtaggagccgttggaatctgagtttttttcttttacttcttcatctcattctcttccacctccttctttttcttcttctgtggaattgttcccgtggtgctttagaaaaagatctaagtggttagtaagaggaggtaaggcacagcgctgggctatttttctccaccttctagaacactagaggtcagtattgtcctaatgatacaaaggcgtggcagcaagctagctgtgttttcccttcagcacagctgcctatctgagaagagtgaatactttgaaaagccacaaaggtgggggtgagagataaggataaaaaagacagaacatactccacacgcatatggctgtggactttctaatgcaacaccttttcttaagagccaataaaacaaatattttagaatagcattttttgtaaattaattgaattatggttaatgtgttttaaaaatgctcataaaacctaaatgacatggatttaagactcatgcttatcattaccgatgtagtaataaagctaattctgaacatttaaaatgaaactttgtgataatgagctttagtattttatcagtgacagtttaatttccctatttccaatcaacattttaattgaatgctcactgcttgctaaatattttgaagtcagcgttcttaaggaataattattaatgatcattatgctgtacaaaatctattaattgaataatagaacagcagaaaaaaattagctctgaacttgatatattttggtgtcttcataacctatgatgcagaagctctaagaaatatgcattaaaattccacaattcctttagatttctactgaccacactctttattcattaaatataggacttgggtttatttttatctataatcaattaatatttgtatacatatactgaacattagcaatttattttcaaatagtcactttataaaagtttatttggaaatttttttacaagattattcttcctatattttgaagtaatatgtcgtgacatttgtgacagtagccttgaaaatggatttactaacccaatattttccatagtatatagttgcactgtggactttgttcaggtatacataacttctaattgtttttattattcttataataatatgttgttggtggttgttactatggtgtggtgtgtatgtgtgtgttttgtgtgtgtgtgtgcacatgcatttacatttctcataatctgaccgaaacctgggcttttaacttcaaaggaaagatgaatgcttgcccaattatagattttataagtttctaattaaacaaaattaaaataaagtcaggttagaagggccagcttcagtacagatattatgaatctgtgcagagaacataattacttaccagtaataaaaactgcagaaattccctcatttcagattttcaggatattaaatagctacaattcctcctctgggtttatcctgagggaattagttaacatcaaatgtagatatagtaggccaatgtttaatgaaaaatcattttacatataatattaactcttttgacataagaagaagtgatatgacttgatagttggttaaagtgaaactgggagttagaagagctgaggagttctagccctagttatgccacagctaagcgttcaaatacctattatgttattcaaccttatagtgctcacaggcttgagtataaaacagcaattgaggtatgcgtctactccaaaacagaacagcaggtaaatatgttactgagaaaattatttaaatattaagtatggtaagagatgattgcactgataaaatgtgcattcagaagatagcaggaatacatggagcacatatggggtcactattaactatttttaacaataagtataagttgtgcgattataaagagctttaattttgagcaatacatcactttgaatgatttccatgtgcagtatctaagtttgttgctacatattagggtcacacaaatacagcattgagagagggatcaaaaactcttcattctagctcattcatcatatgtagaatttcaactaagatatatgaggacttcaatcagattcataaagctcttcaaataaggagatgaactatactttgagttatccgaagcttatgcacaaactcaatcaatagataatattaaaaataaacaatcacgctggttttttcagcagcaactttttgtggcatttacagtcaccacaagtaaaggaagcactccaatgctcatttggaagagtcctaaagattttccttttgttgaattggcttatctttgacagtacctatgagctctttttcctttctcttcccatagtcccccatctcaaaactaaattgatatttctgcaattgggaaatgtataccaaaccctggactagcgatttccacacaagttcaaaattatgaaaaaattagttttattacgaaaaccttactctctccttgctttatttttgttctaatgaatgactatcctctaaattgcagttttctttctttttcctttgttcctctgcccaatttcattgctttctttactggatctcggtttccctttactgaatcactttatttcttaatgcccatttgttaaaaaaacaaagtaatgcgatatcatttgaaatgcccctgaaaccttcagttggtgattcagagtcttcgagttgataagccagaacttcactcaaatatttcctgtgtatacaatgataattatcccccttagatgagaaggtggagaaaagatctagttacctaaaatcccagaggacaattggaattcactcaataggactttattgaaaggttgcagtgtacatatttggagccaataatgacatttttaattcataagggaaggtttcttcattcatcaaaactctgccactttctggatggtgaccttgtagaggttacttagttaccccaatgatcttgctgtatgcaacgaagaaaatggattagatcattattattaacatcctatttacttttaatgtaatttgtctttaaatgctgatattgcctactggtcattttatttggatatttctgggatgattatattctaacattgtaaagcaattataattagaataacaatatagtagggttttaattcttaccaacttctatacacttatctctcacctcatattgtgtccacataaattaccaaggcagtacagctaggtatacttacagatccagtttacagatgagcatattcaaggttagtagaagttaatgatttcctcaagatcacagatctaaacaataaaaaatcaacatctggacctatatttatctattatcaaacaccaaactctttgcaagatatgaaacttactccaaaacattcactttgacactgtgtatatacatatctgtggaaacttgacatgggttctttatggttaatttctgtagctctacccatggcaaagggcatgagagtagcagttagcaccacagccaactccagagtcacatctaaaagaaaaaaaaaatggagatctagatttgatgcaaaatgctaaacatcacaatgaccaaagataagagcctcatctggatgagcacttgatgctttattttttatgagctttgatttaaaaagttgatagggaaaggacatagccttgatgaggacttgtgaatccctttcctacacatacagaaacacacagtaccatgaaaggcacatgttgacatgacgggttgtaagtctacagatgtcagaccaacaagtattaattaactagtagttatgaattccttgtcctagcacaggactggccctgatctggctctgctaaacctcatcttcaccactcctccaacacaaagttatgaaactccttcacattccacaaacaagctatgttgtttcaaatcttgcatttattttcatagactgcctgcttggtctagaataccctttttctttgttatcttctctcactctctccccgctatacatacacacacacacacacacatgcccagaaatatttttctcaggcatatcaagtgtccctatatattacatttccatagtattaacaatccttgtctcctcaactaggatgcaaagttctctgatggtcatattttatttgaaagtctatattcaatgcgtaaaacattgggcaagtgaaaggatgagagaataaatgattggtttcctgctaagaatgcttatttctaaactaaaattctctcttggctctattgctagagtattacttttaaaatttgttttatgtttatttttgaaacaagtacaactcattactgttttggaaataccaagaagcggttagctattaaaggaaagaacagaagttcagatcacctgattggatgcgggagctgaaaaatgagcccctgcagctatagaagctttcatatttccatgacttcattgctatgatggtcttatttatgtatcacatggccatttgttcctaacagaggaagcctctccatccactgacttcagtatcaagttggagccaattttattaacttgctttatggaattttaatgagtgttgcttatagaatctaaaaaaaatacataatcacattgctataaaaactattttatagcccaaggatcagtataaaaaggagaagtttgggttatactcaatggggctttattaataaattattgaaaagatctctctttttttattgcaagcctacaccattaccctgataacatgattccatgaatcctatgtcatctttttaagctgtggtcaagagcagatttaaatgttaatagtttttttgtgtgttatgcatttgaaaacattattttagaactacagtttctctttgctaaactcaagtttgtctatgaatctggagaaataataatgaataagaaaatatagtccataacctcaagaaactttgaacacttggtagttagaaaaataaacctttagtcatgtcagagtgataaatgctatgataaaggtaaacacggcatgcactttaaggcacaaaatgagcatctcatactggctggggcatcaaagtatgctctttgaggaaaaacaaattcatctaagatttcaactgtcagattttgctagctggagaaatgggaggggggcagttattacttggtagaaggatagaagaaaaaattagagttgtaggtaagcatgagagtcttttatttttaaagctatggagattcattgaatgtttttatacaggtaatgattatagtcagatttttttgctttaaaaaaattactctgtgaaggatagactggaatagaccaagactggtggcaagaaaaccagttaagagatgattacaataactcaagtgacaattagtaagaccttaaataaagaaggatagatatatctgaatctacaaaagttacacagcattggaaaaaaaaataatggccaagtaaatttaagacctaggcatatatgagctagtaaactcacagaaggtacagatttgtattctgcataatgtatagaatacattttacatttgtaaaatgtattctatagctgtttcgattgtttttgacaaatgagagggatagatgctagaaaaggtactcagttctctgaaatgaagttcttctctgggaataccaaacgaccatattctcagtgcagtatatttcatatttgcatgacattgtatagcacatgctgtctctatccatcatcctgatgcatcttctagtctgtaaattatgctggtttttgtcagcagagtgagaactagtcattaaggaatgtgtaattaaacctcaacatcccagttctcattccccctctgacagggggataaaccagggatcattactgctatcaggggctgctcagtggaaagagaaacaaggggaagttgggtgtgctacgctgatgtgctatcattggtaattgatttgctggcgtaaattccatgtctctacatttctaattgcttttgtgcatattcttgggggttgattaatgccatctgttcacaggatcagctgaattgatagagttttaaaggatgacaacagtaatgttgaagatagaaagaaagtgaagggaaatgccaaaacactgcttgtgagttatattatttttaactatccacctttagaagcagaaatatccttctaaaggcaatccaaagcaaatagcagtctaaagaaatgtgccaaacagactgatgttatgtaggtattagtctaggccactatttactgaataggtgggttcagttgtatctctgttttcccctccctcccttcttctcacactttcttcttctcttccccattccttttcttctatcttgtgaccatgtggtttgtgtattaccattgacttttccctgaggagatgattctctttcagatgtacgataaaagggtaagaagtctttgagattccagtgctgccttgctaaacaacatgggcatagtcatcaaaagtgaaacttccagacaagacctgttactgatgcaggccagacatgggcctggtgccacagggaacctgggaaggccccttgattgcaatgctccatccaactctgtccccaaacaacccttctgctaactccattaatctcctgaatctgtaaatatgggtagagttgtgtggggaagggagccttccaattcatatagataagctttaagacacagaaccccactgagtataggaaagcaaatctatactgtacttgacagagaaacagaccttttccagaaaaaaaaaaaagtgtgtgaaagagatagtactgggtatctggaaaagggaggataatgttttgaatctggaaggagaaagaacagggatgttctaggtgtgcaaaacaagtgttgctgctttcctatttttgcccaggctgaaaccctccctcatattacatggccaaaagtacagtagatggccaatggggagatgaaaaaggacagtgagaagggcatatgtcacacagtttgggattgatttaattctcattctgtgaatatgttctgtgtatactaacatgcaccttgcaaagtctgtaagtatgagtggctctgcataaaatacatataatgtggacatccaatcattatacctgttataattattaatgaaactcagcatggattttctcataataactaataatacagtgtagggcaaggacagctacatttccattttcaaacaaagtctggcccacttccccttcatctgggtaatcggatgggtgagtcactgctaagacaaatacaaatttgttctcattttatctcccatgtaaacagacaatgagtagagtctaccttcacctggcagagaaatatcaccgttctggatccctcacttagttcctgggttgggtcatagcataatcactgcttctaggccttggccagtgaaactgctagctgagaaactcacaaaaggagccccataagagtgggggaaacaagcttcatctagagaagtgaggagcacagcccctccaaaaaactgaagagggcaatggagaagatgtcagcattatggcagaaagatccttaaacagaccttaggtaaacccatgatcctgggaaggagtgtgtgtgacaatgttctcagctccctaagaccaccatttgcaggagattcaggcagatggacctagaattggaaagttgagagagccacattaccctcctgtgtactactgaagtctgtttctggtgaataaatggcattaagtattcctattttcctgttgattttgggttaaaaatcaggtactgcatcatgatgagttattaagacatgttatccacaagtcctccctcccctcccctcccctcccctccctcccttccttccttccttcttcagatatttatgaaatgcctagtgcccatccatttatctgtacacttctgaaatatttttgttcatgacaaaacacttgataagaagaaagattagaattgccatccacatagctccagagaaaaccaaaacaaaaggtaactgtaccatctcaaaggaaggtcatagcactgtgactcacccttccatcattcctttactcttgctccatgtatgaagtatctcttattttttaagtcttttccccctgctcctttattttcaatattcttccccaagttgctgatctgctttctttctaatcctcttttcttccttctctttcctctcgtctctcttccccatgttcttctactcctttcctttctatcttcttcctctccatctcttccttctacctcccttccctcactcttcctgttgcaattaacttttactaaatgtcttgtttttatgttttatggcataagttaatgcttttcaaactttccactgaagtgctgctcaccgggaaatagagtgcacgggaacccaggggattctatgagctcagcttcaaatggccactgaagcatgtaatttcttaaattttatcttcaacactcaggcaaatttgcattcagctccatattatatccatgtttatactataataaaatattttccccaaatccccaattaaaattgatgacccaagtttattagcttaacccatagcagagggctgcataatcccaggggcaaaggcttcagttttttggctctttctccacatttatgttttccagtattcctgtgtcacagagtcctacttcgtggtctctctcctcatctcagaacaacaggttgctgcatttcccaggatgaactctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcccaggatgaactcttaatctgtgaaccgcatattatcattaatcaataatggggagtaagaaggacttattaattcacaagggaaaaggaaacccacagactggcttagtgaacagaaactgttcactaagttttggatgagctgtgggttacaagaaaccccagtcccaccccaagtcttcagatactgctcgcccctgttacggtcacctgggactatgctgccacatccatgagttgtacctttgagtgaatgtgctctgtcagttgacagtaatggggtcaaccagggcagatgctttctgataggctgaaaccaccaggatattaaaagattaatgcctctgattctgcaacaatcaggaaccctttgacacaatccaaagaaatgaaaccaagcagattggaatgctggaacactggagattagagataaagttaagtaatgtgcttctttctcggcagggtttcaaacctacactctgtgccaaggttggtacttggtaagattttactctatttgttaccaacagtcctaagagacagttgttcttttccccattctaggctgaggatatactggcttggatggtgtggtaatttacccaagattatatagctataggtggtcacactgggattttaacccacttttccttggctccaaaactcatactttgaaaaattttatctgctgtttcagtgaactcaacacaaagacttagctattgttaaactccagcagataattcgtcctagcaaagacagtctttccctataatccagggtgagaaaaccctcatgtgtctagacccacagattctgccccaatcttcaggccatcttattccagtcttgcagaaggctccttccccatatctagaagtcactatgtcaaccagttcctgtaggttagctgtttataaaagttgcttgtattgctcactaaagcttttcaccaactttttgtggccaggcttcatgctttcactgatggccttgtggattccatgatcactgcccactattagtgtctgttcctgagactcctcctgtcactaagtgcagtatttttatcactacataatatttcacccctaaagaatactgcagccctagaatttgtttcatggattttatctttaaattctgctctcccatgttcattgcagcattatctacaatagtcaagtcatgaaactaacctaagtgttcattagcagattaatggataaaaagtgcacagtataaaaacacaacagaatctagtcaaccttgaaaaagaaggaaattctgtcatttgtgacaacatagattaacctggaggacattatgtcaagtgaaacaagccagtcacagaaagacaaatgctacacaaactcacttatatgtggaatctaaaaaattcaaattcctagaagcaggaggtaggatggttgttgccaggagctgtaggtgtggggagggatgggagatgttggtcaaagggtacaaagtttcacttagaaaggcggaataagttctagagatcttttgtacagcaaggtgactatacttaacaataatgtattatatacttgagaattgctgagagtaagatttaaatatttttaccatttcacactgtatacatatatcaaaacattatgttgtactccacaaatacatacaatttatatagaccaattaaataaacaataaaattttgtactaattagaaaaaccttattcctgacactaagataatagtttcaaacaaggtaattattggatgcattcagatctgttctttgtcttcacgctgcaagattcatccccaaatccagactgtaagctctttttacccaatagggatagacagaaggttaggtttgacaagtgtatacccaattccattatttttcaccactgattatcactgactagtgctcagtgatgggaccctgtccgactggcttcggaggatcccgttggtaggcaaggaccagtgcttgtacatacctgctttcattgtcagctgtatagaaaaccacagtagtaaatgctttgttttattctcaagttctcatgagtttgagaacttaggcctgctgcttggcttggttgtgaggcctgtctttgggtctcctgtatcttctatttcagctattgtcttgactcagaggacctgcttgcttgggtttagagaggcaaaataatttgttcaatgtccagtgccttacagtcttgcctctcttctgcatcaacaacgggagctatcaaaaaaggacacagagtattctgaggcttttcacactgaggcaattaatcaatgtagtgttctagctctcaaaaataattagcctttcaaggaatgaagccttaaatatttaaattttgttttaaaagcagaacttttggtttactaaatgaaatcttacatatgattttaatatgtaaaataaattacaagagcggctttgaagaaaatagaatgaagggcctagaatcctaccatccagcctgcccttcttctgattcttcatgtaggtaccgtgtgaagacttctgccttattcttaattgcaggaatctctaagcctacaatttcacgcaaaagcaactaggtacaagaacatttgaggaagagtggggatggaatcccacctcagtcatggtccatgcctggctggtgcacagcagcagagccacactgggtgtgccccacctgcctctgcttgtattggtccgggagctgatgtccaggctgggaaatacttcaaatatgatctctgccctaagttacactaaataagcagacgctttattctaaaccattgtaaatctgatatatcttgctaccattcatatgagtgtcagggcaagacaatcttattggaatttactgatttgaaaagatggtagcttgtcaaatacttgtgtccttatcttgatatccttagtttgtggttaatagctgtttgtattttaaataactgttttgtgaaagcgcttgcattatctacctgcattccaggcattcccttgggacctcctccaaaaaaggaatctcatgttagctgtgattaaattgcccatatatagcacagtaaatggcaaaataactacttaataaattgaattgaagcacaacaggttaggtgaaacccaagcatagacagaaagcctggatgagggataatacggggcaaacccctgagtgttggcttatagtgcagtgctccctccaccgcttcaagcctctgtctcccaacatctgtgaaataaatggacctttgggctccatcagcgaggctatctcagtgctccctgatgttaagtaatgtgagtagaagtgatgaaagtatacaaattaaataaaattgtcacacacctggattcagtcttcatttctgattctggtcagaatattaattttaaacacatccttgagtgtttacttcgggtgccattcatcacaaaatccttttatttaggtctacactgcgctctctcctccccccagtgaatcccaaatgtccctgctttgtatgggtaataaaatttaatatgagcaataattaaatataggatggtatatttaatggattactcaaaataatttactaatattaaatagtatgcacacatatatatgcatgctcagatttttaatgatttatttttagttttttttcatggttagtgcacctggtggaattgtacatgtgcatatccgctatgtaaaccacttgttctggtaactgtcaagatttattatcccccaaggtcaatattgacttaggtgtcacctttgtgaatatttacctctctagatgatgaattgaaatggtcatttggatggaaattaatatctacttattttctgaaatcaaatgctgttgggaggtgtgcagacatgctccaccgtgtctgcttgtttcagggtggcgttcaataatcattctttgcattctgatttactgtggttatttttatacctctttcacatggttcttttgcctaacagatagactgtgaacttcaaatgtattcggcttgacatttcaataccacaatcaggagatcgtgatatttgatcatatggatagtaagtacacattggattagtgagcaccttggccttggagtttatttagggcaagatactgttacctgaaaaacacaaagctccttcaacaattatctaattatataaagaatacaggaagagacataaaattacacagtagttcctttggttttgaggtattgattcgtcgttttcagataaccttacagtatgccatgtgttttgtaaatataatgtgtttgtacatatatatatgtatgttcatacaaatataatatgttcaattctgtgtgcctgtgtgtgcctgtgtgcctctgtatgcctctgtgtgtgtgtgtgtgtgtgtgtgtgtgtgtgtgtaacagtgcttacttctttactggcagaagacagagacatctttggtagagagcttttaatatatcaaaccacaaattctaaaattgtgagactacaatagaaatatttcctgttgttcttattataactgttgcattaattttgcgtactgggtcacaatatatatactgagaaatgttcaaccttaaaataaggcatttaaatacaagtataatggtgacagttgctgtattttgttgtatatgagtggaattcatctatgcttttctatacaaatattcataggcagtgcattcttggttttgtcctttacaaacaaggagtattagtttgtcatccccacaaatctttcctagccatgaatggtctgagaaaagacctggacttaggcaaacatatcataattaagcacagactgtggcttagtagtcaagggaatcaaccactgtaaaaattcattagtaaagttaatccaaaaaacatctgagcaactgaaacaaaatcaatcctaggggagaatgcataactctattgatgttctcacccttgttgatacattgtttagagtaaagatttctatgtcttctgcataaatatcaatttttgttggcaaattcaatttgacttattgggttcctatagctaagtgttttgtggttcatcaggaaatgatgtcattttgtgtatgaggaaataaaaatacctcacttgatggccaatgaaagtctcattttacacaccatccactgcttttatgtgctgggaaggtttgagtcctagaagaagccaaagacattgggtggtttcttcatgcattatttgcatgtgtataggcacacatcctacacatagcaaacatatacacttactgtcaattagtttagtttgtgcttctttttttaaaaaggaattaacgtggagtcagattagtggttttcaatcagatgtaactttgccccaggggacatatggtagggtctggagacatttttggttgtcacagcttgggggtttctattggcatatagtgaatagagatcagagatattggaaaggaacattctacaacacacattgtattatatgttgtcttttgtctcccacaacagataattatgtagctcaaaatgtgaagataatcaagggttgagagactagtttagatctattagtgatttatgcatcatgatgtgtcaaattacatatatatatatatataatttgagacagagtctcactctgttgcccaggctggagtgcagtggggccatctcacctcactgcaaccaccatctcctgggttcaagtgattcttctgcctcagcctccgaatagctgggattacaggtgtgagacaccatgcccaactaatttctgtattttcagtagagaagggttttcaccatgttggccaggctggtcttacactcctgacattaggtgacccacctgcctcggccccgcaaagtgctgggattaccggcatgagccaccatgcccagccaattaaaaatttttaaaagaggttttcttccagcatttagacttatagagagatatataaaatagaagagaaatatgatgacatatactttcatcctggttctgcttactggctatataaattccttttcattatttcacaccttttcccaaaaaaggtgatgataccctccccaactattttctattgtgaataacatgagataaagaatatttttaagaaggtgtaaccatgattttgctgaaatcatatttattatacttttcattatttggaggagtaatggcctggctgtactgtcctcataggctttagacagacaaggataacatggaggacatgggcacagtgcaaagagggactgagggtacatatcctggacttggggtacgtatcctggactaggaactgcaaaggtaaattttataccagttttaggttttcaaagcatttttaaggttggtttaaatttctacctctgtttaaaaattatctggtcaggacatcttttggcagggtgcatgtgctataatgcaatcactgaagtctgtttatagtaaagcacattctgtcaaattttttctttttgtagaccccctcttgcataagcgtaactctctatcatctatctatctatctatctatctatctatctatctatctatctatcatctatgtttgaaaaatgggataaaaactaaaggtgccgaagttgcctatgctttggaggtgacgtaactacgtgactcaggaaaggccatgaaccaatctatttagatgacactctctaccttatttagagctcaaagatcagttagataataatcctggctttgattgcttatcttctccagtccaatattcaatttttaacatcaattacattagaaatagtctttaatttgtcttttcaatggaaagaagatggatggccttggtctctactggatgtctgccttttgaaaaaggaaagtgataaaatcagaagtaagagactgctgggttgggaaaaggaccttggaagtgatgtagtccagcctaccctgcataatgtatatagatcaccacattccctaaaacattccagatagttgactattctattttacttaacctcctaagtgaagaggtgggacctcacaagacagctcagttcctcaacaaaaattatagttggtaggacattctttcttccactgtacataagtctgcttcaagtaccaccaaaccactctccttagctctactcactggacatctcaaaccaagccttctttgtcttcatcataattattccacaaatacctaacgatagccaccacacttctctcaatcttttcaatctttttatatcttcttttacttaattttttctatgacatgattcctttcccttggacttcccatcatcatgttctcctatttgtagtgtattccattttgccaatgttttctttaaaatatgatgtctggaatagaatgcaatcctgatttgtgcttaccaacctgtgtgggctacaatgtgatggtcataaggaatcctgggtgggagagaagattcagtgaagtttacaacaacataaacctcaaagtctaaaatgaaagtaccaaaaaattgtgttgtggaaaggacattgtctctactttctctcactcactctttcacttacttggccctcaactaatgtaaatcagtctctttacttttttcagggataactggtacaattttgggtttctcccaaattaagtgaactttgaactcacatcttacctttatctgcccagatcttccccatgggccagttcttgtcctctcttctctagtcttaattagtatgactgtcctctaaatccttaatgcttgtacagtatacattacatctttaagccctgtattatatgctgtcttttattggcttccacttctattttcattcagagtacattgaactgcaatcaatgagaagaattacatttaatatagcctctgtctatagcaataggagtactgcttacggtgtgccagatcttatcattgacatacattactactaatctggctcatgaccctatatggttaataccattattcttactttttagatgaataaatttatgtttagagtgtccaagtaactttcttaactttatacaattattaaatagtttgcctgaaatccagccctggtctctgaacccaaagtactgtgtcctttacgctggagaaaagatttcacaacccaggtaggatgtgagctcctagcagtttgtcaatatatcattctaattaattgggggaaattgtattcattttacaaatatttttagaacaccaattctaaaccaggaactggtcttagatattggtaaagaaagacattcaatttctgaatataaaccatggctattttttttcaaactgtggactacagagagtcccacaggtcttgggttccaccttcccacggccacccttatggaggtgatgatttatattggctcttttctgatagttccccagtgtgctttttctcttgcttaaatatttcataaagccatatggttgcttatatctcctcaactgtcatgatggtggatgctgtgaaatgatcttggcatgtttgaggacacatatccttcaggttgaccttatctcagaaactaaacttcttaattgtagctgtaatcccaaccccgccacagacggaagcaatggtagtgaggaaacacacacacacacacacacacacacacacacacacacacacatgaataagtgaggcccatcttcctggaatgtcaatttcatccaaagagtaagaaatacacattatgtgtatatcttaaaaaatacaaatatgttctggagtagaatacaaaatttcaggaaactttcaaataaaacatgagatttcaaatatgtctctggctccaaaatgtgttcacagaaacttgatatcaatgaattcactgttttcccacttcaagatgcctcagggaaaaagcaaacaagcaagcttaataacaaatacccctgattcaatttctgtgggtctaggtaagtcttccacattggccttcatttgaaaataaatgtctttcgccaaactttgattttcttttcttttccttttttttttttttttaaattttgagatggaatctagctctgtcacacaggctggagagcaatggtgcaatctcgttcactgtaaactccacctcccaggttcaagtgattctcctgcctcagcctcccaagtagctgggattacaggtgcccaccaccaggcctggcaaatttttatatttttagtagagatggggactcaccatgttggtcaggctggtcttgaactcctgacctcaaagatccacccgacttggcctcccaaagtgccaccgcaccaggcctggttttctttaagccagagttactagatagtgttacaacacagaatgatgttatagttgtatgtaatgtcttatctcttaacaccctccgattttaaaaatgcactgtgtagacaataataatattaataaccttctttttattctaatgacagtttttagacaatctctattactggctttatgtgttggggaagaaggtagaatgaagtaatattgacagaaaggccattcctccacttcccccttggcaggcctctcacagagagtcttgctatgggtgccacattaggacccttaaaaattcacattctttgtttaagaggtgttgtgaatcccctgaaattgtgcactcatcactgtgtgtatatctgcatatttgcatttttcttggataaaggtatttatatttcacccaatttccaaaacgcatccatgacccagaaaagatgaagaaagaaaggctctgagatcctcattaccctgaacatcctcagggaggggaggaggggacagctttattctagatgctggaaatttaacctaaatgtgcctgagtggtgtgcccttttctagcacctgacggagtgagtgtgagctctggggtgctgaagagagtgggaaagagccccccaaaagggaaaaagtcttctagaagataaaagacaatgacagaaaaggaaaacttcagagatgtcacaatttgccagtggcaaagtaggcacattgcaaacaatctggaattaataggaatgaacatttttaatacaaagaatacagattttgaagaaattactcagagcctttccctttgtcctttcctccacctcccctgagatctgctcacaaaagagagaaaaaaaaaaaaaaaacagagaataacaggttaatatctagaatttgcaaggctctgaatagccacctgacaacagccgcctcctgctgagaaaccactgaagcttaatcattttcctttgcatcagaaagaaggtggctgaagtattcattttttccttgaaatgtcaggtgcccacagcaattaactaatcatgttcctaccaggtcaagttgcaagaaaagaagacgattgggtttttaatgctaaggggacattttagacattttcgtacaagaaaagaagacaattgggtttttaatgccaaggggacattttagacatagggattaaaaaatggtttcataatgacaaaagctccactgacatgcctcaacatcccctgagtgataccatgccttgtacagaggaagtgaagaaaggctgaggctggactgggaaaggagatgtagccttgggcacacatttttttcttgagtgaaaacatggccttgaatggccattaaggtctccaattgtaagaaatttctttgatacagaaatctgagaaattcctagaacagctttgagagagcggcttgttcaaatgatccatcttaagtatcaatcacagcctaagaatcgagtgtttactagataacagcaaaaataagaccaagacaagtgatgaggatggcctaacatttatccaacacttactacagactagaaacaataccgagctatttacatctattagtgccttaatcttcataataaccccacatggtaaaatatgctgaatgtttacaggtaaggaaatagaggcaccgaagggtagtcacatagctggaaagtgaaatgtccactcagggagactgcctctaggacttacagtcttcaagtcagaaggtcagtgtttagatccttattttacagaggagaaagtgaaactgggacaggtgaagtatcttacccaaggcttatcactggtacacagagagcttggacggatctggccaaagccaagttctgtccgacttcacatacattttcccattcaacatcacttcacatgacctgcatattgtgtataatcatattggaattcatccctaggagagatactggattctaacactggtgcctaaacccaatcaagtagtaaggctgcagcccaactgaacctcattaattctgttgctctggaagcactccacgcctcctgcgatgacctccatgttatctaggttttctctgtgtccctggtgcatgaaaaagtgcagtcagtgactcagctgtaaatggttcaaggtacagactccttactcagccctcctctcttttttcagctctatcgttccttgcactccatggtatttattgagtgtctgttgtgtgtagacagtgttcaatagtggtaaagagctagtacctgccttcatgccacttagacccaggatcagggaagcccagagcattgtttctggtgctctcagtgtctttatactgctcctctagcacaagcatgcacatgtgcatacacacactcaggcacatgcacacgcacacacacaggacttctttgcttagctccgtcataaacatttccaagctacactgaaacattcatttctttattttatttagcacgatttctctgtgtctctaacacattctgcctgttttactagtattcttgtcatatgcatatctttaatcttccccaaataaattgctccttgaagctagagacacttgctacccatctatgttgttctgtttaaactggcagcatggtgtcatgggggaatgctttccagaatcaaacagaactggagttaaccagctctactctaggaatgtcagcttgagtaacctcttaactatcctatttcctgtcagtaaaatgtgagttcttttcttcctcgtatattttgagcacattcttgacagttaatactgatatgccatttaatggttgctctttcctttgcgtctccatttagtaagtgtccatgaaagagttttattggtttctcccaagatattacctgataacattttgtttgtttctaatttctgtttagagatttgttaacttggttggagtggtccattggacatttgagggctctctatacactttcttaaattgtttgccaaattgtttttgtgccctgttgcattcatcatactttcaaaggaatacaaattcaaaaatgaaaagattaatgagtatcttttttgttggtaaatatgctttctttttaggcagtcttttattccccctttaacctgattcacctagatggaagtattgacagtgtgcatgctcagacagggagctagtgataaacggggtcatccaaggttatttgagtccccaagaatgctaaccattttggatgtcctcataagtatacagcagaaattggacacagtgtccttgaagaatatcactaaggcaaatatttacacacatttatttttatgagtgttatgcaatacgttaggttacatcaaatgcaagtttgtttttctttctttaatggcaattttctccaatgcttttgatatatcaatgtgcaagggaggatgtctaaaactgggatagtatagtgcttcccccatttgcttagccaaatatctcatctcacgacccaggcttgctgctctgcagaggtcactttgagaaacgctgatttcagggctttttgctttatcactgttaacgtccctatgatctccttcatttggtaccacaacaagactctgagtttttgtccttttattccctttgaatgtctgcggcaacaaggaaatgaggtgggaaactattcattgccatcaggaaggcttcatgttgctctgtgtctctggaggctgcaatacgaatgcctcagaaaggcacaccgcttactcacatcccaagagacatgcagaggtggcagtagttcctgtctaagtcttaaagatgatgttcttgctaggaatgattctggtgttgattttcaacctgaacagtcaaaacttttatgtataacttagacttttcagtatacagaactatattttttaaaccataataaaattatcaggcctactttacttcctattagaggaaaacaaaataataaaaattaccagtttaagggtcaatgcatctgaatttaaacacaggctctatcactcattagccttgttaccttctgagcttcagtttctttactgtaacatgaaggtaatgatacctaccccgatgattaaggagagggctaaagaagctaacaattgcattatacctaaattaatatgttttggcttctataataaaataccatagcctaggtgatttatatacaacagaaatgtattttttacagttgtaaagcctggagaatcctaatcaaactctgagtcaggcagattcaatgtctaatgagggcctgcttgcttcttggtttatagatagaaacttcttactgtaatctcacatggtggagggagcgagaaagctctctggggtttctttcttaagaacactaatcccattcatgagggctctgccctcatgatctaatcacctctcatagtttctacttcctaatagtgtcaccatggggatgaggattttaatatgaattttggggtacacaaatattcaaaccatagcaataccttaagcatactacttaatatctagtagctgttcactcattgatagatattcttaatacaattgttattattaagaataaagaaatgggctgggcatggtggcttatgcctgtaatcccagtaatttgggaggccaaggcaggtggcctcacttgagcccaggagtttgaggtcagccccggcaacgtggcaaaaccccatctctacgaaaatacaaaacattagctgggtgtggtggtacgtgcctgtagtctcagctactcagaaggctaaggtgggaggattgcttgagtccgggaggtggaggttgcagtgagccaagatctcaacagtgcactacagcctgggagacagagcgaggccctgtctcaaaaaataataaaaaaagaataaagaaataactagattttgttagcaagatcttagaaagagaaaggaaggtcgggataaggggcatatctactccacttctgcactttccggggtgctccagatttcaaaattccctcatgcctgccatcctgttgactctgcccctgcctctgtgtgctgcagtccctccttacatggtacctttgacacactggcaggtgagctgagcagtttgggcacctggttcctctaggatcccagaatatagctttgtactttgatgaagaatacttctgactgtatttcaattgatctgaaatatcagtctcacacactgtttgcagctgggattgcactttgcatactctgctcagggcactggcaagtcctgaaacaaaatttatagtagggaccagcccagagacatcctttcttcaaagtgtgttagtcctgaatgaaataggcaccaggataacatctagagtgcttaatctcggatgtgtagagaattttcctggactgtagcatgttaaatgtccacagttaaaacctgaaacagaagtatattcaatcattcggttaatctaatattacagatggctgaggtgggataggatcagagataatgacatgtgacaaagtgtttcttggtgatcttccagcctatttgaacatctgcaatagtttgaggccttaaaaataaataaacttagttttctttccatctctttcctcaaaaaaaaaatacacacaaacagttctcagagataaaaagaaaatgtctcatcagttcaacaggtggtctaaggtttgcttgtttttagataatgatctgatgcaggctccactctaattgacagcatggcctgcttatgagaaggtctgcacttgtttttcccagagtatttgatgctgctgtttacctctaaggaagcatgttaataacaagggcactctagggtgttgccaatcatgcaccacatactggaaatcaatgttgtgtctagtgctgtgctaggaattatagacattaaaaatggcatatgacaggaatcctgatgttaatacaatgtccatctcttcgtgatgccaagcctaatttcagcactaaattatacgctttgtagcagagaagcaggaagtattaagaagagcattgatggtggtggtggtgggggcttacatagatttgaagttgattccaacccagataacctgcacacattctcctagccccagtttgttcacttgcaaaatggctatagtggtgtccatctcacagagctttggtgaatgtcaagtgagacatacagtttacctgcttgacacagcgtagtcactcaaaactgctagggtgattttgcttgatttccttctgctacagcattccttttgccacatgaagtagaacaaggtgtctcaaactatctgtgataaaggaccaacccctcccaaatctctctttctggctccatccagcacagactaatatttttgtaaaacacaaaaagatgaactactagaaaagtagaataaagaaaataacaaagtcaaagaaaatacaagccaactttttactactagattccacatagatgaaatgatgcatctggattgtgacaggtttctaagtgcttatcctcacattctgtacctattttatcctggagtggtgacaaaagtccctgggcccacactggtctgcagataacatctggagtagcatgaactggaagacagtgatatgatccttaaatttcatcagattaagattagaaatcacctagttactttattgaaagtctttacttcaagctagtattgactgaaagaccaaccttcatctgcaaatgatagtaaaaactctgacccaggggagtagtcatacaaacagacatcaaggacaggagcgaggaaatgctcagatgtgagttaacaggacacagcaccagagttgaaggaatgagaggcagcctggatgtttacgttattccctctcaaccaagggtcccaggatttaaagcagagaggaagggtaaattaatgcaagcatttgcagtgcagaactttcagtgtttgatagatttccattccaaagttcccattcaacaattattactaacccttttgctttcttgagggggtggagataattggacttgtgttctgagctttcagctcctacctcttactgcatcttccccctgagttcagaatgatctatataaaatggatacctgtgcgcgtctctcctctcatgcagcaaataagaacctaagtagcctggttttggctgacctctctgaactcagccctcctttgcagctctgaaattaggtctgcattttgtattccaattattctgaactcttggcagttccctgcccacatgtcatttttccatatctttgtgccctcctttgctaatgccattttctctgcttagcccagtatcaacccctccttgcctggctgacttctatttatccttcaagacatggttcagaaagtcgtccagaaagtcttccctggccctccctcccccgtccctgctctgtgggcccataccttcctctgcgtaccttgatcactgaaccagccacattattcggaaaccatctgtttgtcctcatttattattcatcagcaaatgcccaataaatgtttgagaactgtctataactgaggtagatgtcctggctgcgttgagaggcactcaagaacaaactgttaaggacaagcagaaaactaaatttattgtgcaaatttggctgaggtgaagcagaaccaaaaatcatcagattcagccactagaaaagtgagaaattcataaacaaggtaatctctgtattcacctctttctatttatttgttctgcttcctttttctgatagaaactaaatacttgtacatacattttaagtgcagccatttgagcaccagcccagagagcatcaaccacgaggacaaaggtttctgtcttgagacaggtaaagaacatgagagacatgaggccccatctgggggcagaatacctggcttaaattggagttttggccttgctatggataaactcaatgaacatttgacctttctgagtctctgagtctctatttcttcagctgagaaaaccatggcaataacgtatgtcacaggattactttgagagttaaatggcatggtttacataaacacctagtacagtgtcaggtacaatacatggtagctattatgatcagaggtagctatttatgttctgtttgaaagcttgctcagtgttactctgctatgcaatttctcacatcctaatgttgcattactaggagatttggggcaatataatccagaaggcccatgaaagcatatctctactcaatgtaaaaccagccctagaaattataacaagcatctgatcttaggaaatgtttcttagcctgccgcttttaaagatgctggaaaattctagtttctccaagttgtggcaggccttggaacccatgctgaggaattggaatgaaacaaagtgaagagaaagaaagatgtcaacatgatttactggaacaaagtggcatcgtattggcactcaatcaagagcatgtagattagacaaggatcgacttatcacagttacagatcctgaaacaatttgacttgaagaacaccaagaagcaaacagaggccaaaaaatccctcaattcaagcataaaagagacatgtgttctttgccctcttctgagaaactatgtgcacttggctttttgtctggatgtttgggttggttgtctttttaaactgtatatttgggtgaggggagatatgggcatttgggcagtgggaaaatgcttatggcttttaaaggaatatgatggaaaaaatagcagtgttaaaaatgtattttttaaaaattagagctgatgcactcggatccctaggctcctagggtcctataccctcactctcgacaagggtggacctaagtcatacttcaaaagaagcaggagcctcagggacttgtctactgagagcagctgtcaatgtcaccactccacttccagcagcctggttgaaagttgcccgaggcaagacctgcagaaaaaggagtcaaaaagcatgaggagagagggaagtaaaaaagaaattaagttctgtgggatgttattgctgttcaaatcccaagtttactatagcagatctcagccccgtggatcttggtaacccatgattactcttttcataattccaaaagatatggaaactatataactcacagcactcaagccccttcctgctgttcgttagtaaaattgcctaccctcacctgctctgggtgaaagaaatacttgccttttctatttcccttcctgcaacagccctagaacttttttgattttcaaaaattattccagctagcagggcaaaaagagaagctctctctactgtacacagaggagctctggttgggaagttcatattgatgtacttccatgaattgtgtccctaacagagttttgaactggagccaaatgggtgggagtctgggctctcacccctctgcttcctatctgagtttccttagccaaaatgggcataatacccatcttgcagagtgtgttgaagattacacatactgtatgtaaatatatctgcaacacagacaagaagccaaccaaatgtttcctttttcctgacatcatgagatacagctggatgtgaacatctgtaagcctaagaaaggatgcttgtgaagccaatggtgacattttacttttaaaactgttatcaagagataaagtccaacttcttcatctggtgtggagttctttccagaaactaagactcatttaactctactttccaacattccctggaaggatccctgtcctcctcctcatctcctccaaccccttccgctgctaagttacagcatgtggggaatgcttttttatgttctctggttactccttcttcttggatagctttcttccccttctctgccagcctatatcctgttcaactttcacagttcaccccaagcctcacatctttcatgaatactccccagaatgttctcgtccagtgactccttaccagtgggatatgatcacaggggctgtcaacagtggctgtcagttgctgagagttacctgaccatggaaactgagagaatcccaagtctttgtccccatcctgacctggacctcataagttgcccagccaggtttctatgaccttgaccacctacaatccaatatcctctgagggattactccaactttcatttcctcgtgtttaagcccttctttttagcaccagactccattattttcagactccatatttttcctaagtcatcaagaagacagaagccatttgcctggcaggaccttcgtcatcttccccccatttaacaacatacttatttctatcctcaattccctctcccgcaccatccatgtccactgccatggctctgattttgactccctctgtgactgtaaaagtaaaacacctatgcctctttcccttgcaccttcatctccctctctgctggctctttcccatttgaattaaagcatacttctttcccttctcaatttcacatcccttcatctcatgttacatttcttttgctttcagagacaaggttttagaaaaaatcatttacatgcagtgctgttattctacctctcttatatactcttccacttattggatacaagttcgctgattatttcatccactcaagtttctagaaaggcttccaaattagagagaagctggtcggaaattgaccatctcctctcactagccatgtgaacttgggcaattacaaaaatctcttttctgtctcagcatcttctatacaactggagtgatggccaggcacggtggctcacgcctgtaatcccagcactttgggaggccgaggcgagcagatcacgaggtcaggagatccagaacatcctgcctaacacggtgaaaccccgtctatactaaaaatacaaaaaaaaagaaaaaaagaaaggaaaaattagccggctgtggtggtgggctcctgtaatcccagctactcaggcggctgaggcaggagaatggtgtgaacatgggaggcggagcttgcaatgagccgagatcatgccactgcactccagcctgggtgacagagcgagactccatctcaaaaacaacaagaacaacaacaacaacaacaaaaactggagtgactactcctgccatgtggtcatgatgagaatgcaaagtgataacatacatggagcagaatgtggaggtcactggacacatcgagtcattgtgaatcagtcatctcagcagtattttatcctatgggccagtccacttttcttggaattcacttttgcttttgccttcagtgattcatctctatcgtagttttcttcctctgcttttctggttacccattctcagcattttctccaagttactgttttctatcaaaagctatgttctccaaaattcagttgttgtttgtttcctttattttttaatgttttttacttacctaggctgtgaaattagctagcattaattgattgataattactcaatggccatgtccaatactaatctcatgagccccattaaaccaaccgacatcacaattgggaaggacccaggtatggaatgcccgttttgggctcagttctttacccaattaagcccattcattttcctgtgcaccctcactgtgtaacaccaccattttctggtagttatacctttatacctgactctttctttctccttgtcccctacatcgaataaattaacaagtccatttttttttttttttttgaggtggagtcttactctgtcacccaggctggagtgcagtggcgtgatctcggctcactgcaaactctgcctccccggttcacaccattctcctgcctcaccctcccgagtagctgggactgcaggcacccaccagcacggccagctaatttttttttttttttttttttttagtagagatggggtttcaccgtgttagccaggatggtctggatctcctgacctcgtgatccgcccgccttggactcccaaagtgctgggattacaggcatgagccaccgctcctggccaacaagtccattcttaattcatagatatattacttcttacccaggttgtggaaatagcctagtgaggagccactgtgcctccttttttgagctgcaatccaatctacaaattactttaccagaatgaatcttttaatggataaacaagaaggatggtaacagaggctgggaaggtaatgagagggcagtgtgtggagaggtagaaaatggggatgattaatgggtacaaaaagtagttaattgtttgtaatacaaaggagaaatgcttgagggggcggataccccattaccccattcaccctgctgggatcattatgcactatatgcttgtatcaaagtatctcatataacccgtaaatatatacacctactatgtaaccacaaaaattagatttaaattatttttttaaaaattaaaaaataagttaataagcatagctaactctccaagttgaaattattttagtagttcctggtcagcagtgtcttttgggattgtgatcctgaaactacatggaagtgaatgacctacagggattgttaaatatgcaaattcctagacatcaacacagatcccctaagtaagaatttcctggttggatcatgcttaagcacactaaaatttgggaacgtgtaacaatagaataaagacaaaattttatggaatgttatataaggttttgcataatccagcttttgactgtctctccagcccccttgaaaaccatcctgtcatatgattctcatgcctgttgcagggtctggtccatcatgccatcatgcctttgcctagtatcaaagtccttccactcccgattcacctatcacacttgtttatccttctaagaatagcccacatcaatcatctctcccttagtaagagtttgctgagattcctaatttgcacccctctgatcttagataagtccattttccatgctttcaaaaattcaagtgtatcaatccctctcctccctgtactatccccaagtctagtataccattgtatatatctcactgcatttaaatgtttggtaatttgcctgtcgttgtcatcagcctaaaagcttcctaacacttgaaaaaaatgcatggcacatattaggtgctcaaattttatttgttaattgaagaactctctctttaaatcatgatgtctaccagttgtcttctaccactcttatgagccaaattttgtccatcaatgaccttctgaaaatccagtccttgcatgggaggtttttatccccatgttgagtcctgctacatctgagcaagtgctttttcaagttgcttcctgctgatccaatctgccagggatatttaattggccatgtgcctattcccctggtactctttaaagtaagctattgtatcaccaactctggtgatggaattattttttatctcacagggtattttttttaagttacagaagtaaacttattatcaacaatataattaacagcaatgttattggaatttcttccactaatattttattgttacttcttcatattttaagtcctagacgtaaaatgtgttttcaacagcactaacgcattttaaagtttattgtatttattattttctcttacttaggtagtaaaagttatccttaacagtattattaaaatttccaaaaactaatggcctcactagatttgtttgtattttaaagtcgtaactataaaatgaattcaccatttattgaattggcaaagatatcacatttctgtgaacatcgaataaagtaaataaggtctccctctaatcacataaatgtctacaaaaaagctgtgtttttgctttttctgcccaaaggaaaactaaatgctgaatgggctcagcatttcaagtcaaactgagccagccagtttgtgtcctcttctgtaatctactacctgtgtggttgtgatgcacaggatgtcattcctgaccctcagattttcctgtcaaaataacctgtagcagcctttgtcatacacggcacatattaggcactcaataactgcattttcttttttttttaaattgattttctagcatggtagctagtatacttgtttttcatagggctgttaagaaggagttggggacactcctgccatttccctggcatgttgctgtcagccttgattgtcttctgtttggcatcagcgtagagtttttcaatatctgtgtggctctggtcttctgaacaagatggcgagttcctcaagggcaagagcctgtgaattccaagcacagagtgtatgctcagtatataaaaatgtctcatggattctagttttagaattgccaacatgatattatgaaaggaaagcaatgttatgctggaaagaataatttttcttctcacaaacatggttttcttaaaatgatgaggtgaaaaatgaaaatacttcaaatattttccaactgtaatagtcgatgatttgtaagatgttttctctagttggctggtgtccataacctctaaggcttgacacttatgagaagtttaagaaattctattttagtgtgttcagggtggcccctttacctttccaagacttgctactttggaatcgatgactccacagagcgtaaagtggaattaaagctgagagatgcctatacccacttgtatcagaaatccgtccactatgaagatatctgtcatgattaataaggctaggcagttctcaataaagaaagcatgagtgagtttgttttactgcacaggcttgccctgatcatattaatttgaaaaacagctggaggtggcaacttaccaggtaaaaacagattgggggaccgataaaattattcagatgctcatgggcagctcctctgtaattcacaggaaagcctacacttacgtctgagaagcagcattacggaaaagtcccagcagaatttgcaaactcaggtagtcaacagtttgaactacaagtattctatttgtgggtatacccgtatgggcctttatggacctccttaggtggagaagggcctgccagtgggtatacaaagagcaagaaatctgacattgggcaggctttagtttggaccacatgggaatacttctaagcgtctttgcattattagcagaacaagcatttcttacagaagacaaaatccatacctggagattcagaaatacacttaagataaaatggggctttctagtcaagctctcttaagtctcccaggatgtctgtcagtctctcagagctgtgatttctgaagactttgacctcattcaaattaggtgaacaaccaagttaaacttgtcatggtgtttttttgactggaaattttatgacagaaaaaacatgcagatacagttgacccaacagtggatggactcagccaatgtcatttaagtctgtctttctgagtagaccctgtgaaaggtctggggctgccagtgccatttactgcatcaaccaagatctgagcacattccccttccgttttttttctggaaatcaagtgccgtctccattagaaatgcatgttcctgaaggccagggaagcctagagcgaagccatgtcagccataacacatcatgagatcctccctgtgccccattaaacaaagcctcggtatttgccttgttactgcatttcacctttcagtgtggaagagggttctctaaagcagcgaagcttaactattgtctttaatctatcacttgatctaccttttctttttttcttttttgcctacataaatcattcaaaatttgtttttgtgtttaaccaaagtttcagtaatcctctaaatttatattagatgtctgactagtggtattcatcatttcactttttctaatagaagctactctgaccttaaatctatgagaaaaggaaaatgtgaaggacatggactttggaaaagcttgttagtctctgtaccgacaggtcatgtcactggccactttcctaaaagaaagaagaccatggggaggacattctagtaggtgcttttcttttccagctgataatacaaaaaaaagtggaatacatttcatgactgtaagagtttgtaattaggttgtatatctaagacacacacacacatcattgacaaataagaaaaaaatagcacagttaaaaaattagttcaaggctacctaactaaataataacagaattgggtttaatacttaatctctgaattcagccttcccagttggcccaaatttaagtcaatatctcctcttctcaacctgctatttcttttcctgagttttatcttaaggattagcactattgtcctggatggagggaatgcaataattcaaagccatcctttgccctccctcttcatgatcctactatccaatgagcaggaatctggctgattttacctccgcaatgccatccacatccatgccttcttctacacgctgctggatattccagggatttttcatctcttacttgggctgtttccacagcctccgagaggtcttgttatcttcagggctacctatcaactaaatccagccaccacatggccaatacttgcttttattacagaattaattctgtttttgtttgtttagcacctctaattttgtccattatttgctatagtttatatcacaaaacctttgtcctacatgcaaaactcttcatgatttggcttatatgaactgctcctattattataaccatcctttccatatattccttgctacctctctcctccctcacaatctactcctctgcatctttattgtaccattttctttggctcagaatgctcttctttaattctgcttaactcaatcctgttattatacttcctacaattgtactcagttgttttctccttgaggaagttgcctctgaccccagcatgggctataccactgtgattccttagatttgcatatgcaatgtgtggaactgttttgccttctatgttactctctgttaaaccattacctcactgaaagctgagaccccattttaatctccctcccctactctagtacctattacgggctccagagcatagtagatgctcaataaatgctttatatacacagtgaaagaactcttatgacaggtgtcataagaagtttaaggatagagtggtgcctgtggatttagaaccagtggtaagaaagctctaagttgtctgtgtggggaaatcctatcagtcgaggccgtgaagcaggacacacaaagttagggtccctttctccttgggagtttttttggtgtggtttgtttgtttgtttaacaggaaagaaagacacaaagggtccttttggcattttttcatggaggacacagcagtcatatttatctctgcatcggtagtagagtctgggagagtatatcacattcattcattagagaatgtatctaactgaagactagaaaatcttctaatattagtgataaaagatgtgagttattattggatttgttgttttgttatgtttttgtttcttttcctgtccttactgattctctcaaattggttatgttgttccagcaaaaagatcaagggaatattgggggcagtaaaatctgttttgttttttaattccccaccgaaacggaaaaactaatacagccaaataatgagctcataaatactaatttatgagcaggtaacaatcatgacacctaacaaaaagtcattcaacactgaacttgaagttagaaaatcatgttttaatttccatctctgtccatctagttatgtcatcttaagctaatttgtacatagttctacgtgccactttcctctttcatgaaataggaacgttgatgtagatatcttttaattctatgacttcaaatcctacaactctgatttaaatgatttcaaaaacatttattgaaaccttctcatgcttaggaatgccagccataaaataagaaggtctggttcttgttcttactgagttataatttagaaggagaagtttaaggtataaggagcattaaatgacaattatggaagtacttaaactctgtttaacatccaggacgcaacacgtatttcttacattcagcaaatataatacttctcaagtccttctatatgtctggcactaaaataagtgcccagaatgaaaagaaaaagagaccaaagcctctgcccaaatcctgtaaggcaaaccatttccaggcctgataatgaacgtggagatggagtaagattcacaagacagaaatgatgtcatcaaagtagtggaataaaggtgggcacaggacattccacattagatgattactttaaggcagcatagtatgtccattcttggtgctagatatttgtcagcttatgcccatttaaccaatgagatgaaaagcaaaatctgctatactttctgagaaagagaagtcaggcactttctattgctgaaaatcctaagaaaacatattgctcccgttgctgcagacaactatgttatgaacacacagacagccagacttaggatgaagccgttgtttgtaaaaagaggagaagtatggagagaaactcaatctctgatgacacaatgcagtagctaaattagcgacttcgaaggcctattcttcctttagattcctgatatctgagatcaaatccccctgtattaagtgcatctgaatcaggatttctaccacttagagtagaaagaatataactgatactggaaattggcctgttacatgctttaaaggcttagaataaagagcactatctgatggaggtcactcgctatagggttcccatagtttgtttttcaggcatggtgagaaaggttcagacaaggatccattgccttttttcccctcattagccatgtctaatcaatccccaatcctgtcaattccatgacctttatacatcttacctgcttctctccatttctattaacaccaacacagtccaaaccagggtctttgcatacctggatcactattgtggatttctaactggtctcctgcatccatcaattttcactcctctattttattctctatcatgcgaatcttataatttcttgacttacagagcatctttaatggtagctcattgctttttgataaagtcaaaacttcataaaatgtcttatgactgtatcaataatgtctacctctcccatgtcattattcagtgttccaccaccctcccgtgactaccactgggcttcagctattctgaatctccttcaaatcttgctaatgcatgtgtgttctcccatggggtaaagcatgtggttttcccaccaccgggaatgccattttctcatgtcagtctgattcctatcatctttcaggtttcatatacaatgttacttcatgtggaaagtgggttttgaccctagtgtagattgctcctttctgctaaaggctcccgtgacccctctgtacttacattatctcactctagtataattatttgttggattaattctttttatttttgtaggtcctcgtttgtgttgttcactgttgtaatcccccagtacctctctatagtggatacgccacatatattgaagagctgaatggtttgagtacatggagaattatgcagactaccttttaaaaagcagccagggaaggggaaagtacagacactgaggataaataaaagcagttagaattcaggcagaaaaacagcagttactgaatgttctgttttagagttgaacaaataaatggccagagattgaagtagacagttaagaagctgataaacaagataaacattaaaaaatatatacacataacactggtatcatacctgattcagaccttgagccattcagctaattctgactgattccaattggtctggccagttttctgtgtgatgcaaaggtaatttatttaatgtattctgtgggtataaaaaaccccccagcagctctgcccaccactaaagatgagctacagtatcagtagagacatgaatgagtcacacagggtcagatgccagctctaccaagttcaagcatcttaacttgaaactgataataattcgttaaacagttgtacaaatccagactctgtatgcagagcagcagctataatgtccccaaaactgaaacttatcattataataacacaaaggatccaaatttagaaccctggaagaatggctgtaccaaccaacagaaataggaattcaagtgctgagcaatgtagccacctcctctcatggttggtgttctcagtttaacacggttgagctacaatccacaaactggatgactcaaaatcaaaagtaaaaaatccaatttagttcacagtattgatactaatgttagtctccgtctggaggtttatcagcttaaagtccatctgctttataaagctaaaaaaggacgatgtattcacagtctggttttggtttcaaatggagaaatatattctgaagctattaacagtgagtggatatgctctcgaggtagagtatcagagcagccagcacaacaatccaaggaacttcccactgcagtctgcctgagtgcttaggttcaggaaatctccacttagctgacactgggtattggttcagcaacatctctaactgggtgtggggtaagaaagtagggttaatgggtagggtgccacctgagagagacagtttttttctttccccacatcttgaaaagcattatggatactcacactaaaactctggactgtttctgtttaatccaaatgatttcagtttagtcttgatcagaacaaaagccagattactttttgaaaaagatcatattttcttaaatctaatgtagacttcatttcacattgtacatttggagattaggatatacgtagttaatctagtgatgagttttttcccctctgaaactgtttttaaattagtaatatcccattagatcaatggcatctgagcattggataaatatggcatacattcttctatgtggcaaagtttcctgtcctgcaggagaagatatctattattgtgcttgggaccttcgatgtgaagaccccacctggtcagacacttgatttctccttggtgttacttttacatcctgaaagtgcttctaactggcactgaatccagacaatttttaacaaaaaaaaaatagtttatcttattatttaaaaaaatcaggacactggaaaacacttaagaaaacagagattaaatagacatcataaacccactacctatggaaaactatgaagaatgccccaatcatatgcttcctgatcatttttgtgcactgtaaaaattatttaatggtactgtccttttaatatatctatacatgtcaacatagctccatgtcagtatgtttgtttacaaccttgttttaaatggccaaatggtatcctactacacaaatatgctgctgtttgtaatcaagtgcaggaatttgaagaattcaagactacattgtactcttcaagaccacattgcaactctatttacctctttgtttagactacaagtacctagaagacaggagccttgttccattcaaactgtcttctagatgctttgcacttgatatatattcaataaatgtggatttggattaatcccacaaacaaaaagatacttgggtgaacacacaaaatctggaagtatagtctattggtttcctgtggcttcagcataacaaactgccaccaacttcatggctcaaagcagcagaaatttattctctcatagttctggagagtcagaagtctggaatcagtaccatgggtcagaatcagggtgttggcaagaacatgcttcttctggaggctctagaggacaatctgtttcttgccccttctggctctggaagctgccagcattccttgatctgtggctgcatcaccccaatccctgcctctatggctacattgccacctcctcttctgtttaaaatctccctctgcctctatcctataagataagtgtaattgcctttagatccccacagataaccctggataatcttcccatctcaatatcttgcaatcgcatctgcaaaggtccattttgccataggggataaatttacaggttcaagaaattagagcatgagtaactttttttttgaaggttgggggacatggcattttctgccaataagtaagatacataatttcaactatactttttaatcgttgtgttttcagaaaaagtgttaaggcttgagaaaagtgggaatggagaacacactgttcaattatctttttcttgagaaagctttggtgtttgccgaagttagaacttgtattttccatagttagactatactttcctatcatttaaaagcctaagtgacttgatattactcaattctattaattgaaataacagtattacatttacttttaactataaataaaattagtgcatatagcctggatatatacagtcatattggagaaggaggaataaacaataaaaccaaagaaaaagggagtacacaagtggagcaaggaggcagaatagaaagctctaccaattgtcctcccaccctccccaccctcttcaagaacgcttttaactatctgcatacacaaacgcacatttacaagaaccaaacatcaggcgagaatcacactacctatatctttcttcatatggttggaagaggcattgaagagactaggagagtcagtcttgaatcattggcactacccctttctaccccctggcagtggctgtgtggcaccaagagagaatctgtatacctcagggagacagagcgcagcaactggtggactttgcattgaactcagtgctgccttgtcatagcaaagagcaaagccatcttcgactcagccagcactcatccagggcccacagaaggagcatttggaccaggcctagccagaggagaattactcagccctgaggctgcaacttgagtttcttagaagcctcacctttgtggactgaaatgctctatggtcctaggtgaatctgaaaggcaaactaggacacaggaatggcatttcttaggcacgtcctgatgctgtgctggtcttagagccaatggactggggtggtgcatgacctagtgaaacaccagacatgactgctaagagagtgcttgcaccacccctccttcaacaccaggtagcacaactcacggcagtgaaagtgactccttccttctgcttgaggagaagagagagaaaagtaaggagtactttgtcttacattttgaataacagcccagccacagtaggatacaacaccaggcagagttctgaggcccctatcccaggccctagctcccagacaacatttctagatataccgtaggccagaaaggaacgatctggtcctggagggattcatcacctgctgattaaagaactcttgggccctgaattatcaacagtgatacccaggtagtataccatgggccttgggagaaattctgagacatactcacttcaagtaccagcttggctacagtgtagtagagcaccaagtgggatcttggggtacccaagtccaggcctaggctcttggataacattactggacctgtcttgagccagaggggagcccattgccatgaagggtgagtcccaggcctgtcagcattcacaagggccttaagtgaagagcccttgaaccctgagtgaacattagcagtggcctagcagaactccctgtgggccagtggttatggtggccacgatgagactcctctgactgtggaagggggaaggaagagcaggaaggactttgtcctgtggtttgagtgtcagcttagctgcagtagaatagaataccaggtatatttcaaaggattttaacttgaatacgtggctccaagtcagcatctctggccctgcttagggtctgggggaacttgccaccctgaatggaaaggcacaaacctggctgacttcactatctgctgattgtagatccctagggacttgaataaacataggtggtagccaggtagtgattacagcaggactcaagtgagacccagtgctgtgctggcttcaggtctgaaccaggataatttcagtggtggtggccataggagtgcatgcatcaccctacccctagctccaggcagctcatcacagagggacatgctatttgtttaggagaaagtaaggaagagaacaagatcctgtgcctgataatccagagaattctttcagatcttatccaagatcaccaagctgtgggatttcttcaacaccagaactgttctacaagaaatgctaaagggagttcctcaatctgaaagaaaaggatgttaatgagtgataagaaattatttgaggtacaaaactaactgggaatagtaagcgcacagagaaacacagaatattataacagtgtaattgtcgtatataaactattcttaagtagaacgactaaagtatgaaccaatcaaaaatactaatggcaacaacattttaaaacatatatagtgccataagatataaagagaaacaataaaaagttaaaaagtgggtgggtaaagttaaaatgctcagtttttattagttttctttttgtttacgcaattagtgttaagttgtcatctctttaaaatcatggattacaagatagtatttgtaagtctcatgataatcttaaatcaaaaacatacaacaaatacataaaatataaaaagcaagaaattataccatcagaaaaatatcactttcatttaaaggaagataagaaggaaagaaagaagcaaaaccacaaaaccaccagaaaacagataacaaaatggtaggagtaagtcctcacttatcaataataacattgaatgtgaatggactaaactctccaataaagagaaacagagtggctgaatggggaaaaaaaaaaaaaaaaaaaaaaagcaagacccaagtgatctgttgcctttaagaaacacacctcacatataaagatacagactgaaaatgaaggaatgaaaaatagatattctatgctaatggaaaccaataaaaagagcaggagtagctatactggcatcagacagaagagatttcaataaaaaactgaaaatagagacaaagaagggcattatataatgataacaaagtaaatacaggaaaagaatgatgattgtaaatatatattcacccacccaacactagagcattcagatatataaagcaaatattattaacactaaagagaaagatagacttcaatacaataagagatggggaattcagtactccattttcaggattagacagaacttccagatagaaaatcaagaaagaaacatcagatttaatctgcactgtacagcaaatggatctaagaaatattacagagcatttcatccaatacctccagaaaatacattcttctcctcagcacacagattattctcaaggatagaccatatagtagacctcaatacaagtcttaagatattcaaaaaatggaaataatatcgagcatattttctgatggactaaaagcagaaagcaataacaagaggaattttgaaaactatacaaacacatggaagtaaaacaatatactcctgaattaccagagggtcaatgaagaaaataagaaggcaattgaaaatttttttgaagcaaatgataatgaatacacagcatatcaaaacctatggaatacagtgaaaccatattatttcttcatactgaagagggaagtttatagctataagtgcataaataaaaaaaataagggaagcttcaaataaacaacctaacaatgcatgttagagaactagaaaagcagaaacaaaccaaacccaaaattagtaaaataaataataaagattggggcacaaataaataaaattaaaatgaaaacaatgcaaaaaattaacaaaatgaaaagtttgttttttgaaaagataaacaacattggcaaacatttagccagactgactaagaaaaaaagagagaagacccagataaataaaattggagatgaaaaataagaaattccaactgatactgcagaaactcaaaaaatcattagtggctactatgagcattatgagtgactatacatcaataaattgtaaaatctagaagaaatggataaattcctagacatacacagcctgccaagattgaaccatgaaggaatccaaaatctgaaaatctgaacagaccaataacaagtaatgagatagaagccataataaaaagtctcccagtaaagaaaatcctgagacccaatagcctcactgctgaattctaccaaacatttgaagaagaactgataccaaatcctactcaaactatttcaaaaaaatagaggaaaagagaatactttcaaattaattctaagaggccaatttatgaggcttctcttaccctgataccaaacccagacaaagacacatcaaaaaagaaaactacaggccaatattcaagatgaatattgatgcaaaaactctcaacaaaatactagcaaaccgaattccacaacagattaaaaagattatttgttatgaataagtgggatttatccccatgatgcaagcatggttcaacatatgaaaatcaatcagtgtgatacatcttatcagcagaatgaaagacatattatcatttcaactgatgctgaaaaagcattagataaaattcaacactgattcatgataaaattcctcaggaactgggaatagaaagaacatacctcaacataataaatgccatgtatgacagacccacagctggtattatactgaataatggaaaaaaaaatggaagcctttcctctaagatgtgggaaaaaaatacaaggatacccacttttaccactgttattgaatatggtactggtagtcctagctagaacaatcaaacaagggaaagaaatagaacattcaaattataaagaaagaaatcaaagtactttgtttgcagacaatatgatcttatatccagaaaaacaaggatttcaccaagaaaattattagaactgataaacaaattcagtaaaattgcagcgtgcaaaatcaacatacaaaaatcagtagcatttctatatgccagcacggaacaatctgaaaaagaaataaaataatctcatttataatagcaacaaataaaattgaatatctaggaatcaaccagaaaatgaaaaatctctacaatgaatattacaaaatattgatgaaaaaaagaggacaccaaaaagtggatagtccatattcatgcatcaggtgaatcaatattattaaaatgtccacattacccaaaacaatctacagattcaatgcaatccttatcaaaataccaatgacatccttcacagaaatagaaaaaagaattctaaaacttacatataattacaaaagacccagaatagccaaagctatctcagcaaaaagaacaaaactggaggaatcacattacaggacttcaaataatactacagaactatagtaaccaaaaccagcatggtactggaataaaagcagacacatagaccaatggaacagaatagagaacccagaaatgaattcatacatctatagtgaactcattttttacaaagttgccaaggacatacattggagaaaagccagtctcttcaataaatggtgctgggaaaactggacatccacatgcagaaaagtgaaactagatctctatccctcaccatacgcaaaaaatccaatcaaaatgaattaaagccttaacttaaagacctcatactatgaaactcctacaagaaaacattggagaaactccccaggatattggtctgggcaaagatttctatagtaatacttcacaaacacagggaaccaaagcaaaaatgaacaaatggtatcatatcatgtttaaaagcttctacacagcaaatgaaacaattaacaaagtgaagagacaaccctcaaagtgtgacaacatatttgcaaactacccatctgacaagggattaataaccagtacatataaggagctcaaacaatcccataggaaagattgactgagatctgaatagacttttctcagataagacataaaaatagcaaacaggcatatgaaaaggtgctcagcataactgatcatcagataaatgcaaaggaaaactacaaggaagtatcatctcaccccagttaaaattgcttttatccaaatgtcaggcaataaccaatgctggcaaggatgtggagaaaagggaacgcttatatacgattcatggaaatgttaattagtacaaccactatggagaaggtttgaaggttcttaaaaaaactaaaaatagagcaactatatgattcagcaattccactgctgggtatatactcaaaagaaaggaaatcagtatattgaataggtatctgcatttccatgtttattacagcactattcacaagggccaagatttggaagcaacctaagtgtctatcaacagatgaatagatgaagaaaatgtggtacatatacacaatggagtactatttatacataaaaaagaatgagattctgtcatttgcaacaatatggatagaactgaaagtcattatgttaagtgaaataagccaggcacagaaagacagactttgcatattttcacttatctgtgggagctaaaaattaaaacaattgaacttatggatatagagagtagaaggatgattatcagaggctgggaagggtagtggggatagtggaaggcatgtgctggttaatgggtacaaaaagtagttggaaagaatgaatgagacctagtatttggcagtataacagggtgactgtggtcaatagtaatttgattgtatatttttaaataactaaaagaatataattggattatttgtaacacatagaatagatgcttgaagggatggctgcctcagttaccatgatgtgattattacacattccatgcctatatcaaagtatctcatgtaccccataaatatatacacgtactatgtatccacaaaaattaaaaaaccattattttaaagggagcaagtgagaacaaggagaggaataatgtcatggcgaggctgttgcatatggagaacagtgcagaaacaccaaatgggaccaggggaacccttgccctctccctttggcatttatcagtgtcatgggtattgactcctagacagcacttaccagcctgtgatctatatttctgagtggagaatgtggaatggagggaatgggtaaagcaggatctataaatttgatcatcttgtgtctaccatctccagcaaaaacattgacatcagatctattcatcatcatcatcattatcatcatcatctattgtcattattattatgattttatgcaactgccaatattactcctattgttatttgattcctaagcctcatttactgtgagcaaagcatggtgctattccattttacgtagtttgatttaatcttctggcaatgcaggcagtgttccttgtgtctgtgaaagctgaaattgcatcaaacacaataatcaacatgaaaaagtgcagttttctgtgacttttaaaaaattgatgtcaaacattaaaaatgtactttttttacaattggggataaatgaatagggatatgaaaaaatataacttatacgtatttagtacaccctaatttaaaaatattagaaacactgataactaaagtgtttcatttctttattaaaataatttacctaagacagctagattagcttgcctcctttttgtcatacaacttactacacaaagcaggcatcttttctaatccttggtgacctgtcatactcctttctaagttgagatccacttctaacattttatcctctgcactttcgatgccatgaaagatctctgataatccctttcatgtgaagttttttgccatcatcagtaagtctgggacattttcaacctttttgtcacaatcacttttctcatttatgttgataagttcatctttgctaagttcttagcctgcatgtctacagtcccttgaatggcaaaatgtcaaggtttctaaggtcagctgtttggtctccatttggcttccatttaaatcttaatcccagtgttatcatttttcatttctttgctgcactttcatctctgtttcccagttctgcatttcaattaccaatttttgtaaatgtcacatcgatttaccaccgggagagaaggaagcaacacaactacacattttgctgtctgtgtgtggactgattagcagatacccagtcagcaatcactgaaagactttggaagaagtgatgtgactggccactggtcatgctgtgcatctcttatgtatgtggtgatttgtgaactaaagagctagcagcaaagtttgtactttatgcctttactcaaaattcatataccatagtaattaaacattgagccatgtttttggagggctttgtcatttacctaaactgtgataagtaaaacttgtgcatctcagaaatgtgcacaaagtgaggactgcctatactctgaagtaggaattatgagtttgcccatgatatggaaaagaaaattgagtcagaccaagattatatgattaacccaatgattatatgtattaagtggtaaaggctgatttagattttaaaattcaggtagcctcattacagatattatagcttaacttcacattgtttggcatcagattgaatctcaaaccctgacttcacattctttgtctcgactcgaaccctgactgtgatctctgtcaattaagcttcctggaaatatagttgattttgcagcagctctggttaatcaagaactctacctcctgctaatgacagagtctccagcttctcaaatttcttgaaactgtttctcaagaatcaatttacttaagactgttttcaaagactatagtctattacgattataatattacagtgtactacaggtactatagtgttcacatttgaagctttttcttgtatccttcaactccctgattatggcaatttggttgacactttgaagctttccttctttctcaactgtcctcctgtcctgggcttttaccacaaacactctcttggtgtctttaaagtttttttctcagtaatatctgccagcaaaggaggactatatgacacccctattttcttcccaggttgtccctttgcatttgtatattttcaggagagtgcattaaccctgttttggaaaggcaagaattcctttctaatctgtagtcatttcagtttgttattcactctgaaaaatggtaatgaaagtggagaagacagtggtcaaattggcactatgcaaagctgagatgctagctagtgacagctccagaatgatggtcctggagctgcagccagcataatataaaagcaatcagcccaagtataagacctataatctccctataaaaaacagctccatcatctgccatctctgtgacttagggcaaggagcatttcagaacctcagtgtcctcctttataacataaagaaaagcttgaactctcattaccaacatcagtgaagattaaaatattgttactattaagtggctgatacatgtaaaagtcacgcaaaagttagattttattattagggcttgaaagagtgaggcacagtggcatatacaattatacacaaagatgattgattgattgaatgatagcatccagaagtcttttgcagtgtctcccaaaatctgttctctaatcattgttgtgaaggccactttataactacaccgtggataacatacctctaaatacgtctcggtgtatcctccttaattttacaggtataaccagataattgcaatcagtattgtaagccttatttgagaaaagatacttgctaataggtcattctcctaaactaagctgtgtgataaactagagataactcccaaattcaaagtccagctctacttttctgacatttgtgttgtcacaaattattgggagtcctcacttaaaaacaatctgtctacctgtggccccatagcagtgtctgatgaaccaagcacatagaaaagtatatgttgacataggccatctcttgctccagaagtgttcactacaggaagcctaaccatttgtcacacagggtcagatctcaaagtcctttcccttattcttcgagttttaatttttatttagttttctctcaatgccatcatgcctgtgtttaggctggtcctcctgattctttgtcctcaattaaaatatggataaataagatggtctctaataccagctttatagaaagtaggtagaatcaggcaagattctctctagtttgtcatacaacttgacttgaatcagctttgtgagttaggagtttgactgtactccaaagagattcaaactgagaactattcctttgggctcctttgttgtaaggtccattaaacacaatgagggcatatggacatggtttaccatttcttcacaaaatccactgcagagtttctagtgaagttgcaagaaaaatgacaatgaagtcaaatgtgttatttgttgagttaacttaagcaatatatgttgactcaggaaataaaatattacaaaagatagagacaaaacccagaagaaaatgccaagcaaaacctcagattcaatccttgaaaggacaacaattctacaaattgtagcatataatcatcaaattctgttttcttatgaatatatgtacattttcccatgaagataatatgtttacaactagaattgtggtctacatattgaatagaagactgttatttttatttaacaatatgttctgaacatctttctacatctgtaaatgtattttgttatgcacttgtaatagcttattgtatataggcacaatgatttcttttgtacacatcctgaattatacccttcaaataaagcctcagaaaaaataattctgggttgaagtctataaacatattcctagttgctggtacctatggactgacctgagtttgaattccagttcttgcatatactagtggtatgatattagctcttaatttcaaattatgacttggcctaaatacattggttttattcctcaaaagatcaccttcaaactgtgatggaatcttcagttttgaacaatttacaatttttgccagctctgatgcaatatgcatccactagagatagaatatactttctgtcacctaatcctcaaaaccactgttatgtcagttttgtttcttttaattcatgctattctgatagcaaacattgagacaaggaattgggtgcaggtattttatttgtgagattgtcccaggaagtaggaggaagagtgtctggagagggatgcagggaaggaggaaacgtcaatatatggggcatggccgagcagattctgaaggcaacagggactcagttgtgtgggacctctgtgaaaggtagagaggaatctccaggtttgtcctgtttctgacataggaagcaggggtgattacatctaaacgaaaaccacctccctgtgtaataattcctcaaaatgcatggtgttggatctagcaattccaagtgcttcagaaaagacacagggctagatgcagaaacaggactgtcagggtgagtctgggcttaagtgaaactgttcactggaactgtggctgaagtcataagtaggacaaagatgcatgatttggggcagcaaaaacacctgttacgttagtccagtgtaataggcagaaaatttgatctcaaagagattaattaatttgcttgagagcactcagccagtaattggcagaaacagccttcaaactctggttttctggctccaacccccatgttcttcccatcacaccacgcctcctccaagaaagcccagcactttgtgcttgtatggaagctccaggcactctgctctgggccacagctgtttgggcatagcacagtggtgtgccctgctgtataccacccattcaacctctaaatcccctacagcctcagtgttcagacataagggctctatcctttttatctatctgaacccctgatttttcccttcacagaatcagtgaacttgtacaaatcgtttcaaacagtgcattgcaataaattgatgggttgtgaaatcagtttagtgagacttgactagcattttaaaaataaaatagatgaaaatatcagaagtgtgtggtttctgtcactttatcaaaggaaaaaatgtttattcatgtgtatgtgcgtgtgtatgagcatgcgtgtgtatgtatacgtgtgtgtgtgctgagtctctacaaggaatttatttcatatgatgggacatggataagaaacttggaaagccactgacaaataggttcaaaatgcaggctcaataatgctcaaaatgcatgggttcaagtcccaactccaccacatactagccagatatgtttcagtcttcctatccataaaacatggctaacctcaagggctgttgaagaataaatgaattgctactcatagaaagttgagaagagtgcctagcacattaggattactcagtcattgttacttttcattgtaaaagtataatcaatatatgaagtacaaagttggcatgtaatttttgtttaatatggaacaagggaaaagaaaatcatcaagtattttcaattatttggaaagacatactatggagattgagttaaaatagcattttccttacatttattttgtgctctctcccaactgcccctcactacccagtgttctagccctataaacacagtatctatcaacttaaacaatgcaggtcttaggaaaattaatgtaaaatatttagtaagctaaaatttcattcaaaaatatgcatttttctagttttcaggaggataaatgaactgtataagacggtcttgttccataaatagtcttgcagtctaaacaaatgactcttaaattgccataaactaagacaggattattataccttccggctcagaaagaacactgtaactcaggctttgtgaaagagccagtgactttgaaccgctgcatgaatgtgggtgtgttctgtttatgtaatctagagtagtcatttctgaattgattgcacacaaaattcatccgagggaacactgaaaatcatttccaattgcattgggccaattgcatagaaaacactgagagtgtccccaaatccattctataaaaaatgctcctagaaagtgacagtggattgaaagataagcagttttgaaaataccttgactgaaatttgctgactgctcattcttggcttgaaataatgccattataattatttttagtgtatctatctgaagcaattatacaatacattgattttcactgcctcttcaagaacaaccttaaaaaccatagacacggagattctgaaatatcaggagaagatcaagagaatgctttttccagggccccagtcacgataagaaccctttccctagcatccttgacatgtttgttagaggtgattgaaggattctagtgataagtagtcatttgtctccaataaaactttacagttgcaatcataaacaggcttcaaagttcttgtagtcataaatcatctggacttttatttgcttatatttttctttgaaaactgtcttataaaaattaggtgtatgttaatggagagtatatatgccttactataagtaaaaattttgtgttactagatgtactggttttttttttctaatacacacttaaatgagaaaataacaattaacatgaaatatgttagttcttacaccgtctaaaatcatctattagaaccaccctttgggaaacactctttatgactaagaggaaataagcctcctatttgtctcacctaacagcccttcaaatgcatagatctgtgaacatttttcttcctcaggggaaatatctataacttccttaactgtttcttatgtgaaacaatttcctaactgctcaccatcctagcaaccttcttttaggtgctctctgctttgtctaagtagcttttaaattgtggaagcttctctaaggtgataatttcttatctctggaaaatgtaggcattcctctatagcttccttttctgagtcataggcctgaggaactcacttctagaaaatgtgaatgaatcagcagaatttcttatggctcttgagcattatctttgtgtttctttgataggggatgtggtagcaagtgagtgcctttatatgaagatattgggcaaaatatcaaagttttttacaaggaggactagcataaggcaaaggatccactcattccttattttaattgacctgttcattttgagatagttgtagattcacacgcggttgtaagaaatagtgagagatcctgtgtttccattaccagtttctcccagtgtcaacatcttgcactgtcctgtagtacaatatcacaaccatgatgatgacattaatgttgtcaaagtatgagaattttatatcaatacaaaatcccctatattgcccttttatagtcagtttcttctcaacctcaacatctggcaatcactaaactgttctacatcctgtaatttttgtcctattatgaatgttatataaaaggactcacacagggccaggcgcagtggctcatgcctataatcccagcactttgggaggccgaggcgggtggatcacgaggtcaggagattgagaccatcctggctaacacggtgaaaccccgtctctactaaaaatacaaaaaattagccaggcgtggtggcaggcgcctgtagtcccagttactcgggaggctgaggcaggagaatggcatgaacccgggaggcggaggttgcagtgagccgagactgtgccactgcactctagcctgggcaacagagtgagactctctctcaaaaaaaaaaaaaaaaaaaaaaaaaggactcatacagaatccaacctttgagattggcttttatcatttaacttaattctctagagatccatggagttgcaagtatcaactatttatttttcttttctttcccatttacttatttcttttccttgctgagtagttttctgtggtgtggatgtaccacagtttgtttaaccattcacctatcaaaagataatacattgtttccagttttgagccattacaaacaagactgtgaaaattgtgtacaaagctttgtataatcataattttttatttctctgaatcagtgtcaagaagtacaattgttgggccatatggcagtggcatgtatactttttaaataatctgtcaaactgtattccaagtatctctaccattttatattcctaccagcaatgtatgaatgatccacattctggagagcatttggtgttgtcactattttttactttagacattctgatagctctatagttacatctcattgtggttttaatttgcatttatctactggctgatggtgttggacatctttaatgtgtttatttgccatctgaatatcctgtttggtgaaatttctctttatgtcatttgcccagttgtaactggatcatttacttactgttgttttaagagttatatatactggatactaccccttggttagatatgtggcttgaaaatactttctcaggctgggcgcagtggctcatgcctgcaatcccagcactttgggaggctaagagggcagatcatgaggccaagagttcaagaccagtctgaccaacatgacgaaaccccgtctctactaaaaatacaaaaattgactgggtgtggtgatgcgtgcctgtaatctcagctagtcaggaggctgaggcaggagaattgcttgaacccgagaggtgaggttgcagtgcagtgagctgagactgtgccactgcactccagccctgggcaacagagtaagagtgagagtccatctcaaaaaataaataaataaataaataaaatattttctctcattctgtaacttgtttttcattcccatgtttagggtcttttgtagaattaaagttttttatttggtaaagtcaaatctgactttatggattatgcactctttgtctagtattatagataccaaatagtttttactgtttttttctaaaagttttagagttttaaaaagttatcttttctctactgaattgcttttgagttgtcaaaaatcaattgtccatatttttgtgggtttatttccaagttctctttctttttcattgatttatgtgtccctctttctaccacgttcacagtcttgattgctgtagacataagttttaaaattgagtagactaatttatccttttattttttcttccttctttgttgttttccttctttccagctttccttctttctttctcattttttttcaaaaattgtttcagctattctttttttgcctttctatagaaattttaaaataatagtaatataacaattaattacagtttttgtaagtgaaataattgaatacaaaaatatcttgctgggaatttgatcggacttgtgttaaacctgtaaatcaggtttggggacaactgacatctgtactatattgaattttctaattcatggacactgtgtatctgtccatttatatagatgtttggctttttatcagtgttttgtagtttttagcataaaagccctggtcatgttttctttagatttaattactaactttctgagtgattgcaaatgatattttattttatttttatatgtgttcattgctagtatatagaaatacaatttatagttttatttttatcttgaattctgcaacctttttgatctcatttattaattccagaagtcattttgtagaggttttttttttttcctcacagcgtctcgctttgttacccaggctggagtgcagtggctcaatcttgcctcacttcagcctggacttcctgggttccagcgattctcctgcctcagtcccccaagtagctgggactacagatgcatgccatcatgccaggctaatttttgtattttcggtagacatggggtttgtttcatcatgttgcctggtctggtctcaaactcctggactcaagatccatccacctcagcctctcaaagtgctgggattacaagcctgagccaccgtgcctgccctgtagattcttgacttattgcattggctatacatacatgtatgtgtgtgtatagtatgtgtctatatatgtgtgtgtatatatacatatgtgcttgcatatatgtgtttacatatacttaatgaaggtatatgtatatatattcattaaatacaaaaaaatacattcatgtgtatatatcttcattaaataaacggtgacatattccacctttcctatttctctgttttccagaagagatagtttagaattgatgttaatttatcttgaattgttttgtataatactccagtgaaactatctgtgtctagagatttttttggggatgttttaaaaattatgaattcaagtttcctgtttttttttttttttgagacggagtctcgctttgttgcccaggctggagtgcagtggcgtgatctcggctcaccgcaaactctgcctcccgggttgaagcaattctcctgcctcagcctcctaagtagctgggattacaggcacccaccaccacgcccagctaatttttgtatttttagtagagacggggtttcaccatgttggtcaggctggtcttgaacccctgacctcgtgatccacctgcctcggcctctcaaagtgctgggattataggcatgagccaccacgtctggccgaattcaagtttcttaatcgttacaggactatccaaatgatatatttcatgtttggttgtgatattttgtatttctttaaagactcactcatttcgtcaaagtttcagatttatgagatacagctgtttgtggcagtcctttattatcattttgatgcccgtagtgacatacactgcttcattcctgatattggtttttctctctttcctttgtcagttttgccagagttttgtcaattttattgattttttttcaaagaagtagctctttacttcattaattttcctttgttattttttaatttcattgatttctgctctcttccctcttccttctgctacctttgctttcctttttctaagttcttgagcttgcagcttggatgattgacttgaactcttttctagtgcatgcagttagtcctgtaaatttcacttagcattattttagacatatgtaacaaattttaataggttgtatcttcactgtcaatcagtttgatgtattttttattacacctgagccttcatgtttgatccaatttattatttaaaagtgtgtcgttttcaagtgtttgaaaattttcctactactttctgttattgagaatctgtgatattctatttccgtcaaataatacacgctacttgatttcaattatttttaacttgttgaggtttgtttagtggcccacaatatggtctgtcttgacatacattcaatgaaaacttgaaaagaatgtacatttggctgcgattgaagactgttggttaatggtgttgagttcttctgtaaacttgctgatattctgtctccttgttgtatcaatcatgtagagaatgatgtggacgtctcaaactacacttgtgaatttgtctatttctcctttcagttctatcgatagaactgttttatcagttctatcagttatttcacatattttgcagctttgtttttggtgtacacacttttttttttttttttttttttttttgaaaccgagtcttgctctgtcgcccaggctggagtgcagtggcgccatctcggctcattgcaagctccgcctcccggctcccgggttcactccattctcctgcctcagcctcccgagtagctgggactgcaggtgcctgccaccacgcccggctaatttcttgtatttttagtagaaacggggtttcatcgtgttagccaggatggtctcgatctcctgacctcgtgatctgcctgccttggcctctctaactgctgggattacaagcgtgagccactgtacctggcctggtgtacacacttttataattgctacaacttcttggtgtattgacccttttatcagtatataatacatctctctggttctggtaattttttttgctctgaagataagatatattatctatatcttatcttctaagtttcctttgattaatacttccatgagatatctttttccatcctcttaatttcagcccattttgtcatatttatagtaagttttttgtaaacaacatagttgggtcatggcttataatcctatctgataatccctgtcttttaagtggtaaccttaggccatttatattttattttattttaatatattagaatttaacatttaatattttgttttctgtgtgctgtttgtctcttctctgctttctttttcttaacttattgtggattacttgaacatttatttaaaattccattttgctttattcatagtgcttttgaatacatctttttatatagctttattagtaactgctaggtattacaccctattttatataggtaacttgtcacagtttactggtgtcatcattttatcagtctgaataaaatacagaaaccttacttctttttgtgcccctttatccttcgcctttggtcatataattgttttaattatttcctctgcatacacttagacttagaagcacattatacgacattacaatgtttgcttcaagtgtcccaaacataatttagaaaactcaagacaaaaacgaaagcttactgaatctacccacattttttgtttactgtgttccttctaccttcttgatgttccaaagttccttcttttattttttctttctatttagataatagagtatagtcattattttaggataggcctgctggtgacaagttttcttagatttcttcatctgaggtttttaaaattccctctttacacttaaagaatatttttggctgggcgtagttgctcacgtctgtaatcccagcactttgggaggccaaggggggcagatcatgaggtcaagagattgaggccatcctaggcaatatggtgaaaccccatttctactaaaaatacaaaaattagctgggcgtggtggcgtgggcctgtagtcctagctactagggaggctgaggcaggagaattgcttgaatctgggaggcggaggttacagtgagctgagatggtgccactgtactccagcctgggcgacagagcgagattccatctccaaaaacaaaaaatatattttcttaaccacactaaaagtattgtgctcccttttttctgaactccatggtttctgatgggaaacctattgtcacttgatttgttttgttttgttttcattatgggtaagatgtcatttttctcaggtggctttcaagatgtttttctttgtttttaaaagtttaattatgatgggtcttgctatggattcattggggtcgatcctatctttggtttcctcagctccttgaatctgcaggtttatgtcttccattgaatgtgggaagttttcagccattattcaagttattttagccccaccctctttcttctggaactctgatgacacaaattttaaaacttgttactgacccccagtcactgaagttctattaattattcttcagtctactttctgtttttcagattggataagttttattgtttaatcttccagttttctgattctttcctctatctccttttctgctattaagactatcaagcctgtcctctgaggattttattacatttctatttttttagttttaatattatcatctcgttttttatcttctgtttatttgctgatacttttctttggtgaggctcttttccagtttttcatttgtttccagcgtgttcataattgattactgaaacattttatcatggttgtttttaaatttttgtcagcttattctatctttcattttgatgtatgcatttattgtttttgtcatactatttaagatcttaggttcttaatatgatgagtaattttgaattcaaacttggatattttcatattatgttatgagatcactaaatttatttaaaccttctgttttaactggctttttttttttacactgtgctagcagtcaaagtgggaagtaaaattcataattgccttgtgtatataaaaatccaagcattctattcagtctccattggtacctgactggtgggttcctcattactgccaagcatggatgaaaattctggctctccatggagtctgccctggaactgtctgtagggagcatattcctgccagtgagttcaaagtcctggctccctacttggctttatttgacaccactcaagtgcatcttgataatctcatggacgtggaagtgcaggttcaccactcggcctttgcatgagtaaagatagagccacaatattttctgggtgtttaaccagtcacagtagttatttttaagttttctgacttgttagattgctatttccctggccaacttcctagagagaacaggcttgttttggggcacttttcatctacctcatttgtaattccagattctagcttcgtcaactcagagataaatgagggaaaaacaaaactcaaggcatgcaccactgtgtcctttctgaaattccctagacaatcagctttgttctctacaattttcagtcttcatatgcttatttttattagaatgtccaggattctccattgtaattactaggcgaaagagggaaaagtctattttctccaccttctcaaaggctgaagaccccacctattttttttttttaagtacaaaagaagaaaaatatttcgttggactactctgtactgggcgtttgacttgtagcatctcatttcaaatttttactacactcttggtgtttttccagttgtacaaatgaggtacccaggtcacaggaaggttaggaaacttgccccagctcatacagatggaaaaggagagagctggaattttgagcccacatgtggctcacttaccagctccattatgttttgtactctccattcattaatttctctaatactttcaaggtagcaaaagttttgagaattattttctcaagtgttagaatacttgtgtgaggttacttaaaggagaaattatttatcaaaattacagaatttaagaattagaaaattatttgatttacagatcttgctcccagtccagatcttactctatgctgcattttctgctcccataaaaggactatgagttcacttatttatcattgagttgcacacatcttagttgatcatagctctgaagtgagaacagagtgtttacaagggcaatggatgcctggaatttcctggcctcactattatcctagctgttctagccctttcatgcacatgcttcaaatctcagcctttgggttgtgaagcacttcagagctaagagtgcacatatgtcattatgaccatcacctaatgctgagatggcttctctgttagtctgtctttcccccacggagtgggaaagcactgaatctttccatctttatattcctggcaccagaattgaccattatatcataggacctcaagagacaatattgagtaaatgtatggatggatgaggaaaataaagtaaaatcagcaaaaatatcctgcatgtgagaaggtaagttctgattgaataatcctttatttagcaaagtcatatggcctactttgaaaaataatttaggatgattataaaattacacaaattaatcagtttcggcatgttctattttttctgacctttctcaaaataaaaaaagaaccaattactctttgggggaggatattgcttttctttaataaaaataggaataaataaaacttgcaaagcacttcctgagggcaaatattttcatgggattatattgattactttagctgctgctgaagataagaccattgatttttctcattatctatgagactctaatcaataccaagtatttattgactagctcttttatgttttataagattctaaaggctaaggtaactaaagaagaaacaaacatatgcttccttcttttatgttacttaccttgtgtttgaacacacggttttcatggaagaagtaatgataaataatataagacaatgggattggagcactggcttgcattagacatattacataatcacaaatgatagctttaaaaaaagaagaaggaagtaggtattgattgtctaccattgtattagccatgatacgagaaacttttttgttatctttaaggaaaactttttcaaaccattattatcagccataatttttacctgttagaaatctgagactttgagaagctgaacaactagattaatgctgcacagtaactgaaataagtaggattcaaacagagttggaaagaaaacctgtgctctgttcaatacattaagcccattgagctaaataactagtaagtgtttaataagtgtgtttcaaaagtaaaagaaaaagagtaagaatgagacagaagtgaagaaatccacctgggggaagtgtggagattaaagatgtgtagggtttggatgcatgaggaagcgaaaatgcagggcctggaaagagtcacaaagagtcccccaaacagcggagtacagaccagtctgatcaggaaagagacacagtgggaaacaaataagacctcacctggtagggtgaaatagtgagcagggagtgtacatcgcacctgataggaagaagaacggatcagtataaaagtgtggtttcagtaaaagagagcaatttagggtgggggcaggttgtccaggcctgaatttagttaactacggtgagaaaggagtacttggttccctgagggattgcttctcagatttggatgatggacagatgtgagagaaggagagagaaatgacttgcaaaattcaaactggggtgattgctagaacctggtaagctacatggcaaagaagcttgcagtcgtgatctcatcacttattagtttttatcactttgaacctcagttttaatgtcatgaatatggggttgccaggcaaattcagtgaaataaaatatgtaaagaacctagtccacagtagctttccaataactgtgagtttatatccctgggtgaatggcagtgtttttcaaaaggaaaagaaagcacaggtgactggaatgattgagtttaccttgggagctctaacgttttcctggagagaccccacacacgtttatagaaataaatttgatctggaccctgaaataggtcagaggtcctcaatccatgaaatcagataacaagctctgtgccctgagattcttaggtaaaaacggctaggagctgtcggtgcctgtgatagtgcagatggcttctgctgagccagctggctgaattgaaaaccccaagtaggtcaaatacacattacctgaaatttctggggaatgtggagccttctgctttgcataaggcaggtcctcggcttctgtgccttctttgtgtcgatctgggctggtgcacttttgaactcagaggaatggtaattctccacaccacttctggtggcccctatctttttatcgtattatcctttctgagtacccttcctttttcctttaactctacaatctctttctgggctttagaactgtcctgttacaaggttatcttacattatacccattatacaaggggataaactaagagacagaaaggttaagggatttatttgcgatagcctattagagtaaagccagagttacatttctgtggggaagatgaggtcttaaaaagacgatagccatcaagtagtccaggggttggcaaactttgtaaaggattggatagtaaatattttaggctttgtaggctacatatcatccccattactgttgttgctgctgcttttcctcctccacctttaaaagagtaaacaaacattctcagcccgcaggctgtacacatatagtccatgggccaaatttggaccaaagtttgccaaccctgaagtactttaatcctttcaatgtatagatgaggtgacaaaaagacagatgagtttagtgaggcacccaggtgtcaccaagtctagagagtggtggagctgggctagacctcaagtttcctcaacatttttctctttgccgtagttcaatttctcagacacttgccaattgtaggaagtagttatttacctatttaaattccaaaatgggccatttgaaaggccatggagactgaggtaccaaagttggtctcctcacctctgtatctatgcttgtctcttgctttttaatgtaattttcactgcctaagtccaaagattgtttgaggtggtgtaaaaaagtacaaatagttcacaataataaatacatgataaaaatcacgtgatacaaacaatgaaacagggaaatagtaatgctaacagaaagattagcagtaagtattgaactttgcctctggcttcctgatgcctataacaaagagaagttcatggtcagtcacaaaagtcagcgttcacacatttaaaatgaatcagttgtttgttggagcacatattttgtgattttaagaacaagtagtcatttctccaggggctctgtgtgaacagtgcactatataaagccatgttcaggttttatgtctcacaattagtacatatcaggctgcactgtttattggttagaccatggcttgtggagctgacaacctgtgttggaatctcattctggtacattcttgcaatatgaaattggcaagtcctttggcttttcttatcctccatgtccttatctgtgaaatgggaactaagaatagctacctgagagcttgtggtgaggaatggtaaatatacataaagcctctagaagagactggcacatgatcaattcaatgagcagttactattatgattgctgcctgtagattcttgacttgcattttgaaggagtgatgattgttaaagcacagacaactcagaactgatttgctattagatgaatgcttaatgattcttggtaaatgcctgaatatgaatgatttgatgctagatgtttcaagtttatgtatgagacgatgggatcttatttttttaggaggaatgggcacccatagtcatattaaaaaataaagcacatttgatgttgttaaggtaaagcccaacaaagccacagctgatatttcatcttgcaaatctcgaccttgaacttatttgttcactctctctaatcttcatacttgggtataagatagagaaaatactcatggaataaggacaacaataataaaagcattgcatttgcatgtcagcttgatagaggtgaaaataaagaagcttatttcaactcagtattatcttgcatgatttgtattaatgatatcgcagcctcagtgtttaaagccaagtttggaaatttgcagatgctactaaattatgagaaaacaacaaataatgaggcacaacgtattctgatggaggagaaatttgctcatttgggcacctcaggctaatagagagctaatggatggcaaatacagtttgtttagataaatgtcgaataatgagttttgaaacacagactaaagggagggaatgcctaatgaactgaaagtgctttagcacaataaatcaaagaatgttggtgtgtgaataaaggggatggtctaaacgtgcaaactcaaattgttttttcttttcagcaaagggcagaaatggtcaccagaagtaaataacacttttaacatgcagtaatcagcatttcagagtgcagaaataggaggaactttgaaatctgtcctatgtgcatttaatttctgctccttttccaaaattatacgatttggagtaattctgttgatctacctgaactccattttcttcatctgaaaatgagaatagtagtatttgtcagggctattgatatggtgttgtcaggtgaactgcataagggtctctgggctgagaggccatcacccacattgcaaatgtcatagatttgtctaatacatttatagatttgtctaatacatatatatgtctaatacatttataaaatacatttgtctaatacatttaagcaccatgctctttatagatagactcaaagtttcatgtttgttcattttgtttgttttaatcaatatatacataataaaaacactgctgtatagaggcaaaatatgttgaggaaggggtactttttttcttttctaaattgctaaaggcacaacagcaactggtgtgggggctaaagatttcctggttggaggcatgcacagccccagggggatgagtttttgggtgagatgggcaccagctgtgaaggcacctctctccagattggtgctgctcactgataagagatgactgctttgccaggggtcagtgtgagactatggaacagtacagggaaaatcaaaacactgggagccacagaaagaatccaccatggtgggcactgctgccctcagtgctcctgtaggattttacctttaaaaagctgcactgcgtgtgtctttatagtagaatgatttacaatcccttgggtaagacacatgcacacttatgtttattgcagcactagtacaatagcaaagacttggaatcaacccaaatgtccatcaatgatagactggataaagaaaatgtggcacacatacaccatggaataccatgcagccatgaaaaaggatgagttcatgtcctttgcagggacatggatgaagctggaaaccatccttctcagcaaactaacacatgaacagaaagccaagcactgcatgttctcagtcataagcgggagttgaacaacgagaacacatggacatgaggagggaaacatcacacactggggcctgtcatggggtgacgggctaggggagggagagcattaggacaaatatctaatgcatgcgggtcttaaaagctagatgacaggttgataggtgcagcaaaccaccatggcagatgtatacctatgtaacaaagctgcacattctgcacatgtatcccagaacttaaagttaaaaaaaaagctgcactgcaattgccaatttccttatctggctctttccctttcctgtgagctccttggaaggctggaagctaaccctactatccctccttccacaggaaagttcctgaagcctgtgtgacacttggtacattgtttctgaaaaagtgaggaatgagtctctcttctgttgcctcccatggaggtcagtgtcatatttctaggcttagttattttaaattgccttgattttttgattttaatatgcatctttttttttcttctattctgaatttttggtttgtgtcagccaacatttattgaatgcacaatgtatgacaatcattttcatgctttattttaatctttagttaatctttaacactcttatgagataaacatcgttagccccattttctagatgaataagttgaggcttagatagaaaaatagtaaattgctcaacattgcatagtgagcagattgcagaggagagattcaaaactaagtccccctgtcttcaaactgctcttaaagatttttctcagtgggtccctgaacattctttcccgtgctagtctcaaaagttattctaatattttcttattttgctcgacatacacaaacatgaagtaattacaccccactattgcctcatgtagctccaaacattccagtatccttgccctgtaagtaaatcaacattcactatttgtctttagttcccatttgtgcttagatgaataacctactctattagcctgaatttttttcatattttatatctatttttcaaatctcatttatagaaacatatgggagccctgctgaaaggattatagaaaaatccctttgggcaagaggtgtgcatgaaaaaatacagttttatttcatcactctcatgcaaaaattttcaatagctccttcttgccaatttaatcaactcaattgctggcaacttagtatccattctttaggggactagacattcatttctaaatgcacttccttcatattctatgacacaaactccctcacatgaccttcacatgtctagctccccaagtagcctgtatgctcttcacagataggaggcatatcatatatattccaatgaactatttggggaactgtattccctagctctgggaaaattgttttcctctctgtggcccagagaagccaaatcttcttttattattattattatttatttatttattatagagacagagtctcgctctgtcacccaggctagagtgcagtggcatgatcttgactcactgcaacctccatctcccgggttctagcaattcccctgcctcaacctcccgagtagctgggactacaggagcacaccaccatgccgggctaatttttgatattttagtagagacggggtttcaccgtgttccccaggctagtctcaaactcctgaactcaggcaatccacctgcctcagcctcccaaagtgctaggattacaggtgtgagccagtgtgtccggccccaaatcttttaacgtactattttctttgttgaactggaccatctactcatctgccatccaaacatgacctattcctagtaataactcgaatttgggtattcttttagagcttggaaagcatgtttacatatattatctcctcagattctcaccgtatccctatgagaaaaatattttaagcatttttatttttcagatgagaaaggtagaggttacctgatgtgtccagggactgccaaactaatgaaggctttggatgggatcctgacacagacgttgtgattctaaagtccacattctaaagcactgtcacactatcctaccccaattccatccaccacagagatgttgctttctaatcgtcctctcaacctctatacactttgatagcatcaagaagtttttatcatattaacaaccaaataaatgcacaaagtgaaacagtatgcatattctgaaaatacagattaagacaaatcttttcctctcccattcccctcgccactctcaccttggaaccaagccccactgtaaggacatgctggcgccccagagcctgtgtggtccttagcatgcaccaccttgcaggaatgagctggccctttgtccattgtttccctatgctctacttgaagaacagtaaagacagcctctgaagcacattcagttgacccttggacatcgcagggtttgggggactgccccaacccggtcaaaaattcacacataaattttgacttccggccaggcgcagtggctcacgcctgtaatcccagcactttgggcggccgaggcgggaggatcacgaggtcaggagatcgagaccatcctggctaacacggtgaaaccccgtctctactaaaaatacaaaaaattagccaagcatggtgacgtgcacctgtagtcccagctacttgggaggctgaggcaggagaatggcatgaacccgggaggcggagcttgccgtgggccgagatggcgccactgcactccagcctgggcgacagagcgagactccgtctcaaaaaaaataaataaatagataaaaaaacaaaaaagcctttgactcccgaaaaacttaactactattaataatagcctattatcggccagaagcctcagtgatcacgtaaacagttgattaacacatatttgtgttatatgtattatttgctctattcttacaataaagaaggttacagtaaagaaaatgatactaaggaaatcaaaaggaagacaacatatatttattatttattacctggaagtaggacatcataaaggtcctcatcctcattgttttcatgctgagtaggcttagaaggaagaggggggaattggtcttgatatgcaggggtggcagaagtggaagaaaatctgggtataagtagatccatgcagttctgacctgtgttgttcaagggtgaactgtactcacagtgcgggtggaaggatcaacacaacttaggacataacagctaattgctttactgaacatatactatgggctagagatggttctgatgatattacgtgtagtaaatcataatcctgaagacaaccctaagaagtagtgtcccattatttcccccattttacagatgaggaaactgaggcacaggtaaaaaaaattccaggggcacaactagtgttagatttgggttatatcttcaggcaagcccaccagagcctgagccgtactctctgtgtctggcgttgagaaaaaacaaacaaacaaacaaacaactgataagatgccagcttgagaaatggcgtagagcttcagtctgactttatgcctctgggaaacatcagaaagggggataaagtgtcaggaactccactgcagtgatatcacctacatgaggaaattgatcctgtggacgcagcatcacttaccagcctgaagacactgcaccaactgcctgattaacagcaataatgataataatactaacatccaccatttattgacaaattcctattactgtcaatgtctccctattgttataaattaagcccaagctcctttgtgcagtgctcaaggaccttcgtaacacaagatctgcctatttcttcagactcatgccgcatatatccatcctcacactgtaagctccagtgatattgatgggttcattgctcctctgcacccttcaatttcagggcttcacttacactcttctcccatcttgaacgtcctttatgctctctacacctacgcaactctttcagccttgattcaactattcccatatccaggaagactccgcatagcacacagcttaggtgaaataccactcctctgggtctctagagcaggaagggtttacatctgtcttcatatttactgactataataactacctcagtttgtacatctaacattcaccaagtattgaaattctgagggcaaaatctgtcatattcacctgtaccctattgtccagcacagcacctgcacaggctgtgtcaaaaagtgacagttggcattgtgtatcagaccctgggtatggcaccttgaatccagttctaatctcagtataacctacgagtttgagattatcgagccgtatgtactagttcattctcgcattgccataaagaaatatctgaaactgggcaatttatgaagaaaagaggtttgattggctcacagttctgcaggctgtataggaagaatggcagcatctgcttccagtgagacctaagggagcttttactcatggagggaggcagaagaggggcaggcaccttacgtggcaggaacaggaccaagagaacaaggcggggggcagggggtgccacacacttttcaaaaaccagatctcatgaaaactctatcacaagaacaggaccaaatggttggtgctaagtcattaatgagacctccatccatctgatccaatcacttcccacaaagcccacttccaacactggagatgacagtttgacatgagattaggtggggacatagatccaaaccatatcactgtattaggtcatttttgcattgctataaagaaataactgagactgggtaatttataagaaaagaagtttaatttttctcaccgttatgcagcttctgcttttggggaggcctcaggaagcttccaatcatggtggaaggaaaagcaggagcaggcacttcacatggcaaaagcagggatacgaggggcggaggggcgacacatttttaaacaaccagagcacatgataagtcactatctcagggacagcaccaagaagatggtgctaaactgctcatgagagttcacccctgtgactcaaactcctcccacaaggctctacctccaacattgaggactacaattcaacatggcatttgggcgaggacaaatatacaaactatatcacaaacctactttgcttgtgaaaaaatatgagctcagaaaaataaagtaatatactcaaaactgcatataataactaatacgtataataagaagtgttcaattcaggattcaaatctagcattgttcagagtctggaattttttttctaggtctgtattctctatcacactaactgtctccttaagaataaagtaaagttggctgagcacagtggctcacgctcataattcccgaactttgggaggttgaggcaggtggatcatttgaggccagaagtttgagaccagcctagccaacatagcaaagcctcgtctctacaaaaatacaaaaattagccaggcatggtggcatgtgcctgtaatcccagctactggggaggctgaggcactagaatcatttgaacctgggaggcagagattgcagtgaactgagatcacaccactgtactacagcctgggcaaaaaagtgagactctgtctcaaaaaaaaaaaaaaaaaaaaagaataagataaagttgatgtttgggaaactgagcagaaaaagcaacaatcaagattctcaattcttaattcatgattcctgaatcgatgcacttgaaaaagagaaaaaaggatcagctttgggaatgtgttaaacactcacttctgaacacccatggtttatctagaaagtgaaaggacccatagaacttggtcaacccttgatcacgacagatattgaggagatatgcgaatgcttggaagattcacaataatcatgttgctcaggaacatgaaaataattataggtgacatttttaatcacttacataagatgtagatggctttatgtgatttactatataatatattccttataacaaaatatgccatcatcatttttagatgaaaaagctaagataaattaaataatttctgcaagtttgtcttctgctcactaagtagaagacctcagactcaagcccagtctgatttcagatcccacgctcattaataagaatccttccttgtctggctactgttgacctctaattaggtgctcacctacattaacctggaggaacaaagctggaaaggggcacaagaatcctaggcaagagtagggaagggacggtgcaaccagacaaggcaggcatatttgaaggtggtttaggaatttacatcacgaatcccaaacatccatggagacctccttttaacacatgacttggcccagaggtaggcagtaaagagcaagttcagataaggctttttccctgcttataaaaaacatctgcaagttaaaagttgaaaagttatttatttcagctattcactcacttcagccccaatcagcacatgcctcagaatatctggagactgtgctaatacactcttgacatttggactaagacagagactgcaattcaatgttaacaacctggggtacctaaatggccattccacattgatcacttatttcaggcatttctccaaatagaaaaggttgattttatcagacattcactcttcttaatgtggatcagtagttctgtctcataccagccgtagccgcctggtgcctgacttgcccctctcacaggctggtggggttgctgacagcgtatcactgattttccacaaccagctccagagacacttgcccacacatcttctaggaaccattgcagatgtggctctatgacctccccataaactgaactcctaaatgctgaggcttccagattccctccaccaccccctgaaccagaattaaatattaaagaagtaaaatacattgtattttttaaagcaacctttgcgttgtcctttgcaaatattaaaagcaatgccactggcacaggaactaatccaagtccctggggccacttttcaaagaaagaaaagagtaatagtaagtaaacctctaaatgaaataaaggaagaaactccagctaaaattgctgaataataaaataaagacatgtaaatcatcctcgggggataattttctcctcgatcctggctgattttgcagatgaaaggaacacagcgccagaagttcagcgaccaggctcttcatcccactctgcccattcattggctttgtagcctcacttcaggcaagtcactcaatctctttggagctcagtttatgcttctgctgtagagaaatgataacaccaacagaagtcacagaggcggacctggaagcaatgagaaagctaactattttctgcctttctctctgccctcatcacataaattcaaataagccccgtgctccagttccaataaaggagtctcctcctcccgggaaagctggtttctccatctgcgcttgtgaacccacctcccgttcctgtgggggcatctggcctgagcttcggtctatatctatgaagtgggattaaaaataatgcctgcctcacagcgatgttgtgaggataaatgagctgaatcaggtaaagcacttaagacagtggttggtacatgcaaagtacacaataaatattagctcttcttatgtgtggctcttatttatccacatataagaaattttcaagtgtctttcatctgaaatacctgaatatctaaacatagttcagtcatgcaccacatcacaacattacagcgaatggaccacatatacaacggtgtttctgcaagattataacagagctggaaaattcctcctgcctaatgacatcttgatgatcctaacccgtgtgtgtgtttgtatcttagtttgtaacaagaatgtttcaaaagttaaaaaaaattaacagttagttaaaaatagaaaaaagtcttacaaaataagaattataaaatattttgtatagtggggcaatgtgtctgtgttttaagctcagtgccgttacaaaagaatcaaaaagtgaaataaaattaaaaactgtgtaaagtaaacatgttatagtaagctgcagttaatttatgattgaagaataattttttaaaataagtgtagggtaggctaagtgtacagtgtttataaggcctacagcagtgtagagtgatgtcctaggccttcacattcactctcccatcactcactgagtcaccgagagcaacttctagccctataagctccattcatggtaaatgcccaatacaagtgtaccattttttattttatgctctattgttactataccttttccatgtttagctatgttaaaatacacaaatgccattgtgttacaattgactatagtattcagtccagcaacatggtgtataggtttgtagcctaggagcaataagctgtgccataaagcctaggtctgtagtaggctatactgtctagatgcgtgtaaggacacactgatgttcaattacaaaatcacctaatgtcacacttcttagaacagatctccgttgttaagtgaggcatgactgtatattaagttatattatatataacttaaccattatatatgttattaaaatatagttaataatagatatatataaataaatttatataatataaatataatttatatattacatatgaatctgtatttctatatagattatatattatataatttaagcattatatatgttattaaaatatagttaatcataataatatatgtactgcatatgaattatatatttatatattataaatatatgtatacattatacataaatctatattatatatagattatgtatatagttctctcttaacctcttctgacttgtatcctcctctagatactacctcatttctcaactttcctatacaaccaaacttcttgaccaagtgatcaacatttacaatctttatttttctttcatttttgaaggaaaaaataaaagtatcataaactccatgtatgtatcacacattccatcatcaactccatacctcaccaactttctgttctctacattattttgaggcaaattattgacatattatttttccataaatatcagtaagtgtcattgagaaatttttttctcctctattttttgaatttccactcactcttgaacatgtagacacacatctattctagacaccaattagatagatagagcagtgatcatctgggcaatactgaatgccctcccttaacactccatattctgcctcattttccccatttatgaaaaggtttttttgttttgctttgtttttgttttcaggtaagtttgctaatgatttcccgactgtcaaatccaatgaacattttttagtcctatatcgtatagtgttacttatatggcaaagtaaagcactttcctataattttattgtctcctcccaccccactctgaacacttgcagaacgcattaccatgagtggactctgatggttgatataaataacagaagctttagaacttacacacaattctcctggcccagcactagttccactccatgactttcccattcaaaacagcataggagcctatcatgctgacagctttggtagctggtactcgggttgctgttgtccttgtttttatttgtttttgagtaattaatacatttatattatacacagttagaaatgtgcataatcatatacagttaaagtttcctgacatcttgtcccttagaaaaccaagtcccctccctcggaccaaccacttttcaggctgctgtatgtccttcagagctgctctacacatatataagcatataaagacctcctccctcctttttaatacacacctattagcatacaaatgcactgttctgcaccttgcttttccacttagcaataaatcttactgatctcttcagatcagtgcatgaaacacttcattccttttgaggatgcacagtattaaattgtgtgggtgtatcataatctcttcagccaatcttccactaatagacatttagactgtgactaatcactgccattaaaaacaatgttgcagtaaataactttgcatacctgacattttgcaaatgtttgaatacatgtataagaaatttctagaagtgttattgctgaattaaaacatatgaaaacttgtcattttttgagagatagtgccatattgtccaacagagaatttgcaccgatgtacactccaatcagtgaaaagagtggcattttcctaatactttcatgtaaatactgcttattaatttttctgacctactcaagtccaattaataaaaaacaatatcttggactaattatttagcattatctatcagccttgctttatctagatttttaaaattttaactgttattgttcattgttgccatttttctagatattatgcatatttttggtattcattatttatactttaacctggtggttgttttaacatattgtggtagttttgtttttgttgttatttaatttccaggtagtagaataaatggattttctggcttttatattgattttagttttaccccaccgtgaccagataatgttgtctgcattatttccatgtttgagaacatattgatgctttcctagtgattatttttttgagaattttcaatggatcatctgaaaaatgtttaatctcacctattagtctacggagggtaactatatatctattacatctcatttttaaaccatattgcttaaatcttttgtatatgttttttattcatttaatctttcatgaaatggaaaaggagaattgaaatctacgattactttatttctgtgtatttctccagatactgcttttttttttctttatacaagttatcattgcaggaattaggcctacacaaaagtgcaagaggtggggaagtgaaggtctagaagtagactaaggattcgagaaggtgtcctcactaaccacttgtgataaaaaattaaataaatatgtgggctttgtctctagttcctgacatacagctcctaaagtccttagaatctgcagagttctgtgcctttggtgtgccaacaagttactggtggctggagcaccctggatagatgcaggatggaggctgggcaccagcaagtcctaggcatggttggaattatagcactttaagcccgacctcccaacctctgggcagaggaaagagggtagagattgagttaaccattaatggccaatgaactgatcaaggatgcctatgaaattaaacctccattaaagcctgtaaaggggtttggaaagcatctgtgtcagtgagcgctttggggtgctgagaggtggcatatcccaaaaagccatgaagactctaccccttcacccattcttttccgaatgcagctcctccatttggatgttcctcagctatgtccttgaacataaatcagttacattaagtaaagtgcttacttgagttctgtgagccattctggcaaattatagaaactgaggaggggtttgtggaaacccccatatatatagctggtcagtcagaattgctagtgacaacctgaggcttggggctggcacttgaagctggagccatcgtatgggactgagtccttaacctgtgggatctgacactgactccaggtagatactgtcagaattgagttgaattgttcaacaaccattggtgcctagagacttgaaaattgattggtgtgagggaaaaaaaacccagacatttggtgtcagaagcgttgtgaataaaacagttcagatcagtgctcctgaagcaccagtgtggtggacaagtgggagctttcaggcatgtctgagaagccagcacatccaaccacgtaggcaggactgtgaaatgagagctcagggagaaagagagctggtgctgttgtgcagtgattacctttgtgggtctgaaactaacctctgatgatgggcttgggaccactatgctctcagggctggcagtgaggaagaaaagctggacctggaattgagaacaatgagggctattggaaaccactgcgtctatctttgtccctgaccatgaagaccttccagaggcatccagaccacattttgaatcttcttcaagtgaactttttgtctcccagaaccatataggaaagggaaatctggaaaatgaattttctagcttaacaaggttgactcagtacaacacaactcacctttgctcattatgatattccaaactttctgaatcacttgttatagatgtgtctcctacatacagtatagagtttagatttgattttgtctaatcttggattttttaaattttaataggtgagttcagttatattgattagattgtgtagtagaaagttatgcttttagttaatcaaattttttgttacagtatttcctctggtgactgtatcaaaataattcaagtagactgtatgttcttggctttgtgctagcaatgtgtgtgaacccaaaatatctgagacaggtctttaccaatttagaaagtttattttgtcaaggttaaggatgcacatgcatgacacagcctcaggaagccctgatgacctgtgcccaaggtgactgaggtacagcttgcttttatacattttaggaatatatgaggtatcaatcaatatatgtaagatgtgcattggttctgtctggtagctgggacaacttgtagtggttggggacttccaggtcatagctagataaaagacaaaaggttgcattattttgagtccttgatctacctttcactgaatacacaatttagttgagcatagtgaatctgcatttttacataaacagtggggcagaagaaacagtcagatatgcatttgtctcaggtgagcagagcgatggctgtctgtcctgcacctgtgaagattagctgctggtttacattgccagggtgaaattgcacaaaagtattttagggtaaaaatcttgaggcccacaaggaattttaaccttagagctctaacttcatataatatccttaatcctctctctctttaaacattatctgttgacttctggttatgagcaatgattaaattaatagctttcctctcacttgcaactgtcacctgatcttattttattatgttctctttctcagtgtttacctttgtaatattaaataggcttacccttctactacttcaaatgttattgcttagggaccatcaatagaagacgagcagcccggaagacacttcctcccacttctcacccctttgccctctcaggccatctctctgtctcgttaatatttgtaacagagtttgcacgtatgatactgttgctcccgtgctctgtgccatgtctcagaaaaggaaggtaaaatgcctacgttcctctctcatgtgcacattagaagtatatgggaagctttgaatgtgttcaaagttaatgatttccaaatttagtcacttagataatattattttctaacgtttatttgccacacagcaagataattttagccacccactggtttgtagaaacccttcactggagaaccacttgtccagtacagatataacagcaacttccttaagacatttcagaaaccagaaagtgatcaattattttttatctaacttgagtttataaggctcatgtgtgctccttacaggggatattcttagactgtcattcatgcccctatcctcatcatattcccacaattctagtaaaccacagcttattactgagacactatcacattgaaaccctaacataagagctttccagagataaattaagtaggagcatacatcctgggagcaagcaagtggatcccaaaaagcacagagatgtgaggtcttcaatcacgggcagcttcctgagccggcagccagtgaggtcacataaggccccttgctccaaagggtccctgattgaaaatctttgaaataattaattttgtatttaaatttgtgctttttaactgatgtcccaggggaaaaaggggcacacactgaggcctcaaacccttgcctcacaggtagattttaggctcccagcttctctgcctctggatgccccaaaccccactcagccctcacctcacacagtgatagctgccatcctgtactcgaggcgaggcccaggcacacacacaggtagagttggggatggttacacatccccatagcatcttcatgtggggcatgacagagctgtcccttgccaggctggaaataccaggacacatgaggtaggcgcatcagtagtggcaagcctcttgcccacccttggttcagataacaagcgtatcctggaacaaaagttgtggtccttcagggaatacccatccttcttggactgggaagctggtacctggaaaccagagaccgatttccctgcctggggacagggcatctgtcaggtagctcacagaagggataaacagacagctggtgagccacaggtgtggctggctacatcacagggctgacccccatgcaccttggtagccccttgcctgatagggtataatgttaaatagcaggtaaataacaccatgacaagtcaacagagataccaggaagaaagtaaaatatgtgcatatggaattttgcactattaacggcactttattctggtttttgaacaaaggatctgcatttttatcttacattgagctcctcaaataaagtggttagtcctagaagtaatttaagtacaagacaatcttaccaatggctctagctattagggcataacttcacaaaattacaacaagtgctcacaagtactattgtaggctattctaagtaggccacacatgtgttcagtcctacttagggattaaaggcatatcaaccacttttttggggtatttacttgcttcaggaggtccaatcatttgcagatttgcagaatacttctccaggttgtgattcttttgctgtgagctcagtggaagcctctgtaaacctgactgtgacatcttccctttaaatcatctgttgttatgtatggactgctccttttgtactgagcaccgggattcagatttgtgaatggggaagtatatacaaagataagcaaaacactgactgtagattccatattcaagcctatctggactcatataatcgatgaattcacatgcatatattttggctgtttggccctggaagggagggaagttaaaacaataaaaaaaggccggtttttcaagagcttagaatgaaattggcagcaaaacacatattcatattaaagagaaataaacaatcaaaattaataataattattatggctgtcagatgaacagtgtcttcaaagagttataggaaagataagactgtttattgactatttaccataggtgaagcagtgtgctagcattttatgtatgtgatttcttccttccacctctcctgagagagggctattggtatcctcattttatagacaataaaactgaggctcaagtagcttaggtagtttccgagggccacacaacctgttgtcatttaaaggcaggtctatgtgaccccagagtattctactgtaaaatgtaccttccaaggataactgtctcatctctatttattcagtacatttgccattcaaaggactttcacatctattacctcatttgatctgcacaaaggcccttgatagaaagctcaccaccagaacggggagctgaggcacagagcaggtgaagagcccaagttcattatcgattcacaagtgaggctcctctgatctcccatgatctctacttgtctggtaaatgaatggactgaaaaatgagtgtataatcaaagtgcgatttgtccagggtggtattgtatgaataatttatgtagcataaatactgctggatggagcacttaactaaacccttgatcagatgcctgttattatctggctggaagacaatcaaaaaatgaaatgaaatttgggcaaattccatacacacttgggaaaggccacagagagcaaaggaagaacacaaaaagagaggaggaactcttgagagtttagagtgcatttggattcccaagactgctggaagtccatgatgaaaacgtgctaaagtgtagctgcatatctaggggagaaattacatgtagccactgtgattgcaattaaactggaggctcctttctggctatgatacggtgggtgggttgtttcatacatttgtagcttggcatgactgattctgacattgctaatgatcttaatatcactcgtacactgatgcatatgagcctgtatcagtgtgtattttaaaattcatggaatataaaattattgatctctcctcaaaatccaaatcaccataccacaggcttcatcactgatgtcagtaactaaaaacagctctcatgaagaagccacagtacaactgaaacaaaaccagaagggtggtcacaaaagggaatatcaaactttcaaaactcgaaggcccaaggcaaatgatttattgggagttggcataaaaatttctatgacatccccttgtcttctttccggtccttcttcacgttaatcatacagtgggcctttattccaaataataacttttattcctgtccttacaatttctccaaactcaaagctttgtgtcactacactgtatctattcaggtttttttaagaaatcaattcataattcagcatgcacactgctacggtactggtccagtctttctcacttctgtcctggaagacattatctgatgggcaagaacactgaatgacttgtccctagctagccatgggagtaccccatctatgcaagtttgctggaatcttgtgctgctcagaatataatactggagtttcatgtgttctcccaagcaaatttgaaactccctgaaggcaaacatagagatttctgctccattcaggcttgtatagaaatctggctggctttttaagtattcacagggattaccttcctgactattaattttagcttgtccttccttggcatcactttatttagtttccaaagacattgatttcccacttttgctgtgaatacttccctcaggttccccctgagttgactatttggacaagaatgtctagaactctgtctcacacctaaaatatggctctagctctgattggaagcatcatattttcatataagagatgttctggcctcctgccttgcttgaaaggtccatgcttgctgagccaacttgtcacactcctcttagataggatggctgttagtttctgttctgtttctcttataggcttctcacacagttagacatagacttccttgtatgtatcaactgagctctcatgttgagtttagtgttttattttttaatctttataaaattttgtgctcctaaagataaactcatgaaacaaaaatatttagcatgatgatttgttgcaaagtgattgcttgtgtaggcaccaatcatgttgagaatgaaaacatcacaagcattcaaaagtccccattatcacctccctcctcccaaaaaaaaccccatttgtacttcttgtttttctttatagtatttattacctctgcagcaagcatccttaaacactccgtatttttcaactctataaacagaatgtatcattttgtgtttcatttcttgtgtataatattatgtccccttaaggttctttcaagttgtttgcagcaatacagatatttcattattttcattagcaatcaggaaaatccacacaaaaccaaaataagatttcatacacaatagaaagaatacctaaggttaaaatgaaattttaaatggacaatttcaagagttagcagagagctgatacactgcctgtgaatgtaagtatatccagataatctggagaacaatttgttattatctactaaaatttaaatgtgtatacccacatcccgtggctcaacaattccacttctacatatgtatccctctgaatcacatgcacatcatcctaacagcatgattcatagtagctagaagctggaaacactccaaatgaatgtcagaagtaaaaggataaattatttcataatcttacaattaattctgatgtgggataattcctttaaagttttttgtacacctttctttataggtgttatatgtctcactcaaaaagaaaacgttaaaaaattctttattgtacaaatttaaatagaagtactctatacctctatgctgggtaaatgaaatactaggtctgttcaagtctttcgcccacttttttctatttgaatgtctatattgtatatatctattcaactgatacatatatatgtgtgtgtgtgtgtgtgtgtgtgtgtgtgtgtattatttgtagtaattttttaatatcctggattggagccctagttctctcttgtgttataaatatgtcatctcatcttactgtgtgtttgttcattttcttaattaaatgaaaagataagttcttaattttactaatctaattcagcaatgtttttccttatagcctcttgcatcttgttttaaaaatgtataatatattctatcatctagaagccttattgttttacctttcacatccgtatttataatccttttgaaattatttttgtggattatgtggagtaaggtcacactttattttttccaattgtccacatcattgaaaagatcattttttcactgctctacagcatcacctttgctatatatcaagtgtctctctctctatatatatatatatgtctattactaagtttccaattatatccccctgatctatttgcctaaccttgtgccaatatcgcatgtcctaattactgtagttataatgatttgtggtagatacaagggaaaaaagtccctcacctcattcaagagcatcattagctatacttcttatttttaattttttatacaactcttagaataagcttgccaagcttctaaacaaaatgtattgcgatatcaattggcattgcattgaatcagtagatcaggattagttcaggaataactcacattgttacaacattaagtcatgaatcaatgaaactggtccatctctctcttcatttatttagttcttcttgtatatttcactcaatgatgttttaaaattttctaaatacaaggctgtgcttctctagttacatttattcttagatattaatatttttatgatacattataaattgtatcttatttaaaaataggatcttctaattgtttattactggtatacggaagtaaatttattttactaaattgaccttgattcatcagccttgctaacctcatgaatcctaataatttatttatgaattttatcacattttttgtgtatataatcaaaccatccatgattaatggcatttatatattttcctttctggtcctaatatttaaatcattatcttgccttattacattgaaaaggaccttcagtacaatgctcagtagaagtaagaattatagacaagcttcttcattcataatcttagtaaaaatatttcaaaatttcatcaataaatacgatatctgattgaatatgtttgtagataacactttactaacttaaataatttcatttaatatttgcaatataccaaacatatggatatatatattatatgtacatatatttataatattgaaggtggatttttcaaatgctttttctgcatctaagattttatttttatgtcattaatataatgaattacactggttaatttttaaatcttaaacaaacctcaccttttaaaaataaatccaaattaattactgtatttagctctatatatctagagatctaaatatctgtagatactataatgatgttatgataatagcacattattatgattagcatattattatgtcatgatatataaaatcaaggattctacatatcttttttacatattactagaatcatttgactattatattttattttttaaggatgacatatatagaaatgtgcaaaaatcatagatgtacaattcaaataatcatcataaaatgaacaccctttcataactaagttggctaacactttgctacaggttttattagatcatagcaatctcataaaccatggacacattaagagtttttttaatttactttttattaatcaccaggcttaggaatttcggactgaaactcagggtattggaaataaatatttggggcataaagattattgacattctaaccaagtaagggctagccaggccctcagtttttggaaaacattgaaaagagtaatacgttttgaaaacaaaatcgagtgggctgctggcagagctataggcaaaggccttaaggtaggaaaagatcaaggattctgaagtcagatagacctgggtgtaacacgatgaaactaggatttctcttctgtaaaaccaagaaatgattgaattattgctttccgtataatagtcttttttttttttttttttgagacgatgtcttactctgtctcccaggttgacgtgaggtggtacgatcaaggcttgcttcagccttgatgcctcagcctcctgagtagctgggactacaggcagatgccaccacgcctggctaattgtgtgtgtgtgtgtgtgtgtgtgtgtgtgtgtgtagagatgaggtttcacatttgtgcaggctggtctcaaacttctggcctcaagctattcttctgcctcagtctctcaaggtgctgggattacaggcatcagccaccatgcttattttaagagtcctgagaccaaactgtgctggttggtaaagctcaatgcttggcactcagtcaacgctcagtcaatgttaatttctttctttctacatcttccttcagttaacacaaacttacaacaatgaagaaataaacattaaatgctctacagggccagtttttgttttcttttgttctttaggtataaacaaggaactaataagaggaaaaacatagcagcacttacagcagaaggaaaatccagactggatagtagctgaggttgtggtccctccctcccacttagtacagagataaagtgggtaccaggtgttcaaactataaatgctgagttaggagggatgtatacaagggtgtgaatcctgctatcacagtccccatagcatgagcacatgacctattactttctgtaggaagtgaagaagggtatcgggtaaaactctcttctgtgcaattattcacacaaaggaatcaaagagaagggaagagatggcagtagcagggctagcagctggacatccatagttttatttcactgtatccatgtacttagtcccctgaggtgagcttcgttgtttcctttccctttggtgactcaacacagactccccacctgtgcatgaagcactgcacatacattgagctgggccatggtgattgggcttttcctagaagataaactcttccatttttacataaatttaaatgtgtagcacagatctcctagaaatgtgggtcatgtttttattgaaaattttgtatttgtctattagtaatttccatacaccagaacttctgttaagattgcattaaaggagtggacatccttcatgaggaagatcctctgtgacattcctcctacatcatcttttggaggccacctttcagagtggcatgcatttcactaactgggtccttcatcccaatacagcttactgccagtgagctagaatccaggctgaaataaagcaagccaggacttttaagaaaatgaaacgtgattacaattttaagcacagatatctgagtgggtccttggcatgttttgccattatttccatagctttgcccttgaaatgtgagacagcactgaaacactctcctatcctcctctcctaacagagtagcacacactgatattgtcagcattattctcaaagtgttacttcagcttaagtttcccttattttcatttgattttctggttttgctttcagaaaatataaaccgagccaagaatttgcatcttcctagggcagaaacctgaggtctattctggaggctttatctgaatttcacctctcctcacatttcctaatcccacttttccatttgatattattctatcactgtctgacatattatatatcttacttgattgacttgtctcttacttgtctcacttagcacaatacaaactctgtggaggcagagactttattatgagtccttaatacctagagcagtacaaggcatatagcatatgctccatacatttgtgtagagataattcattatctcaatttataacaagaagcactgcatcctaaattatccaagttgatttggggtaaaaagttaggttgggaaacgaaggaaaagaatatttaaacaatctataatgaaatatattaatttaatgagtacttaacactgtattttctaatcaaatagtactcagtaaaaaaagccttgttcagcataagtgaatttctttccatagcaccgacttcttaaaaaaccagtacttacctactctcctgttctgcactcaagcacgaaattgattaaatcacttaattaaataccaatttaaattaccaattctgaggctccacttccagaatttgttaaaatgtaacatctctgtgcctcactctcagagtttctgatttagtcagaaattaagtgggaggattgcttgagcccaggagctcaagaccagcctgggtaacatggcaaaatccggtctctacaaaaaaatacaaaacattagctaggtatggtggcatgaacctgtagtcccagctacatggaactatatttagtcagaaacacagaagcatacatttaaaaaaattttcagggaattcttacatgcagtaaagcttgcaaaccattggtctaggtatttttttttaaatgacactattcttttaaaatcatttttctttcagtccttctgaaataaggtttgttcatgatcatgcaacagatactttagaatatatgtatatatctttttatatatttgtgtttaaaatacatacacacacacacccatgttatacacacacatatacaaagcctataaagccaaatgtatatccttaaatgttttgataactgaaggacctgaaaagccacagcacccaccttggattgtcatttgtgcaaactataagtcttgcattcaacttcaaacagtcgacaagtcattctcagacctgtccctttcagaggacatctctgtcactgggcagattgaagggatagtaaagaggattcaaaagcactgagccttgttttccagtaagaaactgacatgacagtaagctagttcactgtgtacaccatcatgacccaatctgcgtgtgggaattctgagctcttgagagaacatgaagagtgttttgggaggaaataagggtagtggaaggtcaaggagaaatagttctttgatagcagctcacacttcttaatgaaagctgcctgctacaggacttgtggagagctgctatgtgacagagagagacacgtaagggagaggaggaggaccaacatttgcgaaggccctctgtgggctgggaattaacatgcgtatctcatttagtcttcgtaataacccacatgctaaaaaaagtccatttgtattttagacagttcagttttaccttcagtttcctgtaccacataatttgtccagaatcatagatctagtaaatgggacccaggtctatctggctccaaatactctttcatgtatacaatgctgctaggccctgggaggaggcagagtgtcagaattactcccatcttactagtggatatggtgaattcacactggctttctttctgttggtggatcagaccaagctctttagggccgttgcacttagtgttctctttgcctggaacactctcacaagcgagtctttgtgaggctgacttttcctgccatttctgtgtcagttctaatgaattctatcccgagtttcctgactacctagaaagaaggaacttccccactcactctcatcgcgtcactgcttcattgtcctcttggcacttatcagctgaaatttctgtgcattgtttatgcctttgatcactcatttattgttctatttttttaattagaatgaacatttctctttttttctctttttagaatgaacatttcttaagagcaggaagcttttttttttttttaatgcctgttgtatacttgatccttagagcaattcatggtaattactaggcacttagtatgtactggatattttaatagaatgggtaaatcttgttctcaccagtaaaaacaaaacactttcaatttttaaaaattttgtctatagcactgtgggactgaccgatagtaatttttgagcaaaacgagctcaccaaattccatatgggtgatgtcatgttatgtacaaaaataatttgagatagaataggggccgggcatagtggctcatgcctgagatcccaccactttgagagacctaggagggatgatcatttgaagccaggagttagagaccagcctgggcaacacagcaaaatcccaccccttaaagacaagatataagatagactatgatataacattttatttaataaagtctaaacctcaaagtgatagtcaaaagctgcagtgaacagaaaggaaaggaagaaaccactgcaggctctttacatcagggaatagtgtattcatttattaatattaatttagtgttggacactgtaaagcagtggttctcaaacttggaaccaccttgaggacctaaaaagtgctcttatgactgggttccacctcagagtatctgatttaattgttctgtggagtgacctgggctttgggatatttaaagtctcccaagatcactctactgtgcagacaggtttgaggaccactgttctggggatagagcaccagccattgtggttgtcagagtctgatgcaagtgacagattcagcaattacggtatagggctggaagttatgtcttgtgataaccatgactgtaggttactatggaagcacaaagtagatgctccccaaccgaggtcctcccatcacctcccagagcctaggctgagctgcaaaggatagagagacaaaaaaggaaggccattgagggcagaaatagagagaattcaattggcagggagcaaaggtgagccagagagaacttttgcatctttggtgcatgaagtagcaagtaaaaggaagaaaaaagccaggtctggacaagtactctttgactcaggacataaactctgtcttaagagatgaatagaacatgaataggctcagagaaaaggaagttaatcttggagaaaacaagagttataacaggtttagaaactatctggtgtaatcagctaattttatagatgtcttaactagggtgcagaacagttattcaacctgtcccaaccaaccaaccaaaccacgtaaggacagaacctcgactgcaatgtaggcttggcgatttacaggcaagttttcaagcactgcagtgcagtcataggggaaaggcatgaatggaagcaaaaagagtgtagtgtgcttgaaagagtcacaatactggtcttacaagaaagtaaaatagatatcaactaaatgaagacatgtcatttttctcgttatatgacctcaatgaagtgcctgggtatgcaatcacccatacctgagtcttggttcaaaagatgctcttctttttaagttgaggaaggcatgtgaggggtctctgttggatctatttttttgatgttgtttgaggataaattttggtgtaagaaaggtgctggtgttaacaatagtgccataataactgttcatctgtataacagatttggatcactcaggaggttcagtgtgttccctgccttggccatctccatcttactgacagcatttctgtatcttaaaagcatggaagcttttggtcttattgccatacacacacacacacacacacacacacaaacacacatgcacacacgcatacagatgcatacaatttgtggcctttgctttgaatgaaataagtgaacacccttactacctcctctaagtgtcttaacttcaatttattaggtacagactgaccctttaaatcacacttcatcagtgcgaaccctgaccaaaaacacaaggcttcctctccagctgctctgtggcacacacgtgtgcattttccttcctgcttagcatgcttgtgttcctgaaatattttggaggctttctcctttttctgtattttggtttcaccgacatcagcacacccaaggcagtggcgctgcaggagagactgctgtgcatgattggtgtgtctgcacagtcaacacaattattgcctatgtctgacttccaggacttttatcatcattggggagagattcacaagtaatagcaaatgtcgctgtggtcaaatggtaaattaggctttaagaggctacaaatgggaaaattatgaggtattttaagacacgagacgtacctgagggaactccttgccccatcccccaatcattcctaaactatcccatgcacccagtttttacaaccctcatcaagacctgaagtttccctaccactgcagcccacattgatctttcccttatatgaacatcagctgagttttatagtgtgtatcaaacaatttagcacttaacgctaattaaatgaggttaaataaaatcacttctgcagaagtgcctgctgtgaactgtacaagacagatgcatggaactattaccaccattaattagattaattggcttttgtatgttcatttttcctcctcagctctttagcaagcattctactggaggtttcataccagctaattcatgatggggagaaaggagatgctaaatagctgtggatttattaaagatgggattacgtggtgggccagattcatggctcgttatgcacagtggtcttatttcttcctgccaccattttctccttgaaaatttcccctcatctttgcaaagggaacaatgccagaaccctatccagctatatttagacagccagaaatgaaataactgtaacatgattgataaccttaagtccagggaaatgatattactaattaaatcgtgaaacattaggcaggctgtcaggcacagatatatttaaagtcataacagcccttgcttatttttaaagtgtttgcatattgaatgattctggtaaaattgtttctatttatcagaccaagtataaagtgctcatctccatggtatctgcaagcatagcagtcaatctaagataaatccaggcccaagagagcaatttctcctttatctcacattctctccttctctgtaacccttttatgaggttcactaaaatgagtttcattcaactttggaattagcacattccacactttacaatttctagaagcacaagcatgtgatgagctgagatagaaggaaaaggcacaagtcacagagcttcgatttactggatgcttattgtgtgccagatcccttagatctttgagttgctaatcttcctgtcccaattttacagatgcaaaaccaaaccacagaggtggtaaaagacacacacacacacacacacacacacacacacacccacaccttttcccagctaacagggagcagattgcttttggaactgagggctctttgacacccatgtcagtgccccttcaaggtctagtgataagaaaaaaaatatatgtatatatatatatatctcacattaagaagcagatgagtttttttcagtccaagatggccaaataggaacagctgcagtctacagctcccagcgtgagtgatgcagaagacgggtgatttctgcatttccaactgaggtaccgggttcatctcactggggcttgtcggacactgggtgcagcccatggagtagggtgaggcatcacctcacccaggaagtgcaaggggtcggggaattccctttcataaccaagggaaggcatgacagacagtacctggaaaatcaggacactcccaccctaatactgcacatttccaaaggtcttagcaaatggcacaccaggagattatatcccatgcctggctcggagggtcccacgcccacggagcctcactcattgctagcacagcagtctgagatcgaactgcaaaaaggtggcagcgaggctgggggaggggcgtccaccattgctgaggcttgagtaggtaaacaaagcagctggaaagcttgaactgggtggagtccaccgcagctcaaggaggcctgcctgcctctgtagactccacctctggggacagggcatagttgaacaaaaggcagcagaaacttcagcagacttaaacgtccctgtctgacagctttgaagagagtagtggttctcccaacatggagtttgagatatgagaacggacagaatgcctcctcaagtgggtccctgacccccgagtagcctaactgggagacacctcccagtaggggccgactgacacctcatatggccaggtgcccctctgagacgaagcttccagaaggacgatctgacagcaacatttgccattctgcaatatttgcggttctgcagcctccgctagtgatacccaggcaaatagtgtctggagtggacctccagcaaactccaacagacctgcagctgagggttctgactgttagaaggaaaactaacaaacagaaaggacatccacaccaaaatcccatctgtgtgtcaccatcatcaaagaccaaaggtagttaaaaccacaaagatggagagaaaccagagaagaaaagctgaaaatactaaaaatcagagcacctctcctcctccaaagtaatgcaactcttctccagcaacggaacaaagctggatggagaatgattttgacaagttgagagaaggaggcttcagacgattggtaataacaaacttctctgagctaaaggaaggtgttcgaacccactgcaaagaagctaaaatacttgaaaaaagattagatgaatggctaactaaaataaacagtgtagagaagaccttaaatgacctgatggagctgaaaatcatggcacgagaactatgtgacgcatgtgcaagcttcagtagatgatttgatcaagtggaagaaagggtatcagtgatggaagatcaaatgaatgaaatgaagtgaaaagagaagtttagagaaaaaaagagtaagaagaaatgaacaaagcctccaagaaatatgggactatgtgaaaagaccaaatctacgtctgattggtgtacctaaaagagacggggagaatggaaccaagttggaaaacactctgcagcatattatcctggagaacttccccaatctagcaaggcaggcctacgttcaaattcaggaaacagagagaatgccacagagatactcctcaagaagagcaactccaagacacataattgtcagattcaccaaagttgaaatgaaggaaaaaatcttaagggcagccagagagaaaggtcgggttacccacaaagggaagcccatcagactaacagcagatctctcagaagaaactctacaagccagaagagagtgggggccaatattcaacattcttaaagaaaagaattttcaacccagaatttcatatccagccaaactaagcttcacaagtggaggagaaataaaatcctttacagacaaacaaatgctgagagattatgtcaccaccaggcctgccctacaagagcttctgaaggaagcactaaacatagaaaggaacaaccagtatgagccactgcaaaaacatgccaaattgtaaagaccatcaatgctaggaagaaactgcatcaactaatgagcaaaacaaccagctaaatcaaaataacgggatcaaattcacacataacaatattaaccttacatgtaaatgggctaaatgcaccaattaaaagacacagactggcaaaatggataaagagtcaagacccatcagtgtgctgtattcaggagacccctctcacatgcagaggcacatgtaggctcaaaataaagggatggaggaagatctaccaagcaaatggagaacaaaaaaaagcaagggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagcccttagagacctacaaagagacttagactcccatgcaataacaatgggagacgttaacagcccactgtcaacattagacagatcaacgagacagaaagttaacaaggctatccaggaattgaactcagatctgcaccaagtggacctaatagacatctacagaactctccaccccaaatcaacagaatacacattcttctcagtaccacatcacacttattccaaaattgaccacatagttggaagtaaagcactcctcagtaaatgtaaaagaacagaaattataacaaactgtctctcagatcacagtgcaatgaaactagaactcaggattaagaaactcactcaaaaccgctcaactatatggaaactgaacaacattctcctgaatgactactgggtacataacaaaatgaaggcagaaacaaagatgttctttgaaacccgtgagaaaaaagacacaacataccagaatctctgggacacatttaaagcagtatgtagagggaaatttatagcactaaatgtccacaagggaaagcaggaaagatctaaaattgacaccctaacatcacaattaaaagaactgcagaagcaagagcaaacacattcaaaagctagcagaaggcaagaaataactaagatcagagcagaactgaaggagatagagacacaaaaaacccttcaaaaaaatcaatgaattcaggagctggttttttgaaaagatcaacaaaattgatagactgctagcaagactaataaagaagaaaagacagaagaatcaaatagacgcaataaaaaaatgataaaggggatatcaccactgatcccacagaagtacaaactaacgtcagagaagcacctctatgcaaataaactagaaaatctagaagaaatggataaattcctcgacacatacaccctcccaagactaaatcaggaagaagttgaatctctgaatagaccaataatgggctctgaaattgagccaataattaatagcttaccaaccaaaaaaaagtccaggacctgatggagtcacagccaaattctaccagaggtacaaagaggagctggtaccattccttctgaaactattccactcaatagaaaaagagggaatccttcttaactcattttatgaggccagcagcatcctgataccaaagcctggcagagacacaacaaaaaaagagaattttagtccaatatccctgatgaacatcaacgcaaaattccttaataaaatactggcaaaccgaatccagcagcacatcaaaaagcttatccaccatgatcaagttggcctcatccctgggatacaacgctggttcaacatacacaaatcaataaatgtaatccatcatataaacagaaccaaagacaaaaaccacatgattgtctcaatagatgcagaaaaggcctttgacaaaattcaacaatccttcatgctaaaaactctcaataaactaggtattgatgggacgtatctcaaaataataagagctatttatgacaaacccacagccaatatcatactgaatgggcaaaaactgggagcattccctttgaaaactggcacaagacagggatgccctctctcaccactcttattcaacatactgttggaagttctggccggagcaatctggaaggagaaagaaataaagggttttcaactaggaaaagaagcagtcaaattgtccctgtttgcagatgacatattgtatatttagaaatccctatcgtctcagcccaaaatctccttaagctgataagcaacttcagcaaagtctcaggatacaaaatcaatgtgcaaaaatcacaagcatttctatacaccaataacagacaaacagagagccatatcatgagtgaactcacattcacaattgcttcaaagagaataaaatacctaggaatccaacttacaagggatgtgaaggaccttttcaaggagaactacagaccactcctcaacaaagtaaaagaggacacaaacaaatggaagaacattccatgctcatggataggaagaatcaatatcatgaaaatggccatactgcccaaggtaatttatagatttaatgccatccccatcaagctactaatgaatttcttcacagaattggaaaaaactactttaaagttcatatggaaccaaaaaagagcctacattgccaagaaaatcctaagccaaaagaacaaagctggaggcatcacgctacctgacttcaagctatagtacaaggctacagtaaccaaaacagcatggtactggtaccaaaacagagatatagaccaatggaacacaacagagccctcagaaataataccacacacctacaaccatttgacctttgacaaatctgtcaaaactaagaaatggggaaaagattccctatttaataaatgttgctgggaaaactggctagccatatgtagaaagctgaaactggatcccttccttacaccttatacaaaaattaattcaagatggagtaaagacttaaatgtcagacctaaaaccataaaaaccctagaagaaaacctaggcaataccattcaggacataggcttgggcaaggtcttcatgactaaaacaccaaaagcaatggcagcaaaagccaaaattgacaaatgggatctaattaaactaaagagcttctgcacagcaaaagaaactaccatcagagtgaacaggcaacctacagaatgggagaaaatttttacaatctacccatctgacaaaggactagtatcaagaatctacaaagaacttcaacaaatttacaagaaaaaaatcaaacaatcccatcaaaaagtgggcaaaggatatgaacagacactaccccaaagaagacatttatgcagccaacagacacacgaaaaaatgctcatcatcactggccgtcagagaaatgcaaatcaaaaccacaatgagataccatctcataccagttagaatggccatcattaaaaagtcaggaaagaacaatgctggagaggatatggagaaataggaacacttttacactgttggtgggactgtaaactagttaaaccattgtggaagacagtgtggcgattcctcaaggatctagaactagaaataccatttgacccagccatcccattactgggtatatacccaaagaatgataaatcatgctactataaagacacatgcacacgtatgtttattgcggcactattcacaatagaaaagacttggaaccaacccaaatgtccatcaatgatatactggattaagaaaatgtgtcacgtatacaccatggaatactatgcagccataaaaaagggtgagttcatgtcctttgtagggacatggatgaagctggaaaccatcattctgagcaaactatcgcaagggcagaaaaccaaacactgcatattctcactcataggtgggaattgaacaatgagaatacttgaacacagggtggggaacatcacacactggagcctgtcatggggtatggggaggggagagggatagcactaggagataaacctaatgtaaatgacgagttgatgggtacagcacaccaatatggcacatgtatacatatgtaacaaacctgcacattgtgcacatgtaccctagaacttaaagtataataaaaataaataaataaataaaaaatacccatcagaacagaaaaaaaaagaaagaaagaaatggaagcaatgtacaacaaaatatttgcgtttaatacaactagatggtggttgcatcatacatttgtaccttgtgatgtatttaattcataataaaaagagataaagttataagcatattacttagaaaaaaaagtagatgaaggtgtaattcttctccagaggtagtcacacttgtgagtgaagttcttttaaagacagttctctaaagccagtgggatgaagagaactctatgggcttcgaggttaagcatatctttgccccacagccaggctgggctaagaactgtgtggccaagatcacataacttctctttcccaggcatcctcatccccttctgtaacatgcagcaatgatacccactttgctagtatttaagaagattaagtgggaataatttaaaaaaaaactacaagaagacaaagggcaaggaagaggggtgagtgtaggacttcctgacatttccagaattgcattcatgcaggggttttcttattctctgttaaagatggtattaaatatttcctagtgcacaaattttggcaaacataataggcacatcttgccccaacacaaggtattagattgagcacaataaaattgtgaggaaaggctggaaaatcatgttaaatagtattaagaaagccttaattgaggctccaaaatgattgctttaaaatctctttatcttggtttgttattttcctgacggatgttggagggaagggtgccttcagctgacctgtgttgcattctaaaaggctttctgttaggattgcaaatgagtaaacagatactgtccctaatcctgaaagcactgaagacatcatggtaaattacatgcacagaaggaaagaaggatcttttggcattaaatcccggtctgggatctcatcttcattctatatggattgtcaatttgccaaattcaaagcctcaagctattgtaattagactttgaaaatctctctctgatttccttttcaccattgacaaggatttgctactgaaaattacaaattgcaaatatattgtcagggcctgcaactggtcatatttcatttcactcttaagttccaagaaattacctttgttttagtgtttaatttagttggcttcaaagtactaactctgatatgagtgaacaggagaaggaatgagaaggaatcacagactcctatatcttggtggtcaggatccttcccaaacacagtgccctgttgccaaatctctgggcccaccgactcaggctcaattcccactgtgcttgttcagtcttttgcctgtatacctgccccctcctccatccaagctaaatcttgcaggtggaatgagtgccctttagcctattcatgggctgaccatacaacttttgagagtggaaaaaagaaaatgatcattcctgaaaaagtttcaaaaaatgaggcttggctgggccagacaggttgtctggtcaccccatctatgcaaagctatcttctttataggtgcagtccaggggtcctccatggaagtttcactggtggcgacagcatcctattagctcttccaacactaactgtgagccccaaactcatttttatatttaattatttcaaggcttatataattttttatcatactttgaatatatgccatactaggccaccaaccctaatcctaaccctaaactgtcatagagaatcttctcctttagtgctcggtaatgtactgtggtcagagcagacattcagacattgaatgaatatatacagaatatgcattcattaaaattatttgtatgcttttcctctcttttataattaagaaagaaagaaggtgatactgtaataatagtaccagccccagaagtataaagactctgagaagaatattcacataaatattatagtaatagccatttgtggagtttgatttttctgagaaatttaaacattagggcaatctagttagccagttttcattaatgtgaatagctgtgttttagttgatgtatccttcacctaagacttgggttattgtactgaccctgatgaaatagctatgcaatcttaagtgcattatttaaagctgatggagccccacttttctgatttataaattttagtgaagattatctctgccttagagccatactgtagtaatgcatttgaaaccatgccctcgttaagatcacacattctatatgcaaaaggcaccttgttgtttatcttgtgaagaaatgccatgagatgcttcccccaggatcattcagtcctgccaacaatcttatatcgtaagtattactaactgcatttgcagatgaggaaatggagaagggttaagtaaattgaccacattagtgactgccagatgtgggattcaatctcaagtttatctgactctccagtcaggaattggattgtatcattgtttcagcaaattcaatgatgtgctgataggtgactgatcgggggtaatagattaggaattaatctcaggattcatttagttctggcggctccatgcagattcaacccaaatgtgtttgcgtagtgcagctgcaagacattgatagtatttctccattgaggagagtggatggtttctatacaagagctaaataaaagattttataggaaaaaaagccccacaggcatgttataagcattcttctatttgtgtattttttcatcccactatggaagctttagaaagaaataggccccttctcttatgaacagctctttttagttgagtggggataaggacaatgtttcattttgctgtgtgtcttggcattgtgcctcaggcatgagcgtgcaatgggtgtgtgtgaagagtggatgaaaaccaagggcttcgtcctctcctggaaaaaccatcaaagagacctaaggagacatgtattaataataatctacagagacggtcctttgaatatgctcacactctcctgagataaaggatttcacaggcaggtcctgttctgctttggcaggaagaaaggagattattcaaaggccctgtaccgacagtgccattgggtttcataagggcccattttcagactacacttgagtggaaaggtctggagatctgagcagaacctatcgcttctccttgacagtttgctgagtataagaatacacaaggttcctcatagcgctcactggtgaatggtcattctcaccaaatccttttgttggcttcataaagtgcagagttaatggtctgtattattgtagtttgatatttaagtgagctgaactgtgctgaactattagagttaagattttcttgcacagataaatatttcctataaaatatggtattatggtggtttccattaatctggttgtattatgcttccaaatgagctatctgattttatcgttagaataattttgtgagacaacgaggatcaacttcatcccattttacagatcagcaatttagttaacaagtggtcattattgttcctgaggctatccaaatattcaagctatataagcatccaataattgtgatataatattactaacactaatataacaatattatcaatagctaatatttcatgaggactcactatgtgttaagcactcagctaagaatcatttcaattttctcacctgccaattggagatataattactgttctgtccactgcagggggtgtgtacagattagatgcagtaatgtgtgtttgagtaccttggcatgttcaatactgttcaatctatgtgtccatttctcagcttaccaactgtactaatgaattcttctctctagctcactgaactgcctactcctcgcacctctgtctaagctgcttttgtcatgcagctctattcacatttctctctttaattccttaaaagcaatactaataaccacaataataataggaataataattacagtgcatgtcttccattgtagaagcctgcctggtttacaaagatggcatgtaattgatcagcaaaatatccctgagaagaaaataggctagttatcataatgctcatttttcatttgaaaatgcaaaaaaggtagttgagattcagaaagactgacaattctaactcaacctggtgacaaagtgaaattcacactcagatatttccattccgctccatagctccttctgttttaagtgagtgtccctctcccttccaaggccctttggtccttaaaaaaaacaaaacaaaaaaaaaggtctatgagagtccctatagcttcttcaaagcttcttatatcaacaccttttgcaaagtgacttgccttccttggatgatctaagcttccgtacagtctgaaggagttctatggtgatcatctctagttctatttctctttaaagggcctggtcacacagttggggcaagggcatgtgtcattctttctataggaaatgctttccctctgcttatctggctggagttgtagaagattccacccacatgtctcctctcctgtgaagcctttgccaacacctctccacagagcactgctctctttgtgtctcttctgtatccagcactgactttctgtggagcaccagtagtgctttttttccctctgcagttggaacagatctgtgattatgtcagggatcagctatcagacccctgacatggtgacagatctgttctaactgcagactgtgtgactcctgacagctgagaccacaccttggtcatatttgtgtgtccatgtcctagcacagcaaatggcaaacaaaaaccccatagtgtatattttattgttttctacagtaaatttttgaatgaatgaataactttaacaaaacaacacctgcatctgttaaagggcagtgtgtctaccacttctgtgaagcagctgtggtctgatggaagttgaagtggctaaagtagcctcctctttttctgtgagtccttaattgctgttctttcctgcaacattatcagtgtaatgtgctaactcatcctacgtgtcacccaagcacattttgtagatgtgtgtgggacccaattctggtgtcactcatttgtaaaggccaaagttgaggtgttgtcaatgtctaaactccgtttgtcagtgagcttctcaggggttcgttccactggaccattagttgcctaatcctaccctcattttcttcctggagtaaaagaaaagaaaattacaagaacgatgaaactgtgtatattaaagggaaatagggctgacacaattgagaaatactcctccacactagttagcccttgaaaaagaaaaaaaaaaaatggtaaagccaaggcaagccatttatattaacacacctgggttccagacagaaactatggagtctattaattaaaattagtttggaaacaacattctattataagataatcttttcttcagaaagcttgctattagtaaattaacctcagccagtgttctggcacaatgaatgctctatctcataaaatccatattgtctgcttctagtcaataaaacacacaatctaataaaacccaattgtgcatggtcctggggcccagaaatcatgcagataattgaaatgaaagacacacaaatataaataattggctgcagtcaatagtcctaatgatctttcccacctagttttttacatgtacttggattccccatcttcgcagccaccatttcccaatattcttctgacctgtccattccccaagactctatcctcccagaagaaaggttacattgtagaatgattgctgaggtttatacttgaataaactaggcttcaaattgtgattttacctcttcctggctgtgtgacctgaattatattgccaggattttggtttctttatttgtgtaactgtataaaaatatctactatacagattgttgggagaattacattgaaatgaaagggataaggtatgcccatgtggctagcagagttccatattcattcccatttctttcctttacaagcagtgaggctcttaatagaatggcaagaagaacaagaagtaagaaagcctggagaacaagaagtaagaaagcctgaaagactcaaacactgtataatttttctctgaataagctaatgaacggccaaggttttcaccttttatgaagcgttatcatttgcaatatttctgagaactcatatctgctggagaacaggatatttccccagccagctcccactgagggccaggcgtgtttccagaaagcaacatgacattgcaatcagttttccaccaaagccagacacaggcaagcaaagggaccttgggctggcccgtacttctttggacctcagtcattccacctctataaggaagatgtaagcttgttttctttatttcctctgcgtttctgttatacatgtctgccctggattagtaagaatgggcttcaagaaagactaggaaaaaaaaattagaaaaggaacaggcaactcaagtgctcataagaagaacttacattaatcaaacaagtgtctgtatccctctgacactgcaaatactctgcctccccttgtggagtctataagcttgtctcatcctctagctatttccactcctattcctttctccacagaaactatacaccagtgtctacacatccctgtcaaatatttctcaccaccaaaaatctaggtgtgaagatccaggcttcgtttgttcatttggggttttgtgttttgtgtgtgtgtatttacacaaactgtgatacttgccagtgtcttttaattcatggtgctgccatataaactgcgtttattcctttctgtcctccaagctaggacaatcacaatctccttcacgaagacttattgatggcctgcttttttcatcatgccattatctgaactcctgtacaatggagtcttgtggtggcgttgaaccttaaatctaggtgaactgtctaacagcagatgaggaatgttgaagttgtgccatgcagctaatctacggcatgtggttttcatacttaaaggctgtgatgtccaatttccaattaaatagagacacctattttttccctgagaatgtaatcttgtcttgtaatcacctgaccctctcaaggatatagtctatgtcttttccaatgtataaatccccagagctgtaagtgaatcagagaaagcttgagaaatggcttcatgctttcatattttgagctttctcactgctgcagccatagggtaacaaatatgagaagaataactaacaatagaggggagaagtgaaacagctacagaacttacagactttcaagggggttatgctccaattggcccatcgtaagttaaaaaaatcatagattgaaacacactttgtatactttacctactcaacatcaaagcttaacctagtccaccttaaatgggatcagtttgacacttattatacattagcctacagttgggcaaaatcatctagcacaaagcctattttataataaaatattgagcatctcatgtaatttacagaatacagtactgagagtgaaaaacagaatgtttgttcaggtacttgacgtacagtttctactgaatgtgtttcaccttagagttactgtgaaagtcaaaaatcataaatagaaccatcataagtcagggactgtctgtagagttaacaagactagggaacgtgtaagcaaaatcaagtttatactgaaactggatggctgaaagcaatgcacctcttttctgcacattgcttagactgtcacctcctcttggaagtggcccttcatcagaaaagctctggtgagtgaaagcaacatgctcccccttcacaatgctcttttgtcattgtatatgcagtcttgtctttttgggatgtcctgtcacaattcctttggagttttagacagaacaacctctaagaagtgtgacctctctaacctaggctggaggagaaattcctcccctgagttctcctgcctcacactctttccttcagcatgacttatattgtgctgagttctgtgctcatgcctgtcttctcctccagcctatgagctcctcaagggctagatgaccctttctatcaccacctcgtactgcctagaacatggtctgactggctactggcctgctgtccgtgtgttaacatagggtgtgtgagggagtcaatttgtgaatgaatgaatgaatatatgaaaaaaaaataaagctgcctttgacacttttataatgtctcttttcctctgtagtttttttttcaaatttgttctccatgttaatccaaactttatttgcatataaatgaaaaaggaggaaatacaaggaaaaaaatcctcaattttgtctggatccacataggacttggtgtagagaaaacttcagtgaagtcttttgactttgaattctaaaataaactatgagcccatttacccagatttaatagcttaaaaccactgcagcatagagaagttcaattttagagattttttttcagtcacaaatacacatgtatttaacacacaaaaaaaattctactttgggcgctttaggggaataaaaattgaaattaaaaccagtctaatactaaggggcttacattctggtgaggagtatgtgacacatagatatatcaatgctgttgcgaggtgcagaaactgtgtcaggaatctggagagaaaatggtggacttgtacttgccattgaagagataccaagatgtgaacatgtggagaagtcggtggtcgctgtggagagatagtagcatgcagagggccatgagcctagagactaacattgtttggctgaagtcaacagcatcagaggaggttccaggttctaaattcagaagaaaagccaaggagatgccctgcacatgccttcattacccactatgattcatattcaggagcaactcaattttgtgggatttcgtagatttcagcagggagcataatcttaccaaaattagatttcctcaatgaaaaaatggagaactgaaaaatgttacctcaaagagaaagttagagatgatcctttaccgatgaggaagtgtgggcaaaagcctggcagttgaggccgacctcctctccctcctctctgtcagcatctcactagtgtatgtgatgagactcaggtgaggccccagcactgatgagacactaagtgtacatgagctctctgtttcttgtcacatggcctcccctatacagcaacaacaagcaaatgagaaaagagggcaggcataagccaaagtccacctgctcttaaacacattcgtaccatgatttcctaaggaactgttatcaatatcctgttttcattcagggactttgacaatactgtctgagggagccttgtactcttaatggagcagcatgcagagaagttagatttcatgcctcattacaaatattaagagatggactttcagtgatatgtatgtatgccttttcatgaagaccttaaagtttgtttgtttatttttttcacctgagagtttctctacacttcattactctataactgtaccaccatacattgggcttcaactgttctagcatggccagagcatctggagctggagagaagctgtattctgcatgcaaagccaaattggagaattggtccccgagtttgagagaaaatctatttaatttgattattgacagaaaaataaatggctctattatttgtctagaatctccgaaatacggcatgtaagaacctacatgatctgaattccaggagttccagctgatccttcccctacaaacacacacacacaccacatatcatatatatatatcagccctctagatttacttataattctagaagaagccatgtcctgcccatcagtagcagcctttgcataataaacgtttcctctctagaacactcttggcctaactattattagcccttcagtactctactagggtgctatatattgagtcctgagtctacaggaggttcccttccaccacatccctgcagctgttcaatcttcttttcatcctggaaatgaacctgtgggaattatccattgttttattttgttggagtttttttttcccccataagactatgagccactcgaaaacaaaggtcaagctttctaatctttgatcaataaatctaaatatattcctaacaaaataaatggtgtaaaatgaagtatttaatataaaatcctcttatttctaccccaacacacacacacacacacacacacacacacaatgctgtttcaagagacaaaaaagctctcaagatgttatctgatcaccttcataccattgaataaagaattgttcccatttgaaaaatactaaagacaagagaagttcaatgacgctccctaaagcaagtccggccccttgaaaagcaggagagtagttcgcaccatgatctgccctctcttggtgtagacttctcccagttccccttcacctggtagtttacttcagaggaggaacaagagagtctcgggaaagaggactctcagaagcaggatacttgccacgtgaggcaggtgcctgtttctcctgtgcagtggtctccagagaccggcgaaggagactctgatctgtaattatatccttccttcggtctctcattagtgcacactgttgctgaatacagataagcctgtatttgagaattctgtgcccgatcattgttattaattatagggaagatttgatattttaaaatatatttgaggaaggagccaagatggccgaataggaacagctccggtctacagctcccagcgtgagcgacgcagaagacgggtgatttctgcatttccatctgaggtaccgggttcatcgcactagggagtgccagacagtgggcgcaggccagtgtgtgcgcgcaccgtgcacgagccgaagcagggcgaggcattgcctcactcgggaagcgcaaggggtcagggagttccctttccgagtcaaagaaaggggtgacagacgcacctggaaaatcgggtcactcccacccgaatattgcgcttttcagaccggcttaaaaaacggcgcaccacgagactatatcccacacctggctcagagggtcctacacccacggaatctcgctgattgctagcacagcagtctgagatcaaactgcaaggcggcaacgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagtcaaacaaaaaaacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacctatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaacccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcaagccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaatagactttaaaccaacaaagatcaaaagagacaaagaaggccattacataatggtaaagggatcaattcaacaagaggcgctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatctaaagaacagaaattataacaaactatctctcagaccacagtgcaatcaaactagaactcaggattaagaatctcactcaaagccgctcaactacatggaaactgaacaacctgctcctgaatgactactggatacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaaatcaataaatccaggagctggttttttgaaaggatcaacaaaattgatagaccgctagcaagactaataaagcaaaaaagagagaagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccatcatataaacagagccaaagacaaaaaccacatgattatctcaatagatgcagaaaaagcctttgacaaaattcaacaacccttcatgctacaaactctcaataaattaggtattgatgggacgtatttcaaaataataagagctatctatgacaaacccacagccaatatcatactgaatgggcaaaaactggaagcattccctttgaaaactggcacaagacagggatgtcctctctcactgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcatctcagcccaaaatctccttaagctgataagcaacttcagcaaagtctcaggatacaaaatcaatgtacaaaaatcacaaacattcttatacaacaacaacagacaaacagagagccaaatcatgagtgaactcccattcacaattgctttaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacacgttatacaaaaatcaattcaagatggattaaagatttaaatgttagacctaaaaccataaaaaccctagaagaaaacctaggcattaccattcaggacataggcgtgggcaaggacttcatgtccaaaacaccaaaagcaatggcagcaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccattccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatcacacgttagtgggtgcagtgcaccagcatggcacatgtatacatatgtaactaacctgcacaatgtgcacatgtaccctaaaacttaaagtataataaaaaaaaaaaaaacattaaaaaaaaaaaaaaaagaagaaaaaaaaaaaaaataaaatatatttaatgggatttggagctttgaagttcatgggaaggattgaaatgtgatacatgttgatagtgactgtaaatgatacacagctaatgaaaatttccattgctggggtgttgaattaatagcacttggcatttgtacagcaatttttattttaaaaagcattttgtgagcaatattttgtcttattctcagaagagcccacttaaagcagataggacaaaggtcaccatacctgctaacaaagagaaagggagatggaggcacagagaggagcaggcaggtgtttgaggccaggagctggcggcagtcgtcctgacactgggcaggtgtctttaccaccggaagctgccacctcagctcagacccgagctgttaaatgcctagatgcctaactgtgccaaaagccactcatgctgctaaacttagttcccaaaacaaaacatacacaaacacaaaaccctcccttcccaaatttcctgagaggggtaggacacaggaatatgagaaaattttcaaatcatattaaatttctttcagtgctaagaaccttgacactctggacctttcacctgtgattttcacttctgggaatctatcctaaataaagagagagaaatgttcacagattttttttttttgaataaggatgctcatctcagaattatgaaagtaaacatttgaaaatgaaccagttcttcaacatcagaatacttaaataatttatattatatgtggggatcttatgaagctgttaaaatttctacttccaaagaatatttaacaaggtaggaaattcctgtgacttaaccttaagtaaataaagagtagataagaaattaaagttatgtcaaattattaatagtagttatgtttattatttttattctatctctttgttgttttagtttaaaagtttcacaataaacattatttgagtaacagaaaggaagacattttaagttttatttgtaaaagtgatattctaaattaatgtattatctcattaaatgtggtttcctcagcttctcttatggccagacactcttcttaggagccaaatatgccagtctcttcccttggggagctcacatttgagtgtggatgttggctggggttggggggagacaaaacagaaaataaacaataaacatacaaagtacatgacatagcatttataacaagtactctatgatgctttctcgaagtaatccaaagatgatacaaaaaggggaaaaatgtgcaggatacagagcttggagaaagacggagagttgccatttgaaggagatgatgaaagttgggcttttgaggagtgtagcatttgaataaagtcttgaaggagatgagagcctcagccagaacataacttcttctttaatactttgggcaaggtttgttttcagttttttttcaaaattcagagaagtaattcaatgcatgtactatatatcagctaacacactatatattagctaacacacagtgggatttgagacagtgcccttaagcaaacacattaatatttctgcagggaaacatgaatattcatacaaagcggaataaagagagtattagcccacctgagttctggctagggttctccaccaaatgaattttgggaaaaacatatttgattacacatctttatggatttcaggaagagagataaagagttgtaaaattgtaagacacacagaggttgagtgaagtgatgcaatcagaaataacatttcatatttattgctgttagcatttacacattttgctccagatgtccttctgacagcgctacagctctggagtgggtttgaaacagctccattgaggggatggaacggctctaactagctctgttgggagcctcctgtcaccaagaggcaagtggcctgggcggcttctctcagagggaactcctgcagggcatagaggcttgggctcgggcacccttcagtgttcctcttctccaagataatgcacgtccttaaattcatcaatgcatctaggtggatatcttcaacagtgacttttccaaagggagagtagtgaggcagaaatgtttctgagatgccgaataaagccggccgttagcctttgcgaacacgatgctgattcatgtgggaggtttaataaatctgtgcagaaggaatgtttggttgatggccacgctggctgcgggcactttcactcacactgcccatgccttgcctcacaccaaggtttcacaggataactgtctcaggttgtcaaggcttataagctactttattatatttttatttagtttttaactaaattactttggtgaacataatttctaaaatttacaggacatctcatgattgaaaatattctcactaccgcgtgaacccaggaggcagagcttgcagtgagccaagattgcgccactgcattccagcctgggcaacagagcgagaccccctctaaaaaaaaaaagaaagaaaaaaaagaaaatattctcatttagttttggtttccacattccaaaaactaattgagaaaacattttactatggaaatgcagattgtcatgagccagggactagtggtggttttgtttcctgccgtatcgtcatgtttctaaactctgcctataacaaagcaggcataatgcatctatggagagagaggtatatatatatataatatatacatattatatatatacatattatatataatatgtatatatataatatatgttagggcctattcagtacattcaagtaattcagtacattcaaggaaactattgataatgctcatttatctcatatatatatatccactaatgcatattatatgagatatatatatgcactattgcatatatatcaaactattgataatgctcttttatctcatatatatgcacatattgtatatatatttgcgtgtgcacatatgtgtgtatacatatatgtgtgtatacatgtgtgtatataaacacacaaatatacacacagacactatgcatctatagagagagaggtgtatatatatacacacacacatatatgtatgtatatatacacatgtatacacacatatatgtatgtatatatacacatatataggcacacacactcaaatatatatacatgtatgtgcatatataagatgagtgaatgagcattatcaatagttttccttgaatgtactgaattcctacaaaatgatcagcagctgttctttttcagttgtattccaggttaatcacatatgttacctgtttccttgcaatgcttcaaggctgtgggtgtttcgttaagttcttcttcacttccaaccatccagatctgctccagttagtctgttcatagccctcactctactctcattatccttccagtcattacattttgggtccctatatcttatatttaattttgataaatgagtaaagagaggaagtggcctgttcagacattaaatcttggtgcatattattacaaaaaaaggatcactagatcaagaggaaggaacatgcatttgctagcataccatgtgttccaagatggcgtcaattgcaaaaaaaaaaaaaaaaaaaaaaactcaggaaaactcaacttcattctgagatcagttgaaatgggggctaatatcacaaacacactggctttacagttgcattatctgtattcagagctctctgagatgtgcaaccagggcaaataacacaattttctgcattacttctctttagctaagaaattttcttcaaacagaagggaaaagaaaaagacagactaaactcttttgtaaaggctatcaccaggtctgagagcagtagtggagtgagcagcgccaatccgagtgagaatagcaacagtcaggctgctgctgcttcttcctctcctatggccctgactataaaaataaaactcctcccatttttacagggccagcaaacactgaacagctcgcagctggccgggccaactgtgtgtcttctgttgccgccaaaacaatccccttggcatccgtgaacagtgcagaagcaggttcttcaccctctcagaccattcctgatggagatgaggagattctggcttttcaccttctggccaacactgctgctttttgttaacatctatcctggtggttagaacctagatctctgtctcttgtaccctctctgctttactcaaaaaaatctggaacaatggtgaagtgggaaagcccttaattctgtactctttaaaaactactgtggaaagtaaagggatgaaatcctaatcagaatttttttttctacaagagcgtgtggatttatttccgattaaaaaaggaacagcaccagaaagtattcatttgctgttatatcaaaacatttagatttgtttgccctactatatttaaattagtgtgttaagtaactgagaattgaaatgcagcaacatatagttccaaacatgcccaaggtgtatatcccagcctctgtttatcgattttgtgcattcattgactaacttacctcatggaggttgtagttacaaccccaaatctaggctggtaacttataaactggctatagatatggattatgggaacagataatttagagatattggataatggattcttagtcagtttcagctgctataacaaaaataccatagacttgtgtggcttaaaaaacagacattaacttctcacaattctggaggctggaagtccatgatgagggtaccagcagattcaatgtctagtgaggacccatttcctggtttgcagatgactgtcttctccttgtaccctcacatggtggggagagagaaagaaagagaaaaagaaaaagaaagagaaagagagaaaaagagaacaagctgtctcttgtctcttcttatcaggatactaatttcttcatgagaggtctaccctggtgacctaatcacctcctaaaggtcccatctttacataccatcacattgggaattaaggcttcaatatgtgcatttgtggggggcacaaacatttagtccgtagtatggatattagagattgttactcagccccctgtcccttctgaagagtagcgtgtgcttttggcatatccaagtaaatgcagtcattttttaaaatgcctatttaacacctactacatatctatgggtcaagctcagtgctagagatacatatgtgaataacagggacacggtatgctggaagtgtctgctaggggtagcaggaagttctaagcagaagacctaacacggtctaggatttgacttcccaacttagaccccagagtggggcagagaaaggaggtgcacgtgtccaatgagtacaagggagaaacagtccatgatatggggtgaattgggccggagctcccagtgggaaccttgtggccagtgtcagcaatttaggctgaatcctaagaacaatgccaagccctgagaggtttctaaacagaggagagagatgaacgcattggtcccctcttttccgctaggttcattttgcactgccagatctccacagtgactctcccttctctacgcttcctcatgagcttgctttcaggacttggtaagtgctgctgactttgtcaagagcacttggaagtcggatgaaccaggtttaaaaatcagctctgccacttaccagttgtgtgattttagacattgtgttaccgagatgttcttcctcatttgtacctcctagtgggttactaattaaatctctgtttcagcacttaaaaaatgttcttctctgttgtctttgtcatatgaatttcaattaaatgtcttaactcactggcctaaggcccttaagaatatgtatgtaccacgtctgacagataacgcaggacctagctctatggagttgtctcgtgtaaagataattcacccctgtctccctagcctagataatccctgtttatccttcttcccaggtgaacaaggatctcagacccaggaatcaataacaactactattagtttagcccggacatacactgcatgtgattataccaaatgtacatgtgtcctcaggcatataaccaagaactaattatctcgtgactgccaggcactgttacttaaggaaattacaacttcttaaggggtggctgagaggataagtgagaataggaaaataagtttataggacacccactgaaatacattaacacgcacttgccatatggtgactcattaaattaaacttgactgaaactatgggaagtggatggtggcaaatgcatttttttagaaaagaaagtgcagtctgagagaggtaaagcaacttgctgactgcgctctacctcaggtaagccagcgcacatacaggagaagggtaaaacagggcttgtctgactttcctgtctaagtaccttacctgaggattcccccaagaagtgaagcaacacaaaaactgatatgatttaactattattgactaaatgcatactatatgctaggcaccattctaagtgcattatatccacgtcccattgaatttcttatatggtagattgtactatcatccggattttgcaaatgagaaaactgagattcaagcaggttatgcaagtagcccaaagcctgtgaacaaatacgtggcagagctggagtcgcagatctcccttttgctcattcctttgttcttaagtattcctcttacgcaccagaatggaatcattatatatgctgtatgaaattaaaattgatatatttttcagggttgagatcagttaataaggactggaggaggttttgtggagggagagagcatgtggagggacatgggctgagagctggagagaattcagaaggtagagaggaatgaggagggcattccaagcaaggcgatgtcacagccagtgtgttggagaggaacatgacagattggagggaccacggacagaacagacaagcaagcatctaaatttcaattctgaaggaaatagccagtgattctgtcttattatagcatatacttctccgcttggcaatcataattctcctctagtttcctattaaaagaaagttgtaactgggagacaggcaaatgaaaatcatcctcattcatcaatgttggtttctatagaaactactggtgcggctccatacagaatcctggaatcaaggtcagctagaccatccctagggttagttctgctttgaatattccaggagtgattaaccaacctaaaactacccttaggccaaggctgaaatttgaggtcaggattgctaaagtagatttataaaaacttaacccttcatagcataatgacatgatttaaataattcacatcactcactgattttctgaagataggagaaaggatagtgaaattcattaaaaagatggaaacaaactgaaaattaggaaaagaattagaaagcaaacatgaagtggggcacacacagtaaatgatgcttaataaatatttaaaataatagtctccaatagcaagaggtctagagtgtggcccctggcatccaaccttgctgggttcagatgctgactaggctgccggagaagtgaatacagtaggtcaatgtcttagtcagctcaggctgctatgaaaaatactagaggctgggtggcttcagcagcagatatttatgtctcatagttctggaggatggatgtccaatatcaagatactggcagattctgtgtctggtgaggagggcctgcttctcggttcatagacagtcatcacctctctatacctttacatgaagatgaggcaagaaagccccccgggacttttttttttttttttttttttttgagacagagtcttgatctgtcacccaggctggagtacagtggtgtgatctcagctcactgcaacctcctcctcccaggttcacgctattctcctgcctcagcttcccaagtagctgagattacaggcgtatgccaccacaccccgctaatttttgtattttttagtagagacggagtttcactatatgttggccaggctagtctagaactcctgacctcagttgatccacccgcctcggcctccaaaagtgctgggattagaggtgtgagccactaagccgggccctggggctttttttcttttttttaataggacattaatcctatttctgagaaatctgcccgcatgacctaatcacatcccaaaggcttcatctccatatgccatcccagcggagattggctttcaacatatgaattttagggggcacaaacattcagttcataacaagtagatacatcagttatttaacctccaatgtcctcttctgaatagctagaatacaatcctccttagttacacgttctgttcttgtgggctttccttgtgaagtgggcccttttgagccagaaggagcctggttattctatgtctgagccagaatgagcctggttattctatgtctgctgagtttgtattcccctagagcagaccctaagacaggaattcaagtgcaaggggtttgattgggagataaacggaacagtagtaggtgccagagacaagaaaggaagaaagggcatggcaaaatgggtgctatgagctgatgggggtgaggagaggtggaatgagagccaattcactgggaaatgcgaagggccagtgtacaacacctcacaattacacctcccctcccccgaggtgcagaagttcacattgttcttgggtagagggatgcagccaaggagcaaaaattatcctgcactctgtcctgccacatgatggacaaagagacctccactggaaagagaaacttttccaatgaagaaaggtcagtgctgccttgagaagtccagtgtgctgaagtgccagaatggacaccattttctacccagctcagagcagatcaggcctccagtgtttgctccataaatacccatcaaataatgaccaatgggatgaatgcagcctcaagggatgaatgcagcctcaagcccaggggttcttctcctgggtttttcactataatcagatgaggaattttaaattgcctgatatctaggctccagtgcagaccagttaagtcagattatctgctgtggggtccaagcatcagaatttttaaaagctcaccaaatgattccactatgcagccaggactgaaaattcttgttcaactaacacatgaatcttttctacaaagtccttgacagatggccatgcaagcctctttttgaaactcttcatggggagggactctgctattctcagaagcaaaccattcccgtttttttttttttttttttttttgatggcactaattgttccaattttttttccttactgtgagccaaaacctgcttctgtaccttccatcagtcattcaagctctgcagtttggaaaaatgcaaaatgagtctattccattttgtacatgactgctctttagatattcaaagcctgcaataatgccctaacttgaccttcatttttatgctctaaacgttttcagttccttcagctactgctcttcaacctcctgtaatcattttcatttgccaataccacttttctcctgtggaattctcaactgaatccgtggtctgtgtctgcagttggaaatatacagggcagcaaatgttaaatgaatagcgtgtgtgtgtgtgtgcgcgcgtgtgtggtgtgtgtaaagtgtttaaagtgttatgagtgatcggctgacttaaagtaaacctgctttactaggaaaaaataggatttactaggaaaaaaataagatttcactctttctgttccatctcccaaaatttgttttcttaaacagcatttttctctcttggctaatttgtttgaacacctcagctcttgttttgcttttcagggaaatgtagatatatatttaacatgcataacttgtagaggagagggcgtagaaaaggtttatatttgaggttttttcacccatccgttttttaggagtgctgagccatggaattcatggcctgaaaaacaaaacaaaataaaaatcaataaatttgaaagaaagggagtactgcatctgtgatacttcagggaaagcaattcttaccttaatgaccaagtctattgcaaattctgggggcaagcagttgagcctcttctggacaagtgggatagagcaagcctttgctccactggagataatgtgcgtggccagccaccctcacctcgtataaaacagaagcccagttggccttgcaaagtgcatctaaaaaagggttcagggtgagggtagatttgtgccaattaatgtatcatgttgcagaaaacacagacaaatagagttgacaggtaatcttgatttcgtaaaagggttaaggctttgagaagctcatggtcgactctgaaagaatcttaaagagacagtttggaattccagcaagaccagtgtggagcagcaggagggagagtagagatgacctagggacaagaggaaagacttgaatcgcagggcagtcaatgttcctccagctccactgctgattatcacgctgatctgtggggagtaaaattccctttcaaagccttggcttatggatttgtgaaatgaagatgaatgatcatcatgatgtcaatgttcaaccacagaattgctgtaggaatagcatgagtgaattcctgtgccaggcctggatggcagaccctcaaaaatgtgaacattttgcctatttatttttgttttttttgatacagagtctctctctgttgcccaggctggattgcaatgctgtggtcttggctccctgcaacctccgctttccaggttcacgcgattctcctgtctcagcctcccaagtagctgggactacaaacatgcgccaccatacctggctaattttgtatttttagtagagacggggtttctccatgttggccaggctggtcacctcaccttaggtgatccacccacctcggcctcccaaagtgctgggattacaggcgtgagccaccgtgcccagcccattttgcctaatttttgagagttcacagagctggtagttcgggatcaaacttcagctccaccaatcaccaagtagcatgatctagtgaagtcactgattacctctgtgcctcagtttcctctgtaaaataaggaccataacattacctatcttgtagagttattattaagaccaaatcacctgatagttatggaaagcagatggagcagagcctgatacatagtttgttgcaaaaagagctagctagtaataaaggattctcccctaactgtgttccactagttctaaaacctttggggctctgtttattcaagtgtaaaatgaagaacgtggttaaagtctttgaggattcttaaccttattcttggtatcgcaggatttgcaggttgcaccgtgagtctggtcacatgtctgtctccctcacagccaccctcttcccctgggtagagagaccatgagtttttattttccagtgcctcgttggaaaacaaagactcagcatttgataaatgtttttgaagaaataaatggagtaattcatataaaaattcagtaacacctgttcttttggcattggtgtttggcttctctagtgctctatggagaagaagctgtgttaggctcttggagacaagaaactgaaaggcaaactttgacttttcggtttcctagttttcccaccttatgtttctttttcagtattccatctttatggttcctttactgaaatttcctcacttactttctatcttgtttttctgtagttaaaatttgaatataataattctttttagaagaaagaaggggtccatacaaaaagaaagaaaggaaattccacttctattaaatagtttggagtaagttatgtaacttctttgtgcttaatcattcataatctaaagggcatctataggaggtgcaattagtgaccattcaaaattcctttctgtcttccttcctgccaaaaccacaattttcttcaagaatttcccttcttccacccaactgtgtgctcatgaggagatcccaacctaaccttaacaccaaagtctaggacaatcatggaagtctaatatctctgccaagaactgcctctgacaagtttatatgacaaaattctagcaaagcgaaggatgttcttgccctaaaaggaggtgcttaagaataaacagctcattttattctattggacagccataactctgttcattttgcagctttgaaatgaagatgacatgctgcaaatggtcaagtggaaatatagagagaatgaagggtcttgttaacattggtgggtcactgaattaaacaatcctggagccactgaacctttccttgtttcctgagatgatgaattttcttttctggttaagccagtcaatttggccttttctattactgacaacccaaaaccctcccttggaaaacattatccatagcctagaatgattgaaggagttgatgagataatgtacaatgcctagtacaaccatccctctgtatccatgaaggattggttccaggaccacccacagataccaaaatctgtggatgctcaaattccttatataaaatggcatagtattttcatataacctacgcacatcttccccttttctttaaatcctatctgagtgacttatagtacctaatacttgcgtatgtcacttcagttgcttaaattcaacgtaatactaccatgtgtggccaattcacgttttgccttctggaaatttgtggattttttccccaaatattttcaatttgcaattggttgaatccacggatatagaacccatgaatgtggagggctgactctatttactttttgtgccagacaggttagcatgtccaacaaatgttgatacatttatgatagctttcttttcttgctatgagaggatattttatttgtttctgggttacctaatagttatgttcttgtcctcaaaatagattgttgcctttctaggcatcagattggtgcacttcctcttaccaagacatctcactagggtgaacatttggcatatctttccattaaacctcaagagcgcctggcaggtatgggacaggtgtgctaaaggtacaaggctggtggccagtggagtgcttcacaatagacagaaggaataataagatgccctcgacacccacaggaatcttacagttcaacttctagtctgtcttctttgattaagaatttcttaatggtcatttcaaaccctagggagagaggttatgtgaggtggctttgagagacatttatacttcaggggtttcaacatgcatagtcccttaacagaacaattgcctttattgttgacattgcatatatgacattgtgtgtctcttgggatataaaactcacttaatgtaaaaacatctaacatagttgttttggttgtttctttttattcagatttttttaaaaggtttaggtgatatctcagtttgtgagttgaagctttggaagtattcttgttcttaaaccggaatctgcaaactttttctgtaaagggctagatagtaaatatttctggctttgcaagccatatggtgtctgtcacaactgctcaactctgttgtaatatcaggaaagccatagacaatatgtaaatgaatgagagtgtggctgtgttccaataaaattttatttacaaaaataggtggcaggccagatttggcctgtgggtcatagcttgccagttcttgtttttaatcagtgaaaagatcaatttgaacactttgtcccagttgtcactaaccaactgtgtgaccatgttaagttatttaaccttactaggtcttagtttccttaatctggaaaacaaaagcactggacaaagtgacccctaggtttgcctctacagctaatatgtgaaattctgtgatttcagcatgactcttcaagggtatagctaaaaactaagtaaagatgaataagaaccttgtggtcttgttttgaatacactcaattctgaagtcactatggagtatcaacaaacagcatgtccagctgtattaaaaaatcaaaaattctatgaaattcataagaaaaattgttcatccaagttttaaaggactcgagggataaatgcatttgaagaaggagaataactaggagtactactacttattaagagtcttccaaagactaagcaatattcctgttttttacagatattgtttatccttacacatagcctatgacatagtgtattgtctgtgtacaccagaggaacagactctctcttattatacatgcaggagagaaattataagaaatcgattcacatgattatggaagtcccagtatctgcagtcactaagctggagactcaggagagcagatggtataattctagtctgagtctaaaggtatgagaaccaggaacaatgatagttaaagtttcagtcagatgtcaagtctgaaggtaggagaagaccaaggtcaggcaaagaaagagaatattatttcactcttttataagagtctgttctatttaggccttcagtggattgaataagacattcttgggctaatagagaataagactaatattcccatcatggaaataaagaaatacaaatctacagtggtggaaagaaatgggataacattaaggtgatcagatcaacagtcggagtccctccttctccccaacaataagctctttagtggtagaggcagaaattttaatcctcttctctccagtgttttctgtctttgccttttttttttttaaagttaagagcaatagaccatggcccataagcaataaactatacaaactgagcctgtaggtatacagaatagtggcataattaaataaaacttacaacagagttaatgtgacacacacctaatgatatacataatgcagttttgaagcacggtaattaggtataaaatggtaagctgttgacataaatggctgcaattagtattgcttctgcacaagcaaaccctgtgttaaattttacatttgtcacttggttggttctttgggatttataaataatcatcattgttgacagattttgtaactgaagagtgcaaaactatggaaattcatggccaaagagccatatttatttatttcattttatttgtttccttatattgtttgtttgtactatatcctgccagtttcacaaaggctttggggtcatctgcataaaccatctataatgcaattaaaaaatgcatatacaatgataaacaaaacagcaagatcagaggaaatatcaacgagaaaaggaagtatagataataaaggaggctaacagttaactttgcttcttgtagcaatggctagatgttgataacatctgtgaactgagtgcctaatacatcaatttatttcttattattttaacaaccccgaaaagtagatgtttcatttatattttatagatagggtgagatagatgaaagtatgttgactatgttcattcagccagcaaatgagtggagctgagacgaaaacttggtcttcatgactccaatgtcatagtgcactctactggatataaggagacttggagtgaggtgaggtgagggagatgatggggtttggatttggagaaaataaactttggcttcctagcacctaggaaacagagagaagagaagttggtagccttgcatggcccatgcaaacccaagcactaacaggaaccacatgacagctcctagaggctattagcagtcagcaagcacccagcatttatttaatgatttattgataggaggagatgtttcaaaatgtattaagtatgtgtttgtcaatacactgatatattacttactcatttgagtgtggacccactccttgctgtaaagagtcatctgtattttaaagaaaatgattttgaaagatgataatctctgtgctcattgcaaatgcagatcaaaaaaaagaaaaggacaaaaacaaatgatctctgccctagattaagagaggctaatggtttaatgttctaccacagaccctgaaaattaaaatatgagcatcattaaacagatcttgatgattaaaatttagaaagcttttcagaattcatctgtgaattcaatagaagattatggatgattggaaaatattttataggttcaatgatatttgagacatatttaatcatatcaagacttcaagagttgagaaaacaaagcaaacacaggaaaataataaaaggaaaaaagggtagcagatgcacaccatatgtgtggacatgattgtggcaaagctcattcaacttgaatcctgtgccactcactacctgaaagccttgggcaagctatttactcatctcttatgcatatttctctctgtaaaaatgccacaaggtaaagaataaataatgtagtgcgctttaagttcatgctgccaagcctggcacataataagtactcaataaatgttgggttttttttgttagtaattattgaatgaagtataggacactggagttagaccattattgcatatttaatttatgacagagattgtattgattatttataggtattacttcatttaaacttggtaaaaaaattatgaggcagatcttattatctttacagacagtaaatcaagacaaaaagaggttcagttactcatgtgatgccacaccaagtaaaggtggcagagctggactttacacccacacaaagtccaatgtagctggcttgccacctggttagttttttctcaagtcatccacagtatgcagataaaacccttatcattgatttgggaaagatgacttgggggttaaaataaaggaaacatgattccttctctttatttctgtcctacccccacatgtagtgtgaaatgaagagtgaaaagtagaaatcaagataagggtaagattaaaattttttaaactaggattttatctaaaattaagagaaaaacactaatttttgtctttttgaaaagtaagcttggaattatttagtttctatatgcctatgtgaatcaataactataataatcataataatggcaagcacatcatagaatgtatttcaaggcatgttttttatgcatgccaccatgatttctgctcctctctgcacctcctcatatccctaaacatcattaaccaagtagaaattccaaagacagacagagtcctttgaaagaaattttctctaaagtaaaagtcatcccttgaagttgacaaaaaaggggacctcaagtttctagtgacagtgtacttccaaaatattatgtaactggtacattcttgaaccctttctcctacgaccattaaagacttagaatcatggattcttaaatttgggaaccaactacagggcatatttaatctcatccatcctttcatttcgcaatggtggaaactgaagcctagaaatgagatcatgaggaactggaagtatcagatcaaagcaaatatatcccacccatcagtgtttgatatttgggccacaccacactgaccctccaccccaccaacattgcaatgaggaaggtgacatgctgcctccagccctggagaatagggctatagaaatacctaattcatttatatcaaattgtcatcataggagacccttagaaggaaagcctgtatctacctactgacagagagttttcatttactgcaaatgtcaagatgggattagcatgctttgaggagtcaggcatgggggtgtgaatctgatctacatgaagatgcttcaggacagaaatgctagctctcagggctcctcattttacatgaaattgaacaacaaaaaatgctaactaccttcctcccctaaaggtcaatacaagcaacactggctttgcttgaagtttccattttgaaagcaatgtggtttcctcccttaaatctgcactacaaaaaagttactaccttttgtgacagcccttaagattatatgcctcccccattctcaccttaataactctcctctttcatttcatttctttcaagttaaggaaaggagaaataaaataacatttactcttcttccatgaagaacaaatcttctctttcttttaacttcaattattgcttctgcatgcctctaagaaaaaaaaaagaattaaaacctctcttaacaacattcacaacttgatcattttcattctttgttccaaggtctatgactctgttcttcacttcacttacttagctggagtctatccaaaacattcattttcttacatctgtgtttatccctagtatttgttcttagtggatttcaaaacatgactgttctccttgtgtttctggctctgaaaacactaaaatgcatgccaaatgttagagaatgtacatgcacttttgaagtctttcagccattcattcaaagaggtgtgttcagtgcagacttagacactgttctaagcaacgctgccatgaacacgcaatactcctgccttcatggaacttacagtaagggatgcaggcagtaagaataataaatctgaataatttacagcaagtacatggagcggtgcagtgactggctatctcctcaaggcatgtgccattgattaagacacaacccccaaaactccccattgctttcacacccagcctgctcattcatagatagattataatataatttcagatagctgtaagtgacaaagagagaaataaacccagctaagtgcagagactctgttttatatgtatatatacttttctttcctcctgaaataatatctctttgaggaagtgacatttgaacagacacctaaataaggtgaaaaagtaaggttttggagaagaaaattctaagtggaggggaagtccatgacactaaaacacctttgatttattggacaatctgctagaacactaaagtgattggaaatacggaagagaaaggcagaaagggagaagagagaggccaaggacagattacacagggccacgtaaatcacataaggaaatgtggatttcattctaagcataatcataagacactggaggcttttgggtaggggtttaaatgaggccgtttcaatattcacctcacctaggtaactctgtagagggtagatctcagctggggaaggaaaaatcaggttttgtcttaagctactggatgggtggctggcaggactgggtagcatgtttgtgcagggaaatggggaacctgcagactttatgacacattgtggtggagcaggtagaacacaagccctggagccagccagagaagggcttgatcctcaggttgtaatctatctgggctgacttaatgtctgtgtacatgtggataaagagcttgatctcaactgtgaagtgtggacactgttgcctaccctgcagtggtgttaggagttatcaggtgatgatataaacagagtttctaacagggcagctaatgtgttcatagtcaaagccacagtcttttgagtcagaccaggatttgaatcccagcttaattagtcactttgcttggtagaggagtttgtgcagtaggtaaatctcagaggtcctttctcctcttctgcagaatttgtagaatgatatccatttcacacgattgttttgagaattaaaaccatgtgtggaagcacctaagacacaatggatgcaatttagtagctgccgcaaggttttgaactggttcccttaacctctctttgccacggtttctccttctgtgaaatggaaacgtctgatatgtttgtgaagatcaaataagaaaacatatgtgtagtgtttaccagaatgcctggcacgcactttatgttaaaaacaatgtagggtgatgtcatgaacatcaccagcaggacctttctctcacctcccctgctccaagcacatgaaacacatttcacatcaaagaccaagtttctgaatggcttgaggtgctcaggctgaagaatgcctgcaatcctctatctctgcttttaagtcaccaaacatggaggggtagcatattctagggtaaaagacattagacagaatctggagggatctgtccctgcctctacgattaaaaatcagaaattttccacataaaacccccagattgctgacttggctttggtagaaatctgaatgttttacaacaagtacatggagcggcgcagtgaccggctctctccacaaggcatgtgccattcatttagacacaacccccaaaactcctcattgctttcacacccagcccgctcattcatccttgttgcttaatgagtatgcagaggattgtgagtgtgaaatcgtggctgactctaagacagaatatcatctagacctggagactctccagacttccagatcccagaattcatgttttctggtagaaacatgaatactaataatgcagacaaaattcttgaaacagccaaatgttgggtctgtgatttgcctgctctggttcattagccatcgttcctatggcttcacatctgggagtctgtaaacaggccatgggctgaatgacacggactgttgttttgtttaaaacgaatggctgtaatcctgattaaagcatcatgtgggagattttataataataattatctgtagttcccattagagccagcaggaatctgaatcacatttaataatctaaagcttggaagtagtgacacttaagtacattgagatttaagtatagggattccaagaatgaggaagtgggtattgctgctctctagccttgattaagtctctaactgtcagatcagcttagactagttgatactaaaaccttctctggtagatcattcagctacttattgtcaattttctgttataccttgttctcttattgacttccacttttacttattcttaatggtggtggcagctctattattgtgccaataattcaagctaattaacagaaaccaccaaaagaaagatctctactatttccagttccttaggtttccttccatgcagtgatggccaccagagggaacaaatcagacaattaggctttatgattagaacatttatatgaacaaagactaacatgtcattggcagagattaggagtctgcagaatccaagaagtccccaagctacagactcaatcctttctctttgtcctttgataaaacttcctcaaatccatctccaagccttcccccaagatggagcccacaggattatatctaaggcctctgcccacagagtgaatgccaatgcaccccttccctttttttcttctttaatgaccttaactcttgtatatatgaatataaaacactcttcattcttctcatttttgtatatattttttgtcctgtcgtcttctctaacttctccaacttaacaaattctcttctgtaaactatgtctcagatatctctctctttcaaacaaaagactaataatccatactcagggacactttaactgttggtatttcttcccacctgaagactttacttttaagtgatgttctcatgtttgggaaaaccacacataattcattaaaacatgttgcttctgctcctcaacacaagttttaggggtgatctctatttaatgtattttcacatgtgactgtagccttaaaaccataagagattaataataaagtttcttttacactccagggtcagtttttacttggcaatattaactccacttatcaccaggagttgtcaagtaaaacaaaacaattttgtaaaagggttctcacttttctcaacactgcataaaaattcttgaaaaaaacacttttctcactgtgttttttgttttttaaagcaaaaaagcaaggtagcaggtttaatggggaaaaactgatttcactaccgtgtactctccctagtattctgaaaataattgtggggcaatggagaacagattgtctcttcacatctcttgttaggcagggaacctgtctagacagcaatcttaaggacagctgagctgcttcctgcagggtcatagctactctgcagtgtgagagggccagcccagtatgctttcaagagcccaggaaaggtcacatatacaaagaactaccttccccttcctgtgctgattcttcatgcctgaaatctgttgaagaaagacaagtaggatcccaagtggtgcaaggctgaggcaggaagccaaaccaaaataaagaaagggagggagtaccagaggagacagaaggaaatgtagggaggaagagaagaaagagagccaggaaggaggcacgtttttattccaatgcttttcagatttttctggatgtatgacccaggataagtcagttccttactataaaagaggaagaagggcacaagcctcatgaaactgttgtgaggattaaacaaggtcttgctataggaaacacatcaatgtattagttaacgtgataaatggtttccttcccctctcatgattacatttttcaactgtaaattattaattctatcagggaacagaaaactggcgctctgtgtttataagtccacactatagcatagatgggtatctctgatcatttcctaacaaattatcttaggaaggtgagcaagcaaggtaaagagtctgcccggacgttggactgttagagagcagaaggtaaagctttatcgtgctaatgcatatttttcaactttcagtattttcttagcatgggttttattagtttggcagtgatagtggcaagcataagctcaatgtcccttcacccaaatgactccatttgtcggacaaaaagttcttcatcttgtaaacattcagatggatgttaagaaagagttggagcaaacctgctccgatgtggttggaggaagaaaaaggtacgttacaaaatatccccttaatactttcaaatatctgcaagaatctcatttggggattagacctggcctcaacagaaagaagaacaaaacaggaaagcaaatggaattgtttagcaccatttatattttaagacattaacatatgtcatccgtgatctcagatcttctgtataaaaatatagagtaaaaaaaataaaattaccaatggctattaatgttattacatcattactatttattgaaatttttttctcaccaaaacaaagctaagcatttatatattaatacatactgtcaattgaggatttgacctatctgcgtggaactttggagttgatgtaaactttaaaaaaattcactccatctgaccatccctacctctgacatagcacacctgacagccatcatactccttagatggaatccaaagattctacctcttccttgaatcacgatgcccacttagaatcagtaggctagctatttctattcggagcactgcctccatgttttgtttcttgatgctgcttcttttttttttgttcaattcacaaacctgtcttctttcccactggactggatcttatccttcacagccctcatgcatacttagagaatagcatggggcaaaactgaagagaaccagagggctgctttttcttttcatatctcttgtggtggcattggggttcttattggcctgggttagggactggctcggggatgttggacatgaaggctttgatgatgctctgcgcagctatccactcactcaaaggacaaatggacaaaagcagaatctgattcatccattaaaaaaattgattttgaggatgatgaagaaacacaataaagaaaaaaggaaaaacggttccttctgaaagaaaactttagtatgggcaaagttcctgtaaaggctcttgagttatgaatagaaaccgcaaagacttgacatttattgtgaactttcaaggaatgctggacaaaatgtgattcatttttagaaaagtaataaatcgtaatgcaatggtgcacttccagcaaaacccactggaaaactccatttctaagattgaagaaccctatcctgttggatttataatgcttcaaaaatgaaaatatgatgcccaattattaattattattgtttgtttgtttaaggtacagaacaaagtgagggcatatttaaggctcttagactcagacttagcatgtgacttccctaacatgaagggagcagtgtgaaggcagtagcccctggttctaagagccagcatcatctgcatagagcaaaggtccaacaattgatcttatccttcagagccttactcttccacatgcataatgcgagggtagccttccaccaccccacatagatgtgtcttgtccttctcttcatgtgggaaaagaaaatgggtaaagaccaggagtagcctcagtatagactgcacctacagctaaaaccaaacagactcaactgtatatttagggaaatgggctatatattcatctccaggagagagaagaggcagcatgacttagaaaagcagggtaatcatctacaacaggaccactaaaggatgacacaggatctgaggacaagaactgaaagaataaagagaggcaggcagcatatggtgatagttatgaagaaatccactttcagacattatgtcttaaatatatatatatatgtttttgtttttgtttttcctgaaagggcattgggttgacttctgcttcagtcactgacataacctttgcttttctttctgagagttaccttgggagcagcccaatatggatttgacttgttcatttggcatgatttagtacctgagttagcttttcagaaatcttgccagtattagcattgtgtgcagatgcttctcagatgagtggcgtcttgggacatcagcagagatggtgctattaaatcacacagccagtgtcctctgccattctatgaaaggcaggcaagagtgccgcagcttcccgatgcctccagataaactacagggccttttaaggagtgccctgggtaagctaccacggtggtgaggtgcatttgggtaagtgtgatagagacagccaaggtggcggccatgggccacggtgagctgtgtcagcctttcccattgcatatggctgcctggctgcctctatggtgaaaggtaactgtgggtagtagaaaaatgattggtgaaaagagaacaggaataggaaaagggcagaaaatgcccaccgagacaggtaattggggaagaacaaatagacagagggagtggaaagaccgtgttcacagaccccatggcacatcccttctagctgtgtgaccttgcaccagttaccctggcttccatatctcttacgtaggaaacccaacaggctcttgtggctgtgttctgatccattagccatttgagaagcccctaacttcctttcccatcttctctaccctgccatgtaggttgattttattttttattcatttctaagttgctgagaactatagtaacaaccccatatggctgtcactcagatagaaagaaggttattgctttttcaaaacaggatagagttacagcagcgatataaaatgttggctttcatcgagtaatttcagatgtcctgttggctctcctgtcctctgcaaatgctctttctctgttcactggccggaagctgcttcgtgtccttcagcaaggtcagagaaaggagctgaagtatattttctgctagatattgaacacacaaattatggtaccccatttggccagccacaaaatgcccttgcctcgtttttgatcactggggtgccagcacaacagtatcaccacaaaccctcagcacgttgctaatttgagctgttctcttgatatgatggcagctcctggatgggcaccaagagtcataagaaggcagaggaatggtcagattggctatgtgagcagccatcaccagagtccttggggtcatcctgcgagctgaagtccttggcggccacattttgcaaattatttctgtctttaactcagactcttggctttctcctatctctggtgttgggaattgactatttcctcagagtcaaggtctatctactagagcaaagggcaaggtgtcctagccattctgggcattcagtaaaggccaagcttttttttgtacacagagtaaatacagacacacagctctctgaggaaaatggtccagaaaggatttctgtcagccaaatttggttatgttttaggttctttatcagcaaataggaatactatgactcccttcctcacttagatgtaagccagtctctttcggccagcttattagctcagaggctatcttcatttgtccttgtgtactcaaaggctggccataggacctactcatgaatgacaccaaaatgctgaatgatttaggaattaaggctttaacatttctatttacttttctctgtcagtatttaatgaaatgcagttttcatttcttttagactttcatagtttccatatccctcatgcctatatttaaaataaattatgtagagaaaggctgcatttttccttttgaaatagcagtgaaatttgtaggaattcttgagagtaccaagaaatatatccacatgaagatggatgtgataattaacttggtataagtcattgttaaataactactaaaatattttttatttttttaaataactactaaaatatatttgtctgattataaaagtgagacgtgctcagtttagaaatttctaaattccaaaaacttagaaaatatgaaacacttgtaattaaatcagtgagtaatattgacttttaatatttttgatatcatggtccttttctctttttctttctttcttttgagacatggcctcactctatcacccaggctagaatgcattggccgagtctgggctcactgccacctctgaccccggggatcaagggatccttctgcctcagccttcccagtagctgggtctgcaggcatgcaccatcatgcccagcatttttttagtatttttagtacagacaggatctcgccatgttgctcaagctgatctcgaacttctgagctctagcaatctgtccttcttgacctcccaaagtgccgggattacaggtgtgagccatggcacccggcagtatcatggtctttactttggtatgtttgtaaatgcttgctctctctctggctctctctctctctctgtgtgtgtgtgtgtgtgtgtgtacatgtgtatgtgtgtgtgcataaattgtttgcacagtaatatatacagggcacctcacttttttgcactctgctttatttcactttgaagatattatactttttaaaaattgaatgtttttggaaaccctgaaatgagcaatctattggcaccacctttccaatagcatgtgcttatttcttgttttcattacatattggtaattctcacacatttttcacacagttattattataactgttatggtgacctgtgaccagtgatctttaatgttagttatccttttccttgtttcagggcaccaaaagtgcacctctataagacagcaaacataagtgataagtgttgtgtgttatgactactccactgatgggccattcccctatctcactccctctccttgggcctccttattgcctgacacacaacaataaatattgaaaatagaacaactaataaccatgcaatagcctctcagtactcaagtgaaaggaagatttgcacctctctcactttaagtcaaagctagaaatgttcaagcttagcaagggagacaagacaaaagccaagacaagctgaggcctaggcctcttgtaccagttagctaagttctgagtgtgaagaaaaagttcctgaaggaaattaaaagtgctacctcagtgagcccacaaatgataagaatgcaaaacagcctcgaaaatgttagtagtctggacagatgatcaaaccaaccacagcattttcttaagcagtagccccatctagagaaaagccttaactcctttccattctgtaatggctgaaagaggagagaaagcttcagaagaaatatctgaaactagcacagctctgcttatgaggtttaaggaaagaaactgtctccataacatacaagtgcaaagtaaagcagtaagtgctaatgtagaatttgcagggaattatccagaagatctagatgacatcactgatgaaggtggctacactaaacagattttcaatgtagacaaaacagcctttcttttggaagagaatgtgatctaggactttcatagctagagaggagaagtcaatgcctattttcaaagcttcacagaacaggctctttctaggggttcatgcctctggtgtcttaacattgaaaccaatgctcatttaccattctgaaaattctagggcccttaagaagtatgctgatataatctacttgtgcctcataaatggaacaacaaaacctgaatggcagcacatctatctatagcatgatttcctgaatatgttgagcccactgttgagatttactgctcaggaaaaaaaaaaaaaaagattcatttcaaaatattactgctcattgacaatgcacctggttacccaagatctctgataaaaatgttcaaggaagttagtgtgttttcatgtctgctaacacaacatccattctgcagcccatggatcaagtagtaattttgactttcaagtcttattatttaaaaaatacgtgttgtaaggctatagctgccagttagtggttcttctgatggatctgggtagagtaaattgaaaactttctggagaggattcactattctagatgccactaataacatctgtgattcaaaaaggaggtaaaaatatcaacattaacaggagtttagaagaagttgattccaaccctgatggatgaatttgagagattcagcagagaaagtaactatagatgtggtggaaagagctagagaaatagaactaaaagtggaacctgaagatgtgactgaattgctgcaatttcatgatagactctaaagtgtgagacgttgctacttatggatgagcaaaaaaagtgattgcttgagatggcatccactcctggtgaagaggctgtgaacattgttgaaatgacagcaaagaatttagaatatgaatttgagaggatttactcaaattttgaaaaacgttctactttggataaaaggctatcaaagagcatcacatgctacagaaatatctttcatgaaaggaagagtcaatccatgtggcaaacttcattgttgtcctattttaagaaattgccacagccatcctaatcttcaacaaccaacaccctgatcagtcagcagccaacaacactgaggcaagaccctccaccagcaaaaacgttatgacttgctgaaggctcaggtgatcattagcattttttaacaataaaatatgtttaattaaagtaagtacattttttttagacataatgttatgcacacttaataaactatagtgcaaacaacttttatatgcactaggaaaccaaaaaatgtgtatgattatctttattgcaatatttgctttacttaaatggtctggaacaagacttgcaatatttctaagttatgtctgtatgggcatgtatacatcacacaagtgggatctacacatacatatgtatgtatagaagcttacatatatataatttagcaccctacttttgttcaacattaatttacattatgatctttcccttgtcattaaatgctccacaaaagtttgattgaattaattaatttatttttaatggcttttatactcttttattccttataatttttttgccaaataatatccgtatattctcctgtgatcttttttataatttcaacttttattttagattcatggggtacacgtacaagtttgttacatgggtatattgcacgatacttaggtttggggtacatatggttccatcacccgggtagtgagcatagtacccaataggtagtttttcagcccttgcccccacccaagtagtccccattctctattgttctcatctttatggacaccacacccaatgtttagcccccacttataagtgagaatacgcagtatttggttttctgttcccatgttaatttgcttaagatgatggcttccagctacatccatgttgctgcagaggacatggctttattcatttttatggctgcaaaatattccattgtgtatatgtaccacatttgtaacacattttctttatgcagtccacaactgatgggcacctaggttgatttcatgtctttgctattgtgaacagtgctacaatgaatatactagtgcctgtgtctttttggcagagcaatttgttctcatttgggtctatatgtggtaataggattactgggtcatgtgtgaattttcactcttataaattaaaatgtggaaacgaacacactagtttggtagtccttgtggctgaaaatactgagtccacaggagagctccaaagtttgctatgttctttgcttccccatttccaggatctttctcctcctttctaatgtcttccttgttctccatgtccctggtctaaagaagtgatggcacatgctgtgcgtgctccctagacttcagttcccttaaaacatggcaaatgaccattaagtaagaggagacaataccactatttcacatctcattctgggggaacatgaattaatttctatggatgaaataaagagaaggaaagccatttactgaacttgatgatgaaagattgtcaaagtaggaaactcagagctctgaagcagtcctccttctaagggtcttgtcacctttacatcaggaagcactcaattggatagtataggggccaagggaaaatttccccattgcctctgaaaggtagctgaaaatcactgtcagaaggcagattaataggaagaaaggcatacaaatttacttgattatagttttacatgacacaggagccttcagagtgaagagctgaaaatacaagagaaactccacttttgtgcttaggttcagtgaagtttggacagttctccaaactttgattggacaaatagagtatgatctaatgtttacagactgagagggaaaaacagacaagcattgtctgtctagcttcttctctgactctgagcagcattccttctttctgggcatggggcagaactttctctggaagggggatcttatgacctaaaatcagacaaagtagatcagataatgtctttgttattgctggttttttttttttttttttttacatggcgtttctctcttgttgcccagggcggagtgcaatggcatgatcttggcccactgcaacttctgcctcctgggttcaagcaattatcttgcctcagcctcccaaacagctggaacgacaggccatgcatcaccatgcctggctaatttttttttatttctagtagagatgaggtttcaccattttggccaggctactctcaaactcctgacctcaggtgatccgctcgccttggcctcccagattgatgggactataggtgtgaatcaccacaactggctcagataatgtctttatggccagtttttacacagaaaggcgggaggaaagttagagtaatatttttaggttttatggttggctttgggaaaaaggggttttagcttctgtggctagccccaggggagaatgaggggccagagacaggagggtcggagaaggtcagagaaaatcttttgtttctgagaccttcattttgggatatcatttttctgagctccaacaacgggcagacagctatttatttacttccaaaacaacttctgggttctctatcagaaagtgtgatgagaaaacagaagctattaggtagaacaggtctggactcaaatcctgactcttgtatctgaaacgttatatatctagatatgccatttcttccctttccatgtgtcctaatctgtcctaatctaaaaagtggcaaaaatcccctatttatgttggtggcttggagaaacagatacatgaatgtatgagcaatgctgggcatgttttagatatttttaatcaatgctcattctgtgtgtgcgcacgcacacaaagcacacacaaacacacttctcgcagaacctcatagcaaggagatatttggggtaaatgctgtaatgtacctacagagatagttttaacagctcttcctgctttctatatcaggtttttgtttgtttggttggttattttttgtttgttttgtttatggtttacttttttttttttttgaaacagagtttcgctctgttgcctaggctggagtgcagtggcatggtctcgtctcactgcaacctctgcctcctgggttcaagcaattctcctgcctcagtctctcaagtagctgggattacaggcacccacaaccacgcctagctaatttttgtatttttagtagagacagagttttactatgttggccaggctggtctcgaactcctgaccttacgtgatccacccgcctcggcctcccaaagtgctgggattacagacctgagccaccatgcccagccaatggtttacttttttattgtttgtgttcttcagcatcccttcttgtcaactcctgggttattgcacatactaagcaactatcttttctcagtgatgtatttctttcagttgaactcactgtacgtgtagaaattaacaccctcatttacccaggcatccgctaggctataaaatcaattcctttattattccttgctgtctaattcctctatcttttgaatagaagtgttgctttccactagaccttatccaagttcttaatattatcattcagtttctaggactacaagctaggctgagcactctaattatagtctaaccaacctgatcaaaatttgggaattaattggtagttcctacatgctgagatctcccatagtaatttcaatgtttttgtttaatgttttatttaatgctttgtttaatgctttagtctgcttttggaaaccactatttagcttgtgttccattaagactaccgagtcaactttgatctcagttcctcagaggtagtgctcattctccaccttggaactgaagtgtttttgttgtgatggtgatggtggcagttgaatttttggttttggactttttttaaagaacttctaagttcaccttttaagattttcacatttatcctgcttgaactctagatagtgtgctcattatcacagacttcatatagcctgtaaatagatagcaacagcaatagtttgaatatgaatacaatacttgtgaaaagctctctgatttttatttgttatttatttatttatttatttatttatttatttatttatttatttattttgtgtgtgtgtgagagacagagtcttgctctgtcacccaggctggagtgcattgcatttttagagctctttcaagaaaggctgtattgatattagtgtttcacccactcactcccattccataccccacccagcccgtgaccctggctttgcattctcatgtacctgcactcattctctaacttcagctgcttattattattattttttttaattttgatatggagtcttgctctgtggcccaggctggagtacagcagtagcgtgatctcagctccctgcaacttctgcctcccaggttcaagcaattctcctgccttagcctcctgagtagctgggattacaggcatgtgccaccatgcccggctaatttttgtattttttgtagagacgaggttttgccatgttggccaggctggtctcgaactcctgaccttaggtgatctgcccgccttgacctcttaaagtgctgggattacaggcgtgaagcatcatgcccggcctaacttcagttattggtactgaacacatcaattttgcttaggaaaaggtatgaaggctttctttgattttattctccttccttttttaaaaaatcacaaaacaacaaagttagagctttttcttagagtgattacattattgtatgatgctgcattctaccaaaccagagcaatcatcattcaagatgaaaatgcttcctttaattatatgaaatgtcagtctgcaagttgcacggcatggaaggggttgggttattccaaatcaccaaaagacaaatgtatttacaacttctattaaaatcctaaccctgtagctttaacaaaattaacaggatttcgatgcattcctggtaagtttgacttataaatttcaattcttggcccccatgccaaagcttgatgctgctcatctgcttctttctgctccccgaagatagagctatttcaggagacacgttttgtatttccatcaaaaccagggagagcttcattaaaaaataaacccatgattcttttccattttttttttctacctaggtaatttgggtaattccacagtgaatgaaagagatgaaaagatgtgatttaagacacattaaggatgtaaatatatacaaaaatttggcttcttgtctcttctccaacaattaatttcatgaaagtgttttctggtggcttacaaacaatgcatgaacatgcacaatggtctttgacaggatgtcaaagagcctgcatggctgagatgacttccatcacagaaaatcaatttcctgtaaatagtgaagaagcaaagattttaggccaacatcagatatgattctcgagaatctatttcctgcttgttttctggaagcgcttggtggaaatttgaaatagatattttgccccatcaattaatttcttattttttcatcatcatcagaaatatcaaagttaatattttatcaatattttagaccccattttgttccaacagtacattcaatacagttaaaaaataaatattgagtgtttcctgtttgcaatctgaatatacatataaatgctagtgagaaatgaagaaaataaagattcagtaaccaaagcctaaatctacataaattgaaaataaaatgataagtttagaaatatttagataaggttaaaattgcatataaattcaagatgagttttattatgactcattataactaattccaacagttgatagaaatcatttaaagaattgtaatactgtttggtaatatgttatgtggaaacatagttaggaaatctttccacttcctcagtctggatttcaggaaatgaaagcccccccaatctccccccaaataattcaagctctgctgtgtaagttataggaaataccctcccctgccagctcatttcctcttattgttcaccttgaatggggccctcagctaccttttcatgcctccctctccctacagatgtatcaagcctggtaaaagccaagggcttccacaggaaaagagctaggtcagagatacccaaggccaccatgaagtccccttctgtaagagaatgtgaaggggagtttgagaaaagccagaatttaaaaaaaaaaaattctagccagtcaactcatttagaccaatacattaacaagaaaaggaaccaagtttcttctgtgttcacattttcgatgtaattttgtatttaattccatctaaatattaattttatagttatattgcatattttataaaatgttagatatttatttgaataactatagtaattaggatagtactttgccttgaagactcaataaataattgtagaattaattaaagtatgtaagaatttttgtgttcgtaagagtgattttatgtttctgcatcaaaattatattgagtaggagtttcttttttgtatataatcaagctgtagcaacatagtatattaagcatcataaagatattctaggaatataaattacctatgtgcaaataaccctatattcaggttttccttttttttttacatttttaaaattatttctttctttctagctagctgcctatctcctggtatatttttattctatatctaatgaaactagttgatctagctaacaggttaagtggataaagtgtcccattgaattacatgaaaattgttctgcactaactgagaaaggcttacttccagccctggctctgatcttcactgtatgtatgtacttgagcaagtcatttcgttttatgtgtgctatttcttccttaactaacaaatagaaatcatgtatctcctgcctgcatcactggctaaggtgaagatcaactaagattataaatgcgctctgagatgtagaaaatgctatatatttataagatggtatcatttgtacaatgatgatgatggtattaattatgtgacagactaatctttaatatacacagcaggattttctcttttaccctttcaatcctgatttaattgatagctatttctggatctaagatatgttgagattcaaagctggcactgggacagagggaatgtcatgattccaaaatgtattagacataaagtcatccaaacagctataatatgtagagttttgttttgactcatacaagtttaattatctgtaatttaagaaaagtggctttaatactaactacttacaaatataatttcttctcacaataatcagaattgggagcgcacttttagccattacattaatctagttttcctttgtgacagaaaactatatatgtgtccgttccttatttatccttcatatgaatattgtttatcagcactggaaatctcaccctcacatcctcttcaaatgaaatatgaaaaaatgattagtctacacacaggcactcctccttaaatataatgctaggtgaatttacaaacagttatctcaatgaattatcaaaatatttctaacaagggattgattgtcccaattttacggatgacaaaactgagactcaggaagcggaagtaacttgccaaagctcacacagtatgtctagaatactaaaaccttgtatcgatcaagacgagcatgttgacctatgcacaaggaagctttgaaatctagttcatcattgacaaatccggtgaaaattaatcttttagtctcatccttcctcttcctaatcttcttatgagactgtatgtttctatttaagtatttttcagctacttaactgtgtccactaaaattctccaatgtttttacaagttccaagcatttgtcatataacatttcactcatatttttgcatttaggtcgttctttgtctccaaggtattaggttttcttgccattcatcttctgcctgtgtctttagtacccatgaagctaccttggctctgctgtttctctccttttaatcagaagatttgttccattttgttccataccagccaagttatttcactattacatttctgaatctttcatgcttacagtttgccttccttaccaaggagcctctgcttatgacagcatttttcttcttcattctcacaagtagcaagtaaatagcaaataaatccttcaacatggaagaccctccaccttttgcttatttatttttgtaatttgtaccaaccctttatatttggtgaagatatcacttttatcaggaagactactaggtacattggtatgatttagattcttctctatggacattaattgctatattcctaccacttggctatagtgactggcatttaataaacattccattagtggtagaatacgggagcaatttaatggatgaatgaaatgtgtgtctaaaaatgaggttgcttaaaaaattctgtttctctgattcatgttatagtgttagctccagaagggaatgttctctactaattattttatggtaatcttaaaaacctttaatggttttccatcttaactatttttgataaatagtaaaaatgtctagtttcttttgaaatacattcaagtcttgtgaaaagttgagaatgagatgtatattcaatgtgtcacaatccagtggaattgaacttatgttattgtgcttgtattatattgcacaaggttgaatagcttcctttcaaaaactgtcagacctggcattaatcaatccaatcgaacagtaaactacagtctgtcctttcttatttggcaaacagataaagcacagttaatatatttcattgcaaccctcaggtgttctgtttctaatgtttactttagaaaaggttataatgaagttgacttactttattcatacattcattcaaaacccatttttcagtgtaatgtgccaggaatctctcaaaggctgggagtagagagaagaaagataacgtccacccactcaaggttttcacaatcaagatggggaggaagataagtaggtaattacattcagttggtgcaaaaataatcgcgatttttgccacaaaagtaatagcgaaaaccgcgattacttttgcacgaacctaatagattatgtgattaagtctcagcagataaatgcccagaattttatgacaaaaagtagaagggaaaaccactcaggccaagacatttagaggattccagagggagttctacatttgctaagttgcaactagttgctggtagagtattggggagttcgagggaggtcgaggagtttttgagtgggagagaacagcatgtgccaagacatatacacaagatgggcagaggaagtgtctacaagactgaaagcttattggctgaattatattataggaacattggattcgtatatctgaaagaatggaaggagacaaagctggaaatacaagtgagaattacttcaaaagggaccatatatgcccctccccagctttggggtgggcggagctttgcatggagaagcaatgtgattatattagcatggtgaagcagcacgctggtgtatggttgtcagataaaatatagttacatttcagataaagaatgaatcttttctttcagtatcaacatgtcgcaaatcttgcatgggacatatttacacaaaaaagttattcattgtcaaattgaaattaatctttcactgaacatcctgtatttctctgtgttaaatctgacaaccttactctgatagcagtgtggagaatgaattggagaagaaaggacaaggcagaaaggccgattcaagggacaacctattaaaatctgcattcaccctttgagtcacaatggcattgctatttattacattgtgctaaagtgcaggatgtggacaactttgttaccatggctgagacccagagaggcacagcctgaagagaaagacaatggatattctggaacaaataggagattttagtgctccaggttttacaggagcactggacctaagatggaaccatactttaaactgggaagaagatggcatgtgtgcacatttcctctgaagactgtggggtaaaatcgatactgttgtaataaaacataggaaacaaagacccactgcatttatcctgggtctcaaggagaagtattcaaacatgccccatattcgtgtttgtataatgatttgaacttttcaatttcttcccatactcagtatcttctatctacatcacaatggctttgcagtcaggaaacagttatcattaacccaattgacagataaggatatctgcacatatacacatattctgccttagtttccttattaaaattccttttgcatgtcaaatccaagctgaaactccacattttctaccaaaatgttcagcccacagtttcttctccctgccacttactatgtcagcattactgagccctgcacaaggttcctctctgagaccttgtttggttttggcttgtgaactcatattgccacccactggactgtaagctgccaaaaggcaaggacaaattttagcattttccaggacacttctgtagtatcttagtattaggcgtataaaagactcctaataaatgtttgattatcagactagcagtggaagagccagaaataaattaaaaatctagtatctcaatatgcagccttctgctcttttgggttaccttcatactttttaaaaattttcatcccctgtcaaaccatacagaggtgtgatttcaaggagaatgaagacaacactggaggcccagagttattcagaggatgctttattcatctcccaaactcggtgcaggaatgagcaccagccacactaaagaagagcgtctgtttaaactgcaccatcaggatagggtctaccaatgagatggagttaaggaagctgacagctgactgcaccatccttggctcctcttttatgaaccctcagggtgtgagttcagtcttccccaaccattgctcagcttctttgcttcccagggagggggattgtgagcaggtccctctgcatatcagagttgaatccactaactggttataatccgctcctaactaatgagcagttgctttatgttaatggatatattcaaatatttgtttacttgttagcataggacatacgtgtatactcctataaataagataattgcaaagtacgtttactatgtattgtatagagcagctattctcatggtaaccatgccaacaagtatatcagaacccccggaggatttgctaaaacacagcttgctgggccttagggtcctgagtgggcatgagaatttgaaattttaacaaggtccccaggtgatgctgattgtgtttatccagaaccacacattgagatccatcgatgtagaaaatacagtttcatatttgtctgtgtacgtgctgtgcacacactggcttacatatgaagacatctattctatagttgtgtgttatgtttagacaaaaattactgtaaatatgcttatctgcatagctactcatacatatataaaaatatacaaataaaatgtttactcacaaaagttgtttgtatatgactttaagtctaaataaatgcttatgaaaggttataagcctatataatgttatgtatacaaacacatatgcatgtttgtacatagaaatatagttatatttctaggtgatacttgtgtatgtacatgtgtatagtatcaacgtatctttcccttttacaacaaaggccttattaagtataacatcaaatttaatattttagttaaactcatcatcaaaagcagtgtttaagtgttccaacctgagggcggagatgtctccatgctggccctgttaagctttattagaaggatgatcttttcaatttccctagagcctcttacatatttgctatatttcacatatggaagtgccaaattaaataagcttcatggtctttcagaaccaccagggccctcctataaagtcaaatttcaatcatttcacttctttgccttcctcccaaagagatagtacaattcttctggcatttaactgactaaattaacaaaaatgcagtgcaaactcagtgtgttgagtgctcctgggtcttacatccttcttgtgctaaaagggtctgctttgttcaaaggcaaactttgtctttggaagaggaggaaatgcgagacatgagtttggggcctgacacttaggagggctaaggtagaaacaaaagaaatgaaagcatcagattgaccacatctcctgtgacatacagtacaataacagcttctttcttccctactccacagttcttcaaatgcaatagaagagaaaaaaagagcaacctggaaggaaaaaaagaaaaggtagcaaaaagagatggatatgcattactagtcacttcatttccaagacatgattatgctttggttatatctcatgacatcacattgcaataaatattacccatcatgcataactggtggctgaggtccagaatctttgggtaaactatttaagaactctcaactaaaagtggaagagctagaatttgagctaagatctgcctgatttcagtggttagatccagaagcataaatcagtgctttcctaaaatggtctgcaaggaagagttaaataataaataaaaatccctgggaattcatttaaatatacatgttgcaatggggacaagagaagcaggagaggaccttgtgggcttgaattttgaacgagtaaaataattttgggatatgaaagaggggagacttacatggtgagctgtcaacatcagcatttctcaaaaacaaggtggtgagttgcccaaataggaacttcactggtataaagtctgaggttcatatacttttacatccacagcttttagcaggatgtttgacctgtggtaagttcacagcaaactctcattaaattagttgcctttttagagctgattctgcttcaagttcaacttcccttcctggtcctctgatgactaaaacaattttaccaggggataagatttcatttcaaatccgagataaggttaaatgcaaataatgcagaaaaagaggaaacatattgactcagcacctgggggtataaatgatcaatggtagatcatcttctgatattatggtttattggagagatggagaaggtcactgaagatctgatcagggagtagggatgagcacaaaaatgagagaatctggtggtatcagacaaagtgtgcttatttcactagtttcctggcatctggtcttctgagcagaactgcaacagaggaaaggcaagaaatggctttgggagctgggagaccctgtgcacaaaagccttcctggcagcctttctttccagggtcattgtgcttagactttgttttacatgagaagaagaggtatcaacgattcaccatagaaaacaaaagatcctgaaggtaggaaaaacagtagtaacaaggtttatgaatcagctaaacttgtgtttccccaaatatatttgtttacgatgatcctttaagaagtttggaaatcaagtcctttaacaaaaccaaacgtgattcttaagattatataagttaacagaaacatctatttataaaagaaggaacaaaaagaaagaaggggccgggcgcagtggctcatgcctgtaatcccaggactttgggaggccaaggtgggcggatcatgaggtcaggagatggagaccatcctggtgaacatggagaaaccccgtctctactaaaaatacaaaaaattagccgggcgtggtggcgggcgcctgtagtcccagctacttgggaggctgaggcaggagaatggcgtgaacccaggaggcagagcttgcagtgagccgagatcacgccactgcactccagcctgggtgacagcgagactctgtctcaaaaaaaaaaaaaaaaaaaaaagacaggaacagtgacaaagtgagagagagaaagagagagagacaatgggacagaaagaattagagacggagggttatctcagcaccaggtagaattcagcagtggcatctgacattgtcatgcttcagacattctgccatcatgaaaaattggattaatcataacctaaagggtttcacatctgggtttcttaaacctggcctaaatgagtgaatccaagaccgcatataatgggatttcagtattttgaagattaagtttttcatgaattcttcaaagtttcctcctgccaaacagactgaaataaatcaaaatatttaggaaacacatattctaatcatgagtggcctctagataattaagaattgttatttttaattttagttatttttcaggagagaaatatttgtcaagcaattgtgtcaggcatttttttaggtgttggagatacagcagtaaacaaaacaattaatttctgatcttgtggagcttattttctaacaaagggagataaacaaagtaaatcagtaaaatatgtaatattctgaatacttaatattattgaaagccctcataaagtccatttctaagccttgctagccagaatgactcccggggtcaatgcagaccctgtgaggtttggaggtgtggaggccctgcagcttggcttggtcctcacacacctaccatgcattttattcatcttttgaccctggagaggttccagactactctgagcctcagttgccgcaactttgaattgtgattctgacattaactctgaaagtttttgagcattttataggagataataggtgtgaaagagtgtgaatgtaactcttgatcaagacagccatgcataatcttcattaacataattttaccaatgtcactaactcaaattaaccaaggagaaaaatcccttttatttatggggattttgttttgttttgtttaatagactggacagaggtctacaccttaagaattggcaagacttttgttggcatctattactatagattccacaccttgcagggcttccaggttggtattctaaatataaagtaacaatgggttcatctaaagggcataggggatgaaggtataggagactaagctgctcttagcacatcaacccctcggaaagatggtactgcggagcagagcaggtgccttcatatgcctggccttttctctgcctcccaagtgggctttgaacaagtcttttaacttcactgagtatgtttgcttctgtaaaattggaaacaattaccaactttcctatttgcagagcttgagaattgagttttctctccaaagagaaaagaagatacaaaaccttcatgcttgaattaaaaattacaaccttcatatgttttgctagaccactttttctaagtactcttaagggtgagcttcatctctttttattccataatgtgtatgttattcaaaagatttattgctttggtggtctgaatagggatataagagccactattaggctaacaattggtagcaatgatgtttttgagcaaacttcaagggtagttagagaagtctaacagagtgtgctttatgagctaaacacaataatggatcgtagccaatgctaaaggttccattagggaggaggaggagatgagtgcgtgagtttccacttacacactttttccctgtgtgagttgaggactcaactggcagattttaccacactgatcctgtaggatgcttattagaccaagtctcccaacccaaaaatcagagctaccccagctttacaaacaaccacttcctggtatttcaattaattaaaaatttatgtagaaaaagaaaaccgaaagctcaattaaactactatgatcctagaaaaaagataggaaaatggaaatttctctcatgctatccaattttctgaagctgctgcttctttcttaaaacaggaataagggtgttataagagatgtctatgtcattgataagatcatagatctattaaataatacagttattaaaaacaatatacaagtattacacacatgtatatgcacatatgttgtgtatacatatacctacgtatgtaaattccatgtctgtgggtagtttgttctaagtattttctcaacttttgtttatataaactactgactatgtgttatttaccccggcatgagtttttatcttctcattctctgggaggataccactccatgtgtctattgtttatcttgcaaaagtagatccttctcatctactgaatgataacagtagaagcctggctttttttgagacatattttattggaacaaaagctgtaaatatatacctatgttttcatggattgtgttttatttttattggtgtctttaaggaatttgcatgttcaaatgcaaacaccaataggtatctttgttttctgactaagatctgaaaatgaaattgagtgcacattttatttacccatctcatcaggccaacaaatccatatgacacagatctggttgttcataaactttttggtgtgggatgtttggagaagatctcaaaggatggggattctctgaaccgcttagttgtgtatttcagggtgtactaaccccttttagttttgaacttccacttgcccactatgcttctttaagaggttttgcttgtttggtatttttgccaaacagactttcataaaatatttcttgcaatgaaagccttccattccttgaaattcttgaaaaacttccaaattatatattatatatatatcatatgtatagtcaagttggagaaagagacaagtcagttgccaaatatggcagtgtgcttaggttagatgacagaggcaatcattcgatattaggagagtacagtggaagaacacctaaaacagactggcctggctgggcccagtggctcatgcctgtaatcccagtactttgggaggcccaggcaggtggatcacctgaggtcaggagttgagaccagcctgaccaacatggtgaaacctcatctctactagaaatacaaaaattagctgggcatggtggctcacgcctgtaatcccagctgctcgggaggctgaggcaggagaatctctttaaccctggaggcagagatcgtgccactgcactccagcctgggcaacagagcgagactccatctctgaaaaaaaaaaaagcaaagaaaaagtaaaaagaaaaatacaaaactctccctagcaggctttaaggagctgcagtctcgtgtctccttagtttgagacattcctggaatcctacagaggacctggtgatggggagcctgtgttctttcattcccatgaaaattaactctattgcttaagtgtggagcaggatgctttgtgtcaaacttgcagatccacatgctccatttttcccctgctctggccctgggatcctagactttctcagttgtttttctttctctctggtgtctgtggggctccgtccatgggatgcacaagggcagacaagggcttgggaagagtgggtcagaatgttcgttgtacattccattcttgctctctgctaccacagttggcctcttctccctggagaatgctgtagctcctgcctgtcctgaccttcacaccagctgccccctgcagccctggcacttctttgcccgatcaagtactgcccactgtggctgtctagggtgattcactgtcctgtgggggtttctttccatgctccccatgccctgaggacagtatcttaactctattccccccaaaccatgcgtctgatggtgccagtggcttcctgctgatatccacaactgacattcacatctaataggcatatcagaatcagagtgtcaaaactgaactccacacactctccacctctcagcttctgcatcctctcagctgtggcacctctaaccaaccagttgtctcgctgaaaatctcagatccttctctgacttccctccttctcctgggctactgtcctcaaatcttcgtaaaatgtcatggccacgaggagtcctaccatgaccaccctattgaatattaaacctcatctcttgcttccccaaaaactccttcttctcctggtcttgctgtatttttttctttgtttcttagcatttatcatttacaataggactgccatcaaaattggatggtttaaagctacagaaatgtatctcatttctgaatgctagaatttcaaaatgaaggagtttctacttcctctgaagcctctgagagaggacccttccttatctcttccatttcttggtagcttcaggtcttctctggcttgtggaagccaatccaatttctggctctgttttcgtgtgtttgtgtgtctctgggtcatcacataacattcttcctgtgtgtctgcctctatgtgtccaaatttctctcttcttataaggacaccagtcatactggataaaggcccaccttccttaatggccttagcttagcttaattaaatctgcaaagaccctattttcaaacaaggtcacatttacaggtacttgaagttaggacttcagacttcaatgcctctttttatttaatttgttgagcgggacataattcaacccataacctatagttgacttatttattatgtccactgtttattgtctatctccactagctaagaattagtatttttcagggcagagatctttgtatcttttgttcattgatatatcccaagcatccagggctatgtgggaaaacagtggttgctcaatagatgtctgttaaattgagggaaagtctgaacagcaagctgttttaagattaacgtaaaatggaattttactcagcatggggaagaaatatccctgaagctctaggttggcattcctgattgtgaaaagcaaacaccttgttatgatataaacagataccaaaccactaacgtttcacttggaaaacaatacctcactggacaaggagggagcgaaatttcaccctagtatttcttttctttattctacaattagtttatgaaatgtgaagcatttatttttaagctaactcctgttaaatcttctgaattccagacctgaggtttgactctttagcagatggtagatatgtaccttggagagaaagagagggtggagagggaggagacagagacaggaagtacaagaggggctgccaaacctcagccctggacagacttcagcaaacaaacagaagtgagacccagcaggaccgggtgtgagctggttttattgctgtccaccagctccaggtcataagtgacctaatcaaccttagcttgcatctttcttgcgatagctttgtgcctgttcgctgcacacagctctgattctcactcatcctaggccttggcgggcatatccagagccctttatgggatccaggacacagctgctgcaatatcccttcattccaaatcacctctcaacccctcccccatttattttctctgcgctactgaacatttccaacacttggtataccagcatcctcctcatcccctccccaaatgacttggctatatctcatatccagaaaggccagctatggaggaccacaggtgggagcaaccacccaccatagctattaacaaaactcaaattgcacatagcacaggtataaattaggtcatatatatatatatatatatatatatatatatatatatatatataaatataaataggtgtgctgtatgttcaggtaatgcaatgaggcctgttttctcttttctagaacatgtggtaaactgacaaacatgcatttactggtcatctgtgtgcttcctttagaggccagaaaattattctaaatatttgaaaatggtttacttccaatcaaactagttactaatctgtattatttggaaaaactgaatccacaaaaaaattttgcttagaataattttcttaccttaggttgccacattataacaatgaaataataataatgtaattataatcatataacataatattttatatataaccttatatattataggtaacattacacataatgtagtaacaatatataatacaactatgtgtaatatagaaatacaataccaatagcttcactaatcacacatttatcttctaaaaaaacgtttcttttgaatattggacacaatggtaaaaactaatagatggaaaagggaaaactagaagttatttgcagtgtcccaattcagtaagtaattgctgttatactatataagggatcctgcaaaccaaaaatcataactaaatggaaaactacaccaatagaaaactggccaaatagatcacaagtgctttcagaattaaataaaaaaaaaactcaaaaagcataaaaaacatctaaagagaacctcaatcgtattaaaagtcaagaatgcacgtttgagcaaggatgagaattcactgaacatttattactctggcaaaagcaagaagctgggcaccactgggagtggtatggccgggtgtggccaagctggagagccaggtggcagggagagcagacgtgaccccacagttcctgcagagagcgtgcatcctggagaaattctcacacaggatcctagaggaacactactgagaatactcacttttgtgcttttagaggtgttgagaaatgcagtgaacccccttgcgcagggggctgccaacttcatctataaaaggtctaagagccgtgagccagaggctctcttgcaatactcaacactgtcccacagcaccgacagaagccccatagacatgatgcaaatgagtggacatggctgtgatctaacaaggtgtcatttacaaaatcaggcagtaggctgggtttggcccctactgtagtttgtagtttgtccattcctgtatatcccaattcctttcacacatattaaatacacacacacacacataattcaaaaagctagcaagattaaacataaaatacacataatcatataagaatgatggcttgtggaggatgcagaggggaatggagtgatcaaacagagactaagcaatggtgtggtggggagtgatgaaaatgaacctagaaataaggattgtcctaactcaagattctgtacccagggccaatttcattttttctaagcaaaggcacacaagctatggtttcggatgaggagctataatttgctcctagttttttaagaactgagattctgtgcagagtgctgccaaattgcccacagtgagttagtatgaagcgcgggcctctgatttgatttgatgatgtacctaattgtggctgggaatcacagtactttttggactcattttgagtgccccttttttgtaaaataaatgataccaggtaaaaaatagcagttttttttttcttgatcaggatgtaatgatttaaaaaatgcccaagggaagaagacaattgtcaagctacatgcacaatggcttaaattgttcaagatattacctctgatgaagaagaaatggagctgtcacgcaatgaaagtctgtccctaggtgagaagggctaagggataagcatactacagtggttaaaagcaagggactggagtggattttcaatccacatcctggatcttcacttcacagctacatgatggactctggcagcatccgttatctcatgttacagtaagcatgatatttacctggaagaaatattttgagggttaaatgcccaatttcaaaaataagacgtgtacacagcgattacatgagatactcaggaataacatggtatagtttgtacgattagcaattcctaattattgttgctttccatatttccatgcaaagatagtacactcattatcccatactccttaacagagagatgtctgttgctacaaaagtataacgtatcatatggaatgctaccatgtgttgtcttgaaccccaaggcatctagaaagcatcccacttcccactgtaaacagtcacaaagcattttaaaataggttcatttttaaaagagccatttttagtgaatttgttaattagcaaattagtaaaataccaaagaaacacaccatgatagtcaaagcttacacagggtcacacaggatccctgtctcaaaagtcccgtaacagtctctcatctgcactgtccccaagccctggggaccatgttggcattacatagatgctgcttagcccatttccttgtcttctgcctgcaaggcatgcagtgagcacacaccttctgcaaaacctctaagtgaaacagtaggtggtctggataaatatagtagcatgcatctcgtgtctcaggttcctaaggttcctacatcatacctcaatctttcatatactttccttcacatgttacatgttttatttcttcattctactatcctgtttcagaaaattgcaggaatatataaatatgtataaattatgtataaggtacgaataatcacaaatacatatctatatgcctatgatctcaatttagggaaaataactgccagtatgtgggaatcattccatggatccctccttcctccacctttgcagatcgcatatcctgttgaattttgtgttattaatcctttgattttcttaagaaagttttaccatctacacttctatatttagttttgtgtgattttaaacttcatataaataaattgagttgacttttcaggcaatattattttcttgagttctgttgatactattgcatatagctatagtttattttaagtgctgaatgattttcctttggaataacatacaacagcttatttattttattggatatttgtgttgctttcagttttctgctctaacaagcagatccatcatgaatactttcacacatatcctagcacacatggggaggacacttgtttagagtatttacctagcaatgggatttcttggacatgaggtgtgtatatctttaactttattgaaattatcaaatcattgtccaaatatttgtaccaattcatattttacaaacaatacggcccggcgcagtggctcacgcatgtaatcccagcactttgggagcctgaggcgggcggatcacaaggtcaggagatcgagaccatcctggctaacgtggtgaaaccccgtctctactaaaaatacaaaaaattagccaggagtggtggcgggtgcctgtagtcccagctactcaggaggctgaggcaggagaatggcgtgaacccgggaagcggagcttgcagtgagctgagatcgcgccactgcactccagcctgggtgacagagactctgtctcaaaaaaaaaataataaaaataaaaataataataataataaaacaatacgtaggtattccatttgtattgactctcatcaaaacttcatattgaaagaaaccttggttattgtcaatatggggggtgtgaaatggcatttcatttccactttaatttttatctgtctaagtactaatcaggctttttaaagattgtgagccatttgagtttcttttttttaagtttgtcttcagatattttgaatatttttctactgggccatctgccttctttcaaatcgatttgtagaaattatttatatattctagatgctaatattttgtcagttatatggttgccaaaattatctttcaatctgtggcctagatttttactcccttcttatgtatatacatgtacctatatattacaatatacagaagcgcttagtttttttttcttttccgactttgattttagaatcaagcggtacatgtgcagctttttcatgagtatactgcgtgatgctgaggtttagggcatgattcagcctatcatcctggaagtgagcaaagtacccaataggtagtttttcaacacttaccctcctccctctctccccactctaggagttcccagcgtctattgttcccatctttttgtccacgtgtacccagaagttgttaatttttacataggggaattagtccattattttctgacattttaaattctctgtattttgcttaagaaatagttttttagcttaaagtcataaagacattgtcttacatattttttaggttttttttttcagttttcccttttacaattaaacctttagtctatctggcatgtattattttgtgtctggatgagaagtatgccagatttcttgccacatgatttcttttttttttttttccattaactgtaaattctattcctttcttactggaaaaaaccttgcaggaccaagtctatcataaaccaaattgccatatatcctggggctgtgtctggtagtcttattttgttttatagtggtaatattctatcccatgccaatattcacacggcaattactacagatttctataattccttatatgtaccaaggtatttcttctcattattttcttctttttcaggaatatcttgcatattcttgggtctttcctcttctaaataaactttactattagcttgtcattgttaaagggaagcaaagctggaaggagaaaatgaaaggacagaggaaaaggaattctgagatggggtgtggattgaatttcaatgaattcatagatctatttagggaacatcacaattgcaaactttatggtattgagtctttctaggaaaaaaattatttctatttatttagatcttctaaaaggtctttccagagtattttataattttttcatgtattttgttacatttattccaaggttctttttttttttttttttttgagacggagtttcactcttgttgcccaggctggagtgcaataacatgatctcagctcactgcaacttccgcttcccaggttcaagcgattctcctgcctcagcctcccgagtagctgggattacaggcatgtgccaccacacccagctaattttttatttgtagtagagacggggtttctccatgttggtcaggctggtcttgaactcctgacctcaggtgatgcacctgcctcatccttccaacgagctgggattacaggcatgagccacctcgcctggctggtattctaaagttcttaaagctaccatgaatttccctttttaaaatcaccttttcaattatttatagctggtgtatctaaacacaattaatttttgtacattgattttatgcatagtaacttgataaacacttttcttcattctcataatctctatgtagattgtttagggttttctaaatatacaatcatcacccatgaataatgagagttacacttcctgctttccaatcaacagaaattttctttctttttcttgaatactttgctggctcggacctcatttgcaatgtcaagtgaataatgttcatggtgggcatatctgtctttttcgtgattctaaaacaatctttgcagcatttcatcaataaggggaatgtttgctctagattggcatagacacccttccaatcctaatttgctaaaagtctttgtcaagaacagatgttaagatatttttgttggatactgactttacatctattgaactaatcatattagttatctccttttagctttcaatttggtaaataatattaaatagttttctaatccgaagccatgttttttcatattgaatattgctgaattctctttagaatttactctaaattactgaggtctcttattcatatatatttctttttgagacaccactcattgttatggttttctcaaaacatttcccttttatcttggttttcaaatttattgacataatcttgtttagactaacctcaataacttaaattcctcttcatcttaagtcacaccctattttacttcttctaatatgcttttattttgaattgtggtaaaaaaaaacacttaacatgagatttactcttttaacaaatttttaaatgcacaatacagtattcactaaagtcacaatgttatataaacagatctctaaaacttactcatattgtttcactgaaaaactttatatctgttaaatgataactcctaattctcaatctgtaacctgatttcgaagctgcaggcacttatgtcctgccacgtatttcttactccctacctgtatcctgaaatcccagtccagaggcacaaattgtccacactctggatgcttctccggttgctcatctaatacccaaatactgactgaaacctgggtttcctgcagttttccatcccctcttatagagcccccttgtttgtcttctgtagcagagccatcttcaggccaaatcacctctaagacccatatgtcctctggaggcagcccaagtgatgtcaatatttctctggggatctgtttcaccctaaggaaaaggaggcatcctgctacgtttcattttctctttttgctgggccacccatcacaagtgctaagagttgaagagcagggcttgtaaataagaatttaattactcctcatttctacaattcactcaaacatctggtaccaggcgtggagccctgaagcactgctcgacctgcaggtcacctaataggaactgagaaggacttctctctcagcctggaccactctcaggtacatgcactacttttaaacctagccaaaaagggagagaataaaattgagatgtaacaatgtttaatgattatggaaattgtatcaatcactcagtgagtcagaagacatttgatcttcattgacattcgaaaaagaaggagaagcagcagttacagaatctttacaataagccatatccgttatgtatgatcacatttaatcctcctcaacacaatcatgctaagaaagggtaattctgtcatcttatgtcaaagaaaacaaagcttaggaaaggtaaatagagtattcaagggtatacatctaaaaccctgcttcttttaacacttaacctctccccatggggctcaccattctggtgtacagagtaatgtataaactatcttgtgagaatcacagtatagttggagagacagtaactatcatgttaagcagtaagtgacaggtgcccctgttgtctggttctgaatttggaggagatgcaatcagggagctcaggaatgattaaagaaggaaagcagtatttgaaattgattcagaagatgaggattttgcatatataaatttgttctcaaaagtctatgatacaagcttagagcagcaatatttcaatacattttccacattccatagtaatggttcatcttagtatcaacattggcaaaagttatggactctgttcattagcctcaccattaatattgttttgcttttgctttgtcctcggcccctaagacagtgtttgcgtaatcaaaatctgagtcatatacatattatatgtatattttatacatatacttcataaatcatgtttcaagattattgttacaatgtaaatcagtctgatgctaatttaaatatcaggatatttatgctgtgccctaagttctggaaagcaaacatgaaaaatattagtataagcattttaaactatgtctaaaatcaaggtgaaagaatgtactctatcattttgttatggcccctatagttctgaagtaagtttctcccaatttcctattctcaatattattacttcagtgatcatttaaaatttctgttagaactacaaggaaaatgaattgtgggagtgtcatagcagccccaataaatgtgattcagtggccattctgagaaattttgaaggaaaactttggtttttaaaatgttaactttatcttgggatgtctttagtagtgtaatgttaatgaataaatccatcctgcaggtttgtgagtggtaaacaaccagtcaggttaggttggagagcaggacggggccaacttcaggagtgaagtctgcatacgagcattgtggtagtccgtttttatactgctatgaagaaatacctgcgactgcataatttataaagaaaaagaggtttaatggactcacagttacacatggctgggaagccatcacgatcatggcaaaatgcaaaagaggagtaaagacatgtcttacatggcctcaggcaagagagtgtttgcaggggaacagccctttattagaccattagattttgtgagacttattcactagcacaagaagagcatggaaaaaattcacccccatgattcaattacctcccactgggtccctcctataacacatgggaattatgggagctacaattcaagacgaaatttgagtgaggacacagccagaccacatcattccacccctggccccttccaaatctcatatcctcgcattttaaagccaatcataccttcccaacagtcgcccaaagtcttaactaatttcagcatgatctcaaaagtccacagtccaaagtctcatctgagacaaggcaagtcccttttgcctataaaatcagaagcaacttagttacttcctagatacaaggggaggacaggcattgtgtaaatacacccattgcaaatggaagacattggccaaaacgaaggggttacaggccccatgcaagtccaaaatccagcaggggaatcaaatcgtaaaacttcaaaatgatctcctttgactccatgtctcacatccaggtcatgccagtgaaagaggctgattcccttggtctttggcagctccaccccttgtgactttacagggtacagcaccccctcctggctgctttcatgggctggcattgagtgtttgtgacttttctgggctcatggtgcaagctgttggaggatctaccattctgaggtctggaggaaggtagccctttcctcacagatccactaggaagtgccccagtgggcactctgtgtgggagctccaaccccacattttccttcctcacttccctagcagaagttctccatgagggttctgcccctgcagcacacctctgcctggatatccaggcatttccatacatcctctgaaatctaggcagaggttcccaaacctcaaatcttgacctctgtgcacccacaggtacaacaccagatgtgagctgccaagacttggtgactgcaccctctgaagcaacgatatgagctttacgttggccctttttagccatggttgggatgcggagcaccaagtcctgagactgcacaaagcagcaaggccctgggcccagaccacaaaactattttttccttccaggcctccaggcctgtgatggaatgggctaccatgaagacctctgacatgccctgaagacattttccccattgtcttggccagtaacatttggcgccttgttacttatgcaaatttctgcagctggcttgaatttctcatcaaaaaatgtttttttgttttctatcgcattgtcaggcaggaaattttctgagcttttatgctctgcttccctcttaaacatgggttccaattccaaatcatatctttggaaatgaataaaatggaatgtttttaagagcaccctagtcatgtcttgaaggctttgctgcttagaaatttatcccaccagatgccctaaatcatctctctcaaactcagagttccacagatatctaggacaggggcaaaatgctaccagtctcttcgataagcataacaagattcaccttttctccagtttccaacaagttcctcatcttcatctgagaccacctcagcctggactttaatgtccatatcaccatcagcattttggtcaaagccattcaatgcatctctaggaagttccaaactttcccacattttcctatcttcttctgagccctccgaactgttccaacctctgccagttacccagttccacagttgctttcacatcattctggggtatctttatagcagagcccactacccagtaccaatttactgttttagtccattttcatactgctatgaagaaatactccagactgtgtaatttataaagaaaaagaggtttaatgcactcatagttacatatggctggaaaggcctcacaatcatggtaggaggcaaaggaggagcaaaggtacatcttacatggtggaaggcaagagagcatgtgcaggggaattgccctttataaaaccatcaaatctcatgagacttattcactatcatgagagcagcacaggaaaatcccacccccaccattcaaatacctcccacaggttcctgattatggggagctacaaatcaagatgagctatggggacacagccaaaccatatcaagcatctactgaggcaagaagacaggtagaatctgaaggtctatagccccattttctaggatattcattgaaagccaaagtaaactgctactgaggccaggaagttcactaaaatgtaagggcctagtgatatgtccagactaggaaagaaaattttaattttcaagaaagtcaaagccattagttgtagccctagaactagtgacagtagagtacacccaatcctaagttggaaactggtacggtgtgaccgtgtccccacccaaatatcattttgaattgtagtttccataatacccatgtgtcatggaagacacccagcaggaagtgattgggtcatgggggcggtttcccccatgctgttctcatgacaatgagtgagttctcatgagatctgatggttttataaacatctggcatttcccctgcttgcacttttctctcctgccaccaagtgaagaaggacatgtttgcttcctcttctatcataattgtcagtttcctgaggcctccccagcaatgtggaactgtgtcaattaaagttgttttcttttcttttcttttttttttttttggaaatggagtctcaccctgtctcccaggctggactgcaatggtgccgtctcagctcactgcaacctccgcctcctgggttcaagcgattctcctgcctcagcctcccaagtagctgggactacaggtgtgcaccaccatgcccagctaatttttgtatttttagtagagatggggtttcaccatgttggccagcttgtcttgtgatccgcccacctccacctcccaaaatgctgggattataggcgtaagccaccatacccggccaaaccttttttctttataaatgatccagtctccagtatttcttcagagtagcatgagaatggactaatacagagagaattctcttttttcctctgtgtgttttgctgcctcctttttttctcagcctgcgtgttttggtgtctctggtagatcctgaagatgtagtcatatgtacatgataattttttaacttcttatctaagatctccaaaaagggctcaaatgaagtttccatttggaagttctaaaagtgggcctttagtccctactcggtgatttaaagtttcgtttgagtatattctgatacacatcttgctttgcagagtatatgtagaaatcacttgtatttgtcctaaacattctgaaattgatcccaagattgagaacagatgaatagaatggatcaaccaagtgttctgggcccattctgctggatagtaactaagtgattaatgccaatgggccttgggcagagctagtgccaatcccagcactgtgaccttgagcaagttacttaaatgcactgaggctcagtttctttataaaaccaggtcaataacacctaaccctatgagttaatttatgtgaattgcctgtcccagtggcctattgtctggactcaataattggtatatggtattataatgatggtgatgacagcaacagtgcagatatggcttaccttgcaggacattttgtgatgcaaagggaaacccttgtcaacataatgcgtgtatgaataaccccttattttcctaacctaccatctcctttccctcaaccacagtgttggggcatgtttgccaagctctctttgtgtgctatcacaagggttaggttgattctggaggtctgagtgggccagtgggggcagttgcatgaagtagtaagatgagggatagctagagaagagagaccaccagtgctccaggctcttgatgatctacatgtggttcatgggccagcggcatcagaggcacctaggagcttgaacctaaattataatctacatttttgtaaaggtaattcatgctcacaataaagtttgagaagctctgtcccagggagtaccctagaaaatcaaaagctgtttcctgggtgagtaataggggacagaagcctgatacatgcaggaattacagggagatgaccaaggtaggaattccatcagggtccagttgttttgaaggcacaggttgcaggcagaaaaaaagcactatacagcccaaatattaatagatatgaaacataagcaaacaattgatttttttaacttttcacatatattctgttcaactctgtatggcaaatatgatgtttagtatcaaatggtagccattcacattttcttagtatgctgaatttattcccaagttaaaattccatttaaagaaacgagaatcccttcctaacacatgttacagactttaaagaactagactctgtgacccagttcatcaaaatgcacttgaaaaattctgtctggagctctcagaccaatgctacacattaaagattttattttcttcctcctgtcttttccaaggcttgactcctaaccacttgagatggagctaaagctgacagagaaagtgaaaatcctctgccttcttgcctggaggaaatgcttggcaggagatttccaagctgtgctgtcatcaaagctaaacttaaccttgttcaggaaaagaaccctcaactttcaaaccaactccttgtcagaccattcaatttgcaaagtacaatgttggggggatagaaaaggaaggaaaaatagcaatgaatgcactgatgtttgagattgagacttgaaatgatgactactcatgttttgcaatgacattaaagttaaatgtcttggttcacgggcacttaccactcccttcatcaccattaatctttgctcacagttttgaaatacaccactttgtgtcttcagcaatgaaacgaaattttcccagggttgtaattgctttccggtatgtcttttctcatgttatttgattgctaaaggttttcttcaaaatgggagatatttagtgaacacaatacaatgtattttcctgctatttttaatctgttcatgcataatttgaagggtttggtgagggaaaaatggaaattgaactcatctgaccgtgacagatttgcaaactctaaatacaacttaaactttatcgatgcttttaaattacagcactgaatacctggacatgtccatataacatttatagcattttatgtcttcatagctacagccaacatttgcttaagaatcacaattgtaattcaggatgagcaagaagagcattttacaaggaaaagtagagcatgctgaagtattttgcctggaacaagcttttatttttagcctgtccccaaaaaatcattatctagaggcctgaaatgtctcaaaaaatcattatatttgaatacctggtaggtcatttcatagagtcctgaagaatcctatttaatatcacgtgggtttgttatctggaccacagagcaattgaaggaatgattgtctattgggacctactcttttcctctgacttctgacatgcaaactttctccagtgtacagttttaacaaatggcacaccacactttggtccagcatgttatatccaggattcttattgagttattatgaaaggtggtatttccaaaattcatataaggaactctcaataatttatacttacctccatgtaatacattcaggtcttctttccaatgccttagcttggatacattttgtgagagtaatagcatgtgaaagaatgtcaaaaaccagaggcctgggcttgagatttagccctgagctctgcccatgcccttcccttccagtgagaaaatatctttctagaagagaataaatatagaaagcagagacatccatcatggatcaaagagactagatggtgactggggacaaaccatgccagtttattgtccattcctgacaaataaatagctctcatccccaaaatacaaaaatccagaccaagaggcctagtgataaaatcgggagggagtggtagctactgaaaactaaaaacattctcgtgttacaacaataggatttcaatttattcatgttctaaatatcatttccttactcaaaaatctttacagaggttcacaggatagttataattgcaaagctgtagctatcattaattaagcattttctttgtaccaaccacttttgtctttgttggtggttcatgacaaccctcatttgtcatgacctccccgtgggaaacaggcatcatcatcttcattttccatggaggaatactatatcacagagaaagaaatggatggccccaatttaccaaatcagtcagcagaacaactggatgcacaaggtactgagacccaccgctgtgatgtttccattctatctcacacattcacttctgccatagcttgctcactcatcagacttcaaggccctacacaaccaggctctcctccaaattactagatatatccccaacttgttcggagttttgacttctttacttgcaaaatgagagggtgttggaggctggaacaagtaagtcagagagaagatgcgttgcctacccagttaatactcttatgaccttcatacctgtgcctcctcatctgtcaaatggtcaccatcttggctgtccttcctggctgagatgatttttgcaaagctcaaataaagaaagcatttagaaatcacactcataggacaaatggtaatgacaaatctcatcgatattctctttaagtgctcacaatcttgaacgcacttccctgtgtgacttggaaacataagtcactttactgttgcccacacattttccattttagagacctgtccagtttctattccgatttcttagtcttcatttaagactgtcctccccttatctaaacctctacctaaccaacaagcaattgagcaattctctgtggtcatcactgtgaaatgcagtgaaagtaggaaagtgagtaagatggggcctcaaagagctcaaggacctgtgtgctacaacatcttcaaaataaacacctgtcaccgagctggtcctcctagtggaggtggagtattatacacaaaagaccccataaaggagaaaaggaatttcttgcctggagagatcaaggaaggctatggagtatttacatcccgtgcagtaagtgcattgttgatgagtgagcaagtggaaggtgatgtgcgggcattcaagacagagtcaaatataaacacagccaataaattggcaaatccaagcacagattgagaaataagcggtgccagaagattaaataatccagagtttgatcatgaagggatatatagaagcaaggaactaaaattttattctgaaggcatgggagactagtgaactcaggtcagtcatctttcttatttcctgaatatggaattcattgctcacctgtctttgggtaattaaaaaccatcaccttatgacatattatgacttgccatctgaatataaatatatggtttttagtcttgtgacactttttattatatttatctaaaagaaagacgagaagctttaaatatgatttggaagtcatctaaatgtgggaccatttatcacctcttttctgcatgatataaagatatgttaattttagaaattgatttgtgagcttcccagttcttcaggataacaaaatagattgtcaatagacctagaaatattgaactaattatttattcttaccttcctttttgtgcaccaggtcatgatgattccaatatggtatgtctaaagttacataactctgtccattccaattgtcattgttttagttcaggctaccattattatatatatattcttttactattctaaatcccctgattgggtcttgttagcacagtctcttaccctcaattctctatccccatctccacccaagacatttttccatatagaaattgaagcaaactttctaaaatactaattgctgtgactctcttgcccaaaacagtatttccttgtttttatttcattttgtttttaaactattttgattcctactgcctgtataagtgcagaatttccttctttttaagtttataatcttcaaaacatgagcttgggaggccctattttaacatattcgcattttaaaaataaattatatatatgaacttgaatgaaattcaaacattttctccagccagctgtcccaacctgcctcatcccttgaaaagttatatgaggtccatgctttctgttccctttaagagtcaccaggttatgtatcagatagcatgatacatgatgcctgggacactgtacttaaaaaatatttgttgaatataagaaaaatgtgataaaacctaaaaagtatactatgtttggtcttggagcataagtaatgcataaacaacacagctcttggtacagaattatcctacatattctgaacagatgataaagaaagtgctaaaaaccgtgtggatggaaatatgtagtagatagtcctgggaatatcatttttcaaggacagtagttggaactggagatgatccacttagaaagcagtagcagatgaaggtaacttaaattcatctatttatctgcctatcatcgatttagatattttacatgaattgtcactttttgttctcacaacaagcctgtgtatagttatcatccccattacatgtagagaaaactgagattaattaacttcccaaaggacacataattagtaagttgcagagtcaggatctgaattcagactggtctggtctctttgcaaatatactacagtctccaacacacacacaaacacacacacacacacacacataagcaaccacattatgatcttgtaggaccactccttctgtctctgggctgccattattttctcatctacatacaccagtaaaggtcaatgtttgttcaaattatcagtacacgtttaacccatccacttctaaatgtttggcattgaccccattggttgtgctattagccagctggccagtactcaactcaagcctatctttctaatcaggcattttcctaagttccagtgagcagaatgagaatacagagatgttcgttttattttagaatcattatgcctagacccatgcaagatgaaaaaggtttatgaatgtgtatggattgattgagctacactttaagatcatggtttcctgagaaacgaggattttcagtgtaatttagaaacactcaatgcaggatcatgattagctgttggaagtttagccccattgtattcaaaaaagagtagatatctagtgagaaagacaacgttctagaagagaaactctcaattctgataactactcaatgaacagaaatactgtctttacaaattctttagttgcctcctttccctcattttaatattcaatgcataatcatctggacaatgacctttttaaaatataaagacatcatctctacttttaattttaaaaaagttctaccttccatattttttctttctcccaatcttatcattcagtaccatccaattcattcatttatgtagcttttcttcagaaccaataaattctgagcataatttggcactactttgtaatgatgtgtgtgtgtgtgctgtgagaagtgttaatagatggggaggagggaaaaggggtttatagaagcagagtgaaatttgtggaaacttttcaagtaggaaacattatattttttcaaagatttgtgttttttcttatgagtctcctataaaacccaccaaactattccagccaccactcttagcttctcctattccagaaacttctaatttttttggtttatgaattttacctgttacactcaataatataaaaggttgaatagctttctaattaagctatgacacattattcataaccttaaaagtttaatagctttaccgtatttgattttaaacactgtcagagtgatgcctttggaggcacagtcctcgacttctgataaagccgatcctaacaacaggtcacttactcctgaacttggtcttacgttttgattctttgaccaactttcagtaccaccaatgatttccttaacttaggcttggctgggacctaccatgtgtagataaatctttttttttttttttttttttttttttgagatggagtcttgctctgtcacccaggctagcgtgcaatggcgctatctctgctcactgaaagctccgcctgccggattcatgccattctcctgcctcagcctcccgagtagctgggactacaggcgcctggcaccacgcccggctaattttttgtatttttagtagagaccgggtttcaccgtgttagccaggatggtctcgatctcccaacctcgtgatccgcctgccttggcctcccaaagtgctgggattacaggcgggagccaccgggcctggcctatgtgtagataattctgctctttcatcctcatgatgccacccctggaagccaagctcaaggctggcataccttgtaagtatttttgaaggcaacatattaaaaatggggtttttaaaaagatggcttaatgggactagagctgggtactacttggctctctcagtgagaaaactaatggaaaagaccattgcaaaaatcataacataatatttggatagtcagaactagaatcaaatcgtgagaaagagaaaataaataagtggaaaactgagagatcatcccaagagaaaacaacaattcaacaggatagaacttgtgtctttcatcctttcactcaacaaagaagtattgactaatttatgtagtctgaaatactaaataccagggcaaaaaaagaaatctgtccagcctgaccctttatatttgcacatcattagctcattatatttgtcacatatgaggggctcagttgtaaacaacatagctcttggtacagaattaccaacatttgttgcattagattaagtcactggtaaattagatttagagcatgaaagtgaaaagaataaagcaaaacagtctgttgtaaaaaaatatttctaacctgagaatcaaaacataacaaaaaaaaatcagtggcaacatcaaaaataacaaaaacactgctttcctctcaggtgtaatctgagaagaaatcaatttagggaagggtatttcagagctgttgagtttgggctcattgtggggcatccgtgtacagatgctcttgaaattcaagaaggaaagagctatattcctacaaaattgtcaaatagagagaggtctgccgtcatattagagtttagaagcaggtttcaactcaggttttgtgcagagtcactttgaccttggttcaaagcccagtttagatattgcagagactctgaaatggacaaaaaatgtatagagtcctcatccatggaataaggtgatggtctccccgttgcagctgttgcagtgactgtgagcaactcagaaagctgcaccaggaggctcccaaggagtcaggcctgctgctgctaccttgttatgcttatggggtttaggatgatgtcctcccaccaagccacttacaagcaggaaattagtaactccaaataaaatatgtcctaaaatcgtacatagaattgctttaaaagcctggaaggaatcccagagccctcttgttagccctggacagcactaaccccctcttctgggtgttcccgcagtctgctctggccccatcaccagtcactattgcagtgcagggagtggtgctgtgtttatctccaccacgtttgatgaatttgcgataattacttttactctctgcaaagcctgacagaaattttgacacctagtatgtgctcaattaaattgtgttgatgaaacaaatgaacaataacccgtgccgttataaagttgaggaatctgaaatacagggaagtgaaaaagagagcacattactagtgcaggcagaaggctcaggactcctggatcccagaccaatggtcttttgcatgtaattgctcatgaacataaggagcttatttcaaaaaatgtatggattatctttcagtccaaagtaaatgattgctttcttgagctcagggtctatgtatttgactttattctgtcttctcacagcaagaagcacaaccatgagtatttagcagctgatcaaaaagcaagttctgcatcaatctggaaatgagtgtcaggatagagaagactcggccttcctttcacgactgattttagaaagctgtatttttggtctactaattatgaagtaatgtatcttttagggtttcatcgtgaagaatgggggcagggtcagattcaagagtaatattatagtatttatttttgttattttctaagtgaaattataggtaacaaggggaaaaataattgaagcaaaaggcatgagttgtcatgtctaagcaccgttgtaggcactccacaaaatgtatgttttatatcttttagacaaagtaggctattaagtgtgcaatgctaagaggaattttatctcacctctaaatacaagtgaatcttttaagctccaaatccccacatacagacaatttaccgtggtaatcaagacgatgcacacaattgaacttcagtaccatctgtaactctattggtattttaataataatgaataaaaatatatgttggcaacaaaaaatgttactcgaagtagaatcattttaaagagtcaatgataatttctcaatagctgtgtagatatcatatttacttggaattctctgttgtgcctttaccttgtaattaatatgaaagaagaccttcagtatttaactgtatacatatactgaagaacatattatcccctcttctttgaattggaaatatgaaacaaaatgcttgtccatgcaaatattaataaggaaatgaatgtttcttttatttttctcttcttaccttttttcttttgccttttttctgtttgtttgacttctgccccctgggtgggtagggtttatctaggggagagtattgaagatgaatagaagaaaggcaaaaaaaaaaaaaaaaaaaaagaagagaaattcaaattatcctgaaagttataaactactcttcatcaatgtttttctgttgtccaggaaataaaataatgtctttcacttcgcagaaaaaagatcatccattataacagttgttataaataatactactactaatggttacctgccttctgcaaaggtgccagaaaactggactagggccacctacaaacagtaaggaaacctgaattttgcttccagctggtcaaataattaactgaataatcttgggcagtcctgtcatctccctaagctccccccaaacccttatatataaagtgaaaggcttggaacctgtaatttctgaagttcctcctggttcagaaatcctcttaaatctgtgaatgtaaagcaaagttacgcaaacaggactgggagtatttaaacagctactggatggaaagagctaaggtgcttttggttatacccacagaagtagatttttatctggggggatgatgggagctagtgatggcctttacattataaagaaaaggagtacagatgacagcaaagttatttgttgaagaaaaatggggaatcaaaaatatatatgaaaaaggatttgcattttaaaaatagacttttattgcatcagagtttttttttaagtttaaaaaattcttttttttaaaattattattatactttaagtttcagggtacatgtgcacaacgtgcgggtttgttacatatgtatacatgtgccatgttggtgtgctgcacccattaactcgtcatttagcattaggtatatctcctaatgctattcctcccacctcctcccaccccacaacagtccccggtgtgtgatattccccttcctttgtccatgtgttctcattgttcaattcccacctatgagtgagaacatgcggtgtttggttttttgtccttgcgataatttgctgagaatgatagtttccagcttcatccatgtccctacaaaggacatgaactcatcattttttatggctgcatagtattccatggtgtatatgtgccacattttcttaatccagtctatcattgatggacatttgagttggttccaagtctttgttattgtgaatagtgcctcaataaacatacgtgtgcatgtgtctttatagcagcatgatttataatcctttgggtatatacccagtaatgggatggctgggtcaaatggtatttctagttctagatccctgaggaatcgccacaccaacttccacaatggttaaactagtttacggtcccaccaacagtgtaaaagtgttcctatcagagttttgctataactcttttggagaaaagacccatgaaaaagcttttaaagatctcattttgaaaatactaggccaatgcatctgtgaaatttggttcattcttggaaagtgattcctgggaaatcaatatagtctatcccaagttgtgtgtcccattggaagtgagtatgagagaagccttttagtctctcattatattttttttcttaaaattcaaatacctatcttcagaccccagtttcttcaccccttcttcttttctacattaaacactaatgaatattcacatacacttttggaggaacagagtgatggattcagcattgttcagacacactgttagaagtctgagatgcatgtggagcctgaaattgaaggagagcacaggtttgcttattgaaggctgcaggagcactgagggagataacatgttctttccttgctccccagccatgtgcttggggtagtactgacccagtctccacaatgctgcagacctgcagaggagagaatgaaggcgcaatgtcatctttatgcaggctcgtgtcttcacccattttattacccctccacttcaccttatcctgttcatctggccagttgtaaacctttaatgtgaatgagctatttatgataccaatttgtgggcaagttttgtggaagagaaaaaagatcccagaaataaaatcattaaaatatttgctctcaaatgtagcagatattactgggcaattcatatactgcttcctattctcattacgggctttatacttaaaaggggacattttcccatctattcttattccatctttaaaatgactctatggctggatatgatgaaaatgactattttgcagacagtgaaaataaaacttagtatacctgaatgtattagctggaatcatccaatcaagagaagaaacaaatctaggaaaaaggaatctccaagctctaaccctcaatatgctttccactaatgcagcctatcacaaatcacaaaacaaaacaaacaagtttattgttctcatttatgctagatcattcttcctttgctttaagaatctgatacatattttaaaaaatatagacatttgaatttagaatggttctatcatcaaacccttaacctgtttatgcttgaggttgcaattttttgaatttttgcaatcagaccttggcgacaaccttgagcagtaggatatagataactcccacatgcttagcgttccaataatggaacattaggcaaaaataggcttccattcccgtttactaggctaatttcataagagacttgctctctcttcaacgtaagcgaggttgccaaagtggttcatgtgagacagaagtgacagaggaaaagatttatctgcttttgggggcagggagtgatttcttccttttagatttgagatttttccattcttattacttttagggacaggagatcaaaagttcagatatgtttcccaaaaagccactgttcaaatgcatagggtctatgaggaaagggctgctgaaaaatcttccttggatctttccattagcataaatctatggattgactaatttccaaagtggaacaactgtccctggaaactgagatacaaggcagacatctttcagaggagaaaacggacagtagggaatggcagttattgccacaagttaatgggctctggaagcttagttctcctggaggtcagcacctcatgatggaggggattgcacaggtctggaagaacaaaacttatcacttgcctgagagtctggactgatagataccaattttactggttcgctgtaatcatagtgaaagtctcctaaatttcctcatcagtttatttatttgtttacatctctatatttctcaatggcctcggagctccttgaggtctagactttattttacccaaagctatcctgattgcctctctgagaatatgcacaaaatgagactttataaatattggttggactgaattaatttgaaatgattaggttacttctactattccatgatcattttaacaatttatatatgaatgcgaagattaccaaaaaagaaaaagaagagaaaaataaattccagagttgtttcttgagcaatgtatggttgagttgacttgaaacatatacaggggtacagtcaattctgctacaacacaatatatgcatttgtaaaaatggcttgctaattgtacaataaaaattttataagaaaagatttaggggagaagtagggttaggagtacaatactcaaaaatttcatcagtcacacataagactataaaaacctaataaaatagtagcagagttgtatacatgctcagtgtctaataaatacataactactatatacaatagctataatactttatgttaaaaagagctacaactttccagtggaagtgggtgtcagaaaagctgtgatttcttgttaagtagtggagagagtgttacctgaaataggaggatggttatatctacacatctggatggatgaggcttagaaggcttctgtgaatgtagataccgtattgatgcttaagacctatatatgtgtttgtgtgtgtgtggtttgtatttttctatggggctcactttttttccacattcatctgatgcttcttgatgacaaaacaggcatacgtacatgcaagatctgcattacgttgaatataatttaataagtgattattatatgtttttttctaatatataaataatgcaacaaatatgtgactttaaacaagtgctttgaggtatgtatgcaccttctgtcacctgtatcttctgccagaggtaaaatggtagtgatctgctttctgttcaccaaatgaccataactgccgagaaaccatatctgcgatttttatgttattcttcttcagtgaggatctggctcggttttgtatttgtcaaatacctcaaaatatttttcaacatttgtatttgggaaaaactcaaaatacactttgccagttgattttttaatacacttaatgaacaataatttaatccttgtgtttctaattaattttcctgcagttagttaaaatactgctaagaatttgctgaataaataagcttaatactatgtaaatgttctttaaaaaaaaaaataaatcaaaccaattcttcctgagagcctttactaccatgaagtttaccttcaaactaaacggcacattttaaatttgttttgagtgaggtatgtctagatttcatgaagtcattgttcaatgtcctatgaaattaaatgtgtacaagacaaaaaataggaaaagaatattggtaatagtatactgactaattggctggtagattgactgatcgatcctgcctcccattctttcctttcttatttcattagctcacgatcccattctttcaacaaacctttatcaaaggcttgttatgtaccagattctctgctagggtcccacaaaatgtgtgtcacccaatggaaaatacaaacagataagtgaattattacaaaaaatttagatgaccaattgtcttagaccattttgtattgctataacagaatgcctgagactgagcaatttataaggaacagaaatttattggtttacagttctaaaggctgggaagttgaatatcaaggttctggtatctggtgagagctctcttgttgcatcatcatatggcagaagacgagaatgagagagagaacccactcctgaaagcttttttattaaagctgtaaacctaagccagtgagggtggagccctcacagcctaatcatctctgaaaggccccaacacttaatattgttacaatgacattagatctcatcatgagtttgggaaatgacaaaaattccaaccatggcaacaatatactaagagtgaagagcagttcctttccatgagattggatggtcaggatatcagtgtcaacccggaggggtatatctaccttctcaagacaagcatctttgctcatggccccaccctgtcccacatttgggcctcatcaaagaatccttagaaagaatactttccacatttaggataggttggaaggatagctgttgaagtaaataccagattcagaatatacaagatctaggactattcactactgcttcacggaatagaaataagttctcagaataagtaaattgttttctgaagactttcacacaactgggaataagatattttaagttatcctactcctctagacacaattattacgggagctcttaggaactgaagatgggagagtagtcaaacaatgtttcccccttttaatcatctcgcttcttatagaataatcttgatggcaataatttgagggtttgctcaagtggcttattgaagaaatgtagctagttgggtttttgagtcagacaaatctaggtgacaattctggctgcgctattttctagcattgagaccttggacaatctgcttgacatttttgaacttaattttcctcatctgtgaaagaaagctggacctgtccttcaggggtgctgtgaggagtagatgcagtaacacatggaaaccgggagtacctgaccttgttcagagcaggtggttaataaatgatggtagttaatttctcaacttctcttcttatggaatgtttcttgctaatagaatctggtctctctccctctgtcctcctatcattatagacaactgtgatgatccactagcatccctgctctctccaatggctttttccagttcctcagacctcactggcactcacagcccagctcaactcaactggagagttggtaagtaggctgactgaaatcctaatgccaagcactaaataattacgtggtgggtaggtgaaggagagtgagcactctcagacactgaaatcatgtccaatggccgtcttcaggaaaatatttacgaggagaggagtgaaaatctaatgtaagcatacttccatagcataatagtcattcaaagtatgctgacttgtgttcacccaaatcacagtatccttttttgattatcacgagaggtctttgtgaaaattactttataaaaagcacttgctttatttttatatttccatagctaacataaatagatataaaacatgttttataataaaatatttataatgaatgtttattaaattttctttcaataagtttaattttacttgaaaattaatattgctgatttttaaaatacaaaaatactattaattgaaagtaagaaaatataaataatctgttattctaccagctagaaataactgtagttaagtatatggtgtttatctttaacatctgtgtgaagtaagagcacctccttaactaatctctcatatgaaatgttgttaacaaatatgatgttggatatctaggcagatacgttttagtcagatttggatgttgacttttctaatgcatagatacataggtagataaatactgcaaaagagatttgaattatttcaatttttaaggacttttaggtatctgatagtatcttaatatctactaaatattataaacttttcctaggtcaagaaaagcgtgtatgcaatttaaagagagctacgggtctattagagtttatattatttaattttgagtatattttccattgatatcttaagtaggttacattagcaggtttttgcaatattgaaccatctttgcattctggaataagttctaattggtcgttgtgttttttttttttttacacgctaactaatttaatttgttaacacttgaatttataattttaatctccattattagtgagattgatttatagtttttgcttgtatgtttgtttcctgtttgtcttgtacttcatttcaccagttttctattaaaatgggattcataatttaaaagttagcaagtgtcactggtttgttgagaaagctgtttaagaataatattctaaaaacaaaagaatggccaaagattcaacaggaaaatttcaattaaaattttgtactaatgtcctttgctgaatattctgtgccaaaaatttgattaagcattttagttttattatgatatttagtcctcacaaagttgttgcaaacattattaccttttaccttcaggtagggttcctgaggcatcagtttcccaagacagaaaaactagtctggggaaatgcttgcattcaaacctaggttatctgaattcaaagttcgtgtttatattcatcccgttaacaaatcgcttcactagtacagattgaaaaggggtgtagcagcaagaaaataaaaactaatcaatcaaccacagttcaaatgcgagctatgccacttaaaaactctctgactgtgcacaagtcacttacctctgccaacctcagttttttatctgtaaagtggcccaggaatgtctgccttgcaacattatgtgcagattaagatcagacttgcatatccaaaatatctttcttacagcagggtagagaactgaactggagcaggaagcccactttccatttcaggaagaaacacaggttggcagaatttaacacggtttccaacagagcttccagagaaaggagttgtctcgatcccacccaaattgtgcagcagcagaaagcaattactactgcctaatagctcctgagcagtttctgggggaagctgtgggtctgatcacaggccggctctctccctgacagacagatattgagtgaggacaagtgtctttgctccaacttattataatttttcggctcaccggggaatttgagtgcctgaatccaaggctagcataaatgtacagagaggttcacttttcttccgtttcccaacaagagtctaaatcagaaaggccaagcagaagacatagtgatacagttgggatgcactgacctagaactcatcctctagtgcatattccaagactcccaagggggacagcctctcctttactcaccgaggcccaaccacggccctcagtgggaattaaacactggctcagggagatacggtatcagtggttctcatcccagggctgtgcatttgaatcacctggagagctttgcaaggagcattgcctgagcccatttttcctatgttctgaattaattgtcttggatgggacccaagcaaggatattgataaagtgaagaaacaaaagcttccaggtcattctaaaatggaacaagagttgcaaattgctacattggaggaattcatgagtaaaaaatccttctattaataattattgagtcccagtatttgtcaggcattgttctagatccttgacacacagttggcacaaataggcacaaacagtattcataaagagctgacatggataataccattaccatacaattacaaactgtgatactgatcaacagctaacatttgtcattagtaataatatcaacataattattttgttaagtatgtccagatatgtatttctactataataaaccatgtatatgtgatatatatgtgtatataatatatagagtaaaatgtatatatatatacacacacatatgtagttgaatatatacagtcagagtctgtcatatacaaagaggtggatatatacaggtttggttatataaatatattcatacatagtaggatgaatatatatgtttatatagttggacatagtaacatatacatgcatatacagtcatgtacaaatatatacatatgtggtatacagatatattaagataaaacttgaaagtcattatattaatgctattaagaacagattttgtttcatgagtggaaaaatataacatttagaaagttaagaagaaaacttataatttttgtttatattggaagtatcagtataaaatactgatttatttgcttccttttaagaccaaacttatgtcctgtctatgcactgacatggcttagaagcaattataacactgtctcaatgaacactcctttttaatgtgtcttcctttaaaacttatcttttgttttacaaagaaaaaacatgcaatatatccaaaagagcaaattgtaccacatggtttgaaatctcagatgctctcgaatatacatgcagatgtaaaggagcatctctccggatggtgagattgtgtgcctaagaattacaccctccctcttcccctggttgtaagctgatgcctggcagcgcacaactaaaaattataacaccactatattgagaacttcccatgagccctcaatgttctgagcccttaaggtacaccaattctatactcacaactaccctttatgtagatgtcattgtgatctctgattcataggtgacacagagaggaaagcaatggccatgcccggctttcacccaagtgatctgaatctgtgtagtgctattggccaaagcaccacaacactatcctgcccagagagccagaataacttcagtgttttagacagggaaagctgtgtgtcatttttattagttcacttacttccctccctcttatgtgattgaagtataattgacaaataaaactgtatacatttacagtgtatgaaatgatgatttgataggtatgcattttgaaataattaccacaatcaaattagctaacacatccatcacctcatgtagttatccttttctttgttttgtagtgagaacacaagacctactctcagcaaaagtcaagcatacaatagagtattattaactatagtcaccatgctgtacaattatattcagagaatgtattcatattagaagtgcaagtttgtaccttgatcaacatctctccattttcttcacaccccagtccctcgcaaccactgttccactctctgcttctctgagttcaacatttttcagattcctcatataagtgagataatgcagtatttgtctttctgtgcctggatatttcacttagtacaatgcccactaggctcatctatgatgttgcaagtggcaggttttcttttttatggatgaataatattccattgtataaatgccacaattttttatccctttattgatcaagaaacacttaggtcgcttccgtatcttggctgctatgactaatgctgcaatgaacattggattgcagatatctctttcagatactgatttcatttccttcagatatatacaaagtagttgtattactggattttatggtagtttcttttttttttttagaaacctccataccgtttcttataactatgctaatttacattcccaacaacagtgtaaaagagttctgttttctccacctcctcaccaacacctatctccttctttataaagagccatcctaacgggtgtgaggtgacgtctcattgtggttttgatttctattttcctgatgattagcagtgttgagcatctttctgtgtgcctgttggccatttgtatgccttgtttggaaaaacgtcaatttagtcttttgctcatttttaaattgggttatttgtttttttgctactgagttgtacttgttctttaaatgtttgggtattaaccccttatgagatattcggcttgcaaatattttctccaatttgatagtttgccttttaatttttttaattctttttcttttttgtacagaaggtttttagtttgatatagtcccacttgctcatttttgtctttgttgtctgtgctttagatatcttagcccatttcagtttcttatacaagaatagctaaaactgggtaatttacaaagaaaagaaatttatttcttacagtgatagaagttgagaagtccaaggtcaaggggggcagatttggtcagggtcctcttgcttatggggactctgcagagtctcgagacagcccagggcatcacatagcaaggtgcctgagtgctctaacatggtagctcaggtccctctccttcatcttataaagccaccagtcccattcccatgacaacccatcaatccattaaaccattaatccattaattagtaaatggattaatctattcatgaggtcagaatactcatgagctaatcaatcatctgttacgggctgcacctctcaatactgccacattggggattaagtttccacatgagtttcacaggacaaacgttcaagttatagcagtgtcatatccaaaaaagtatcatttactttggaaagcaatgagcaatcactctgagtgtgctgggcatttctccactctgccttgttcaatacactgagccatattttataatattctgcctcaacacttcaacttccagcatgttctcctccctaacagatttgctaataaatgcagtcacaatggtctgctttatatagcctcattctattctctcttccaagagggtatggtgaacctgcctccttcagatctactactcaacaccaaatccctgccccttctaaatgtccaaacaccagattttacacacacactccctctctccctcacatacacactcacaaacacaaacatgtgttcggaaaaagagtaggtactaagatacacatgcattattttaattcccagggaatagtttaaaataagtaagtaataaatacttgtcaaagtataattttcaataagttaaaaacatagctctcatgcaaatataaactcataggtcttatacaaatataaactcagcacatcgtgtgtatgtgtgtgtgtgtgtgtgtgtgtgtgtgtgtgtgtgtgtattaaacttattaaggcaggaaccagtaaaatggtaaagctaattcaaagagtattttttgggaactgtgtattcagagacatttggtgagggtggggggaggcggaagaaaataatattggaataaaattgctaggtagatacaaaattagttaatgtatgtattagtcaagattctccagagaaacagaaccaacgggatatatatatacacatacacatacacacacacgcacacacaaatacatatatacacgcacacacacacatatacacatatatatgaaatcatttattatgaaaatgggctcacatgattatggaggccaagaagtcccaggatatgctgtctgtaagctggagaagagggaggctggtggtgtaattcagtctgagtccaaagatctgagaactgggggaaccagtggtgtgaccctccatctgaggcccaaggtctgagaaattaacgaaccactggtatcagtcccagagcccaaggacccaagaacctggaattctgatgtccaggaagaaaagaagatgaatattccagccccaggagagagagagaaaattcagctttcctctgcctttttgttctatctggtccctcaatggattggatggtgcctgctcacattggtgagggtgaatatttctactgattcaaatgccaatattttccataaacaccctcacagatataaccaaaaataacactttaccagctgcctggatatcccttaacccagtcaacttgacacctaatagaaaccatcacaatgtcttacagggttataaaacttgggggttataccttctctattggacacacatttataagttagcatgtgacaacttcacagtatctaagctctgatcacccaggaactagccaaaccaaatgacatgtgcatttttctggaaaattaaataattgttaaatggatttgcttcaaattgttccaggaggatactgaaagatcatactatattttcttatgatttcaaagctttagatagtgttttcttaacacatttattcattggttcatttattacagtaattagtgaatttcttctactctacaccattcagccttccaacactcttgtcaaggaacatcctggtatcccactgggtatcccactcaagatgaaatttaaattgtaaaacccatgaccttcagagcatcaaatccccctcaaaaggatagaatgtcctcaataatatccttgtacctcatcactgctgaactatttcacactgatgagctcccctgcaagtttttgggcatcactgaaaattgctgagtcccttgatgattatataaaaccttggcaaacattgaacataaaggactagggaacactttacccctacgtgtgctcagaactcaggtagactcatgtctgccctatacccaggaagaaagtgtgcgtaactgatcagtttgccatagcagaaaagaccaactcaaacattgaaataaagactaaaggaaaaatgtgctgggcaaatgttaacctatgagctcccccaaccctaggtaaaccaagtttaatgagttccatcaataacaaactaatttttctgagagaaaacacacacttggaaacagctgttgggctgtaggtattgctgtgcccatcaaggtctgggcaatccggcacacgaggaggggattaatagttaaagctcaactataatagtctccatgctgctatctcatcgatagaagggatttgccaaatagaatttttgttctctcacttccacaaacacttcagccttcatctcatcacacacaaaaaaaatgaaaagcaaggaagagaactaattacttttggaaaaaagaaaaaacaaacacaacaaaatacattaaattggaggtcagatcaccattaacttaggttgccaactcaatctatataattgtggcttaggacggatcagtctttgtcaaatatgatttgttttgtggcaagaaagcttttgatctcggcattagagtcagctgggcttcagagaaagacttactgtccgcaggaagtgcaggggttggtggtatatagcatgaagccacggagttgtgggttaggccttcttgaaaatgaaggggaaggatttaagttactttagatgattaaaaggaaaatagaaatagacatctttggccccatgagaggagaggtttgtatttttctattgcatgttttttttttccaaatagagtttggaaaccattatgtttatcatttgttccttgaaattttaatccgtcttcctcactcaatgtattttttgagatgcttgcctgtgtaagttgagattgtgtgtttctagcatgacagttttgttgccatggagaatttgatttcttatgtcaaggcattttcagctccctgggctcatggatggataaaaagatttaaaatccttacctcccgctttggcacagattccatgcacacttaccaccccccataccacttccttgggcagtacttgttacaaattgctaaggaccctaaaggtgttctgaagttggttttcatcttgatgtcatcaggccatccatgaggagatgagggttggaagcaagcaaaaatcagggttcatttgcacaattagcatttcagctgtctagggactttttccagattacaagggaaaatcctgggaacccaatttcataaacaacactacaacgtctgctctctggaggcaacatgagtcttctctctggatttattaagccccatagaatatatatctaatctactctgttttattttttatttatttcttttgtgtgtgtgtgtgtgtgtgtatatatatatatataaattattattttttttttcttgagacagagtctcactctgtcacccaggctggggtgctgtggcatgatctcggctcactgcaacctctgcctcccaggttcaagcaattctcctgtctcagcctcctgagtagctgggactacaggtgcatgccactgtgcccagctaattttcatatttttagtagagacagggtttcaccatattggtcagactggtgttgaactcctgaccttaggtgatccacctgccctggcctcccaaagtgctgatattacaggcgtgagccactgcgcccagcctctaatgtgttttaaaagacagtaagctatacagaaatgggtcagtggattaccccctctccctgtgaaccacccttctctcttttcagcacctttcctttcttgtgtcctgtcctagctgtcccaggcatggtaagcatccaaatctatgctttcctctgtttcatcacactctcccttcccagtcgaattgtgtatggtgggtagaagctgggacatccaccaggagcttgttacaaatgcagaatcttggcttctacccagaactcctggatcagaacccgtgcattaacagctggtgcttctgcaaattgaaatttgagatgcagcattctagaggatcactgaaccttttgttatttcagttctcacctctatgacttatttactgtggatcttaggggtaggagagagtagaaagaatcaaagttggctaagttattaaaaagaaggaattgtgttgaaaacttttgttcttcatttctgtcatcacttcagtactctggtactcatttttctcattttttaagatggagaaacagagtcagagaggttaagtcagtggcccaaaactacacagctaattttggtagggcttgaatttgaatctaggtctgtctacttcacattaatcaatatctttattgatgttgatgtaagatcttagtctgaataaagatgctcttgacataattagctttcaggtaattttggtattcccttagggttctcagtattttaactaaaataatagattttcagacatcaaggaagaaagagaaacctatatatcttgccttttgaatgcccctaaaatcatactgtgtggcctaatatgcctgagggaaaaactaaccttgacctggatatttaaacaatgccttaggcctcttcttttactaggacagctatagatcattgaaagatacaggacagaaaccttctgctatttaacaggagccttgggaccctgtctcaaattgagacaaattcaatgtgatagccctctattcaggctggctaattgcaaaaccacatgatgaggaggaggagaaggaaagggattatagaaaatttgttactggctactaatcaaaagatttgaacatcaccatttggcacaaaaaaaaagttccaagaaagaagcgaatttcatgtacttcatcctttacttttttttttcctgattgtaagtcacttcctttgaaaggccaggttgcgatgacttctaagcagcactccatgaaatgcagtaaaccatcactttgatgtttctaacactttgcaaagagacaagagcttctttaattcattagttcattgaatttaacttaaagcattgcaacaaaactgtaagaatagaattaagagcatgattattagtgacatatttgtctagtgattggcagtttataacagcaatttacaatgtcagtttacaatgttttcaatgtgtgtcacatttaggaggaaataagctatgttcagctggaacattgtgtggtagatgtttttccttcgtctaactgggaatagttagaaggagtctactggatatgttgttggatactggagtcttcttctcgagaagcctttcatttaaacattgtggacatgtccttaaaaacatgagtttaggtttactgaattctccatgagaagtgaaaatggcaacatataacaaacgccaaagaaacagaaaatgggagttaatataatcctttagttcatctttctccagattttcaatttgaagactccttctttcatggtgaccccctcctcatttctccttttgagtatctcactccttgcttatttcagttatattcatctacgcaattggttgatcatgtctggactttaattttctagccaatgaaaatgtttcattaaaaatccagatttgatcaaagaacttttatcatttgttttgctaaggactggcttctaatgaatcttttctacaaaaaatatccatggcaatcagaaagcgttctggggtatctttattggtgtgcttctgtgtgtaaataacagaaaatccagctcacactggttgaaaaatattaaattattcagattaggcacataaagattgaaaggtgttcatatttctatttccagaacagggtggttacaagatcctttaccctataatactttattaagctgaacattcattttgtgagactttttgtatctgtgggtttttttttttttcattacaaaaggattaaaggtaaaaattaattattaaaaacaaaaggaaattctcaaaaagggcaggctccagggctgccagatttaattcaacaataccatcctcagtggcagcattgtcctggaactgataagcctgcccaacatctcagccagctttacaacattctgggaatcaatgagaccatgacctcctgtggcttgttttttaagctatcagagtgtgagccctggaatagcagcataatgaacatctcctaggaacttgataaaaatgtagattatctagactcacaccaacctactaaattagaaattctggcagtagaaacctatgttttcccaagttccttaagtgattctgatgctcacaaaactttgggaagcacttcttagagcactgaaactcttcaaggatccaagacccagaatcaccctttcctatttcaccagcttccacaatttggtcatctgcccagtcctgaaacaatcacagtcaaggaggatggaattaccatcgctgaatttacattcattatctgatagagaataatcaaccatgtctataaatcttcattctatccctttctctctccctttctctccttctctctctcctctccttctctctttcctctttctctcctttctctctctctctttcacagtaatacaattcaatacactcatatttaatcattttgtgtccatagttgtgatgcctgtgagtttatatatatatatatatattattttatccatggtatggtagacactaaccatactatttttatagaagtagggaaatcacttatccaaagtcacaaggtagaaagtgaccttttaaactcaaaaacaccagaattcgaccaggcactgtcttttaaaagaaaattgctccaagaatccaagttaaatgtaatatgctcaactgtgcataaagtatatactgctcatgagaaaaaaaatgtaagtggtaatgtcatcaatatgagatctgcagtttcaaatcacttccaattccagttctcccttttccctttgataatcttgggagagtaatttttttccatatgcctaaaaacaggaacagtgttttaccttgctgctgaatcttctatatatatataaaatcaggtatacataatccactagaatccactaacaatctcttagtcctgagcagcagatgggcagagttagagtgtattgatttgccaagttaaaattgaactgagcctctactcattttataagagaaattttacaacagcactggccgatagaaaattctgcaaggatggaaatatgtgtaagtgtgctatgcaaggtattcactagcaacacggctactaagtatttaaacgtggctactgtgactaagaaattcaatttttaatttattttaagtgaaatttaaatttaaatattcactaccatattgaacaattagttttaaagcctgtaagttttatatacatgacactcccatccaagttttttaaaatgcctgggtgtttttatgcacacatgaatcagcccttggtctgtaggggtcatgaatatggaatatccatcttgggtctgaactccaattcttcccagcccagactgccctcctgccaaaccccctcacttcttttataacttctgaactatgaaacaggcagacagacctcctttcctgctccatcagggccttgattgctccatttttccaaagggaagatatttattggaggacatcagcaaaactgtcttgagtactgagcgtctttcaaaataataacacagctttctcactatagacactgacagacacaccagtgtgaagccaggttcacacactgtctcagaggctgttcgtgctcatatgcctcagacttcaccatttcagccaaaagccagcatcttggaagctgagcagagacaggactttttgtggaagtaattattgaggcggtggtctctggagatagggcctgagggaagcagggtaagacagaggggaaagctagcaagagtatagtctccactgaagtcaaggttccttcagatgccacaaagatgttctagacctcagactacactgtaaagtctgtcatgccttgagacactgggaccagccttttgaactttgtatcaatctgacactcgctgagttgaggacatgggaagtgatagctcccaggcaagaaggcttctctttggccaaggacaaatctctggaaaaggggatagttctagttgtcatctagcactcacagctgaaggatgagttcacctgctagagaggatctggatagagacctgagaacatcctcaacaagaccactttcaaccctaagagctaagcttctcctctcggtgtttctctctgtgctttagatgccaccctgctcttcagaagctctcaattaatacctgaccaagttggtgtataaaaaccccagctccctcccactcaaatgagataaccctaaggtgcttcctatcccactgggatgaaactcactcacagggatgatgtcctgatgatgtcccatagatgggctttcctttctgctctgcctcatcttcctgggatcacttcccaaatgaactacttgcattcaaatccttgttttgtaactgacttccaggaaagccaaactaagtcatacacagaatcactctccctagacattactcttttggcagccatcaactataataaccgggtctgattattatccaaaatcaccactcccttaggtgaacctcctcttaaaagctcctttgttgttttctgcagactggtctcaatcagggtcattccagattttcttacaggtgtttatcatttttgcaacccacatggtgcatggtgtgttggcaagttcccacttatttatttatttatttatttatttatttatttatttatttagtgatgaagtcccactctgttgcccaggctggattgcagtgtcatgatcttggctcattgaaacctctgcttcccgggttcaagtgattctcctgcctcagcctcccgagtagctgggattacaggcacacatcaccatgccctgttaatttttgtattttgagtagagacggggtttcaccatgttggccacactggtcttgaattcctgacctcagatgatccgcccgccttggcctcccaaagtgctaggattacaggcgtgagccaagttcccactttattttcccctggttaactccttagtccctaattaatgtggaactggaagtgcaggaggcgtggcctggaccaggctgcaacaccttagccttcctgcacctgcccaggagcagaaagattacgcccagggttcttgccaacagctttcctcctcaaagattcttgcccagccacaggtcctattacacatgggtgatcccgttctacagggaggagcaggaagcccttctgagtgctacaagcatgtctgtgaatgttgttattactcttacacatactgcataatgttcgatatttatgggagagcctctttctgttattcattaccattaccaggtagctgtgtccctaaaacatctagaacttttacttacagaggcatcgaccatttaataattaaagatgtggctagtgattcaagttagcctcacagtaatttgtgagaatatgcttgtagtttcatagggccttctggaagacagcagaagtaactgcctgggaaacttgtttcctatagggtttattttaggctttaaaaaaaaaaatggtcaggctgtatttttaaaacagattaggtgtggccaggcatggtggctcatgcctataatcccagcattttgggaggacgaggcgggtggatcacctggaggtcaggagttcaagatcagcctggccaacatgatgaaaccccgtctctactaaaagtacaaaaaattagctgggtgtagtggcgggcatctgtaatcccagcttctcaggaggctgaggcaggagaatcccttgaacccaggaggcagaagttgcagtgagccgaaatcacgccattgcactccagcctgggtgacaggagcgagactctgtcaaaagaaaaaagaaagaaaacaaaaacacattaggcatgaaaatgctatgctgctatgtgtgtgtatgacgctttcaactccagttggtcttggactaaatgtactctctttttttgaaagacggttgtgaaatatcgttttgcagagactagtatataatccattttgtgcccatttccagtgtgtggcatcaatcacttctcatttccctttttgagttagaagtggaaataagtgtagaaactgaggaatttctgcattttctactggttattctgcttcatgcttacagcctaccctagtgtgtgcagtttggaatgcaggattagcaataagtgtcttggtatatagaagtgagcatggagtgactgggaggcaggagatctggttttgttttgttttgtttttcttacttaaaactgcagctgggcatggtggctcacacctgtaatcccagcactcagggaggctgagatggggggtggatcacctgagatcaggagttcgagagcagtctggccaacatggtgaaaccctgtttctactaaaaatacaaaaattagctggatgtggtggcacacgcctgtaatcccagctactcgggaggctaagttgggagaatcgcgtcaacccatgaggcagaggttgaagtgagccgagatcacaccattgcactccagcctgggcgacagagcaagactctgtctcaaaagaaaaaacaacaacagcaacaacaacaacaaaacacaattgcttagaattctccatacaagtctattcttgctttcttaagatgttggttcctattgaaacctcaggcagggacttgaaattagaactgggttggagtgcagtctttagccatacatctgggttagctgcctggcccattgaggctgctttgaaaaaatttaaaaagggctactgctgatttccatgagaatcaactgagatactggaaacaatgtcaaggtgaattatgtttctagtgagaattgctcttatgaggaagcaggaggacaaggacctgagggatttgttggtgcacttgagaggccgcttgtagcccagggaagacctgggtgctggatgcaggtttcctgggtctggagctcctgcattgctacttcctagtttatgatcttggaaatgctacccactatcctgtttgcatgatggagatcatttgagaatctctcatctagtgtgacatcaggaacagagctgggtcttgaaccagattgcctgacttttggtacagcatctctattccatctattcctccaaagtcaaataatatagtttgcagagtatgaggcttggagtatgctagaaataactaagacatagcctccaaatcattttggatcttttgtttgtcaaacatttaaacaattccagatgttctctaaggtgagattattttctctttaaatgcaagtgttccctttaagtgtaaacttctttaaatatcctttaaatttaaactgcagagtttataggaatttttgtagttaatagccattgatacatcagccaaaattacagacagcattgcctcagtcaacaccttcaacttgccaaatgcacttatttgtatgtatgttatacccccaatttagagaataattcagaaacaagaagctagtgtaggtgcagtgcgtttttatagtgactacaaatagtttcttcaggctactttcatcatttgtgaaagcacatttattgtttggtggaaagaatgaaatgtttgccatagcaaccatggcaaccctgggtgtcttccctattagctgtaatgcggggagcatcttcaacagcaggaaagagtcctcggcaattatcacccagatagcatccctccattttaaaagctttggctgaaactcttgggctcagaaaatttttaacatgatgtgttgatgaatggtaacaacagctattccattttggttaatttgggggagattaataagctaagtttttttactgtgggaaaaagggagctatgattttctttagacaaatttgcagaaactttaatgctaaatcattctctatttttttgttttggtttgtcttggtttggtttagctttgatcagtcttttgttattttattctttgcaagctaaatttcttgtcaatttatttccttgtttccattcttcatgtaagttcttatcatatgctaattagaatagatgaaggaaaaactttaaagcatgatgaggaagtctagttgtgaactattgagggtaaaagagaaacagttaaggcttaagaattttcattttaaaaataatgatggtcacagaaacagcaaaagtcctatattatagcatcagctcccaaattgctgtacatattctttacgcaataaatcacatatgagtaataaaattctcagcttataaaagaagaaaatgttgataagggaaactatgttatatgcaaaaatcagaagagtataaaatcactcatacattcaccacagacaaaatcgccatatacatttattttctatcatgttttaatattgctgagaggggaccatttcaacaacattttttttttttactgagaaagaatgcagcctcatgaactgggcagcagaagacattgaataaaataaagaatatgtttagaattattttggattttttgaaatataaaacctccctctctataagcctctctgtcaattttgagaagctagagaaaggcagaggggaatgggaattgtgaatatgttgaggaagacagagttgaatgacaaaaatgtactcctagatctggcatctcagaatctctgctcaaatacctacttccagtgattttcctccttactaattttctggagttttataaactgttttttttcctgttgaagaataattgcaaatagctggatttaccctatgttttaatcctgggtgccaaattttccaaacttgctggacttcagtttcctcaactttatgatggagataatgctatttacttaaaaggatattgtatatttattcaagtagacaaaattgcagtgtcaaatagagtccaatgcacaatgacttaaacacaataagtgtttagctctcattcatctactaggtgaacgtgttcaagtaggcaagtactttccttcatgtgatctttccatactgtgattctgccatcatctagatcttgttgtcagctgcatccatcagtggtggaaaaggaaagcaagtggagaaggagcacgctagcctggaagtggcacaaattattcccactcacattcttattggagagaacttgaccacatggccataaccatgaaagtatggaaagctgaaaactgccattaagccatgcactcactgcaattctactaccaaagaaggaagagagaatggatattagtgactatctgccataactgccactgtattcataaaaaacacttaaaaatcacattccacaatagatgctgagcacattcccttccccttctttcctgcatttgaatcttctcaggaatggtgagaaaaaaaaaaagaaaaaaatcaaaacttttctcaaacaaaatctgctaagggctagctgcttactgaagaaaatcaaccacaatttgcaagatgtgcctttaagtcctctatttttccatccttaaagacagaataggattggctttatgccctctatcactctgtctgcattgcagtcctgtactatgagagactctgcaggaggagctggggctctagaaaactctcagttaccaaggagatgtccaaatgacttcttccaaggtggcgagaaagtagactgaaacatcgctaaaatgattttcaatgacatagattgaaagaaaaaggttattgattaactcctctaaatgaaaacttcaattacctctccctacttgatgtcctgagttgcttctatgctatctctacccatggcataatacagtctgcgatagctcccacatgggcttcagaagatttgtgaaacttgggaacagtagaagtgaatattgtcttttttactcctatgtgaaataaaaacagaaaatttaggctacaagtctttcaactaagagagaactcacattgatcttctgcaaacctcaggtgtgatacatacaaaattctcgggccaaaacagtttttgtatgtgtgtcagaatgcccctacatgtcaggtatactgaatcacacgagatccaagaatgttagagactctgtcatgcctctgagattttgtgtatgttgttccctcttccctggctaatctccatcgaactttccaccttttttcctaggatatggctgcacttgcctcaggtttcacctctactattgctatctctagaaggcctctctgatcagctcctgaggcattctgtgctctgtgtacctgctgtttacctcttgtgatggtttctttcacatcacatgtttttgtcagcctctctctctctcttcagcacccagcatactcctggtgctcaacaaacatctgccgaataaatgaatgatactcttcaaaggcatagtcggtgtcctttcatctttgtatctgcagcacaatatcttgaccatgataggttcatagtaaatattcagagaccgaggagagagaaggtaatgaaagaacactaaaacaaggaagagaaggaagaaaagaaggaacgatatattagtcagagagagagagagagagcacatgtaagcctagttcatatatatctgcaatcaaaggctgaagttgtaagaagagaaataaataaaacaaatgtcactaggagtttgtaagatagaagtcataatgactaaggaaatagggatggaagcatggaagatacagcttctggcatgagtcttaaaccatgagagagattttgatggaggtggagaatggaaagtaccagggggttaagtacagaggcagggaagagtagggcccatttgggggtagagtcatcttagttgaacactgtttcatttccctttgatagttgaaaattgtagctatgtgagacattactacaactctctctcactctctctgatcctgttccaggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctgggtaggacatctttttccttccaatgaataaaactgagatgtgctaatggtaaccagagtatatttccgtcattttccaatatccagattgttggtagtttaataactggtgagtgcccattagaaataattagacaatttttaaggcccatgcccggcatggttctacttcctaggaaaattaggatgtctgtcgcaaatagtttagtatgttcccctttttgtagtaaactgggtaattcactgactgagcctcactttcttcatctataaaaattaattaaaaaacagataaatgtaccaaaaagtacgattattaatgtgattatactaatttactgagtgtttattgacttattagtttattatatgccaggcacttcacatattttgtaacaacacagctagctcaattacatcatttgatcaacattgcccaatgtatgaattgtgacttggtaatctttaaaatctggcctgactttaaagccacgaagcagcttctattgtagatttacaaataattgaaaactaaaactacaaaacaagtagaaaatttagaattattctgtcattggaaacaatcttcagcttcagagtgaaggacagtttgctccaagttacaaaacagaactttcctccccagtcccagccccacactcttgacctcactgtgtgggtgaaaggctgtcagcaaattattaatggaggaaaaggtggaggtgaagcagatagcaaaagtcacctggaggtagcttcagaacctcaggcactgaataaaataagttgtaagtttatattatttttcattgagaaaataagtcaccattttttaatccaaatgtgtgtaaaatgtgaagatacggaaattaatagcatattctttccttttcagattctgtcctcttaaatcaatgccaatttatactttacattagtgttgtcttcacattcacattcccatgttggccccatctccctgataaaaatgaaataacttctgttttatatactcattgttatttgttaattgcctacccatcacttggggttgtaattgaaaacagtcataaattgaggattaaaattagttatggcagactgaatcctgagaatagtattaatgtcatctttattctgggtcacttgtaatattaggttataatatttataaagggcgtaagttttcttcattttcaaaaatagtctaaacagtgagtatacatggaaacaaagaggggaaaatagacaccacagcctacttgaagggagaggttgggaggacggcgagagtccaaaatctacctattgggtactgtgttcaaaacctgggtgatgaaatcatttgtacactaagccccagggacaagcaatttacccatgtaacaaacctgcccatgtaccccttgaacctaaaataaaagttgaaaaagaaaaaaaattgtattttggggactattttattttttctcaattttgaggtccccataaattattacaggttttcattttgtttcacttttagtttgagataagaaataagcacaccttccattttgaggaacaattttaaggtttttatgttgactttagagggacaaatcgatgtgggattttttgttttctctggtacttgtcattgggactggttgtctttagattgagttgtagctttgagttattgtgcctaatttttttgtttttaatcatgagtttcatcttctttagaaccaaataatctactttcagcttagcccctgggttgggatgtatttcgagggatgacaattcctctgggctcatgagcagggggcacaaagcctctttcacttcctcacccttgtcactttccctgtgtttctaaatgattccaagctcctcaaaggcagggatctctttatatgtccatttagcccctgtgcccggtatcactagacacatggcaggaacttattttggggtgattattaagagaactgcagaattactagggctccctgaattgaagggtgggggcaggagactttccccattccctaccttgcatcccaaacagccttgacatggtagggcaggtagaagttgctggatgggcagagaaggaaaggcagggccctccgtctacagtgaggcaggaaattccagcaacagctccccagagatgcttgcagtggctgcagggcaattgggagagaggcagcttcaggagcagccttttactaagtaagtacagggagaagtgatttgaggagggaccattacaacttccaatttaaagagtaaaatagagtggcgttaggcaggaataccatgaccggtcatgtacagtaactaggctcaaccctggaaaaataggtgtccccttaattaatactgggataactaacagttactaaacacctattacacaagatatgtaagcaaatgtaattctttatgtatattaaattgtcattctataaactggtgattcaatgttaacatctccaggaacaagaggcttgaggctcacagagcccaatccaagctcacacaaccagaaactggtggcaaaatatttcacaactaagatttattcctaaatatagttggttgcaaaactgtagtttctgtttctcttttagtacactgatttattttttatttttattttttgattttcacagaattgatttacttttctcacctcaaatgtcaactttgtcaagccaactctttaagaataatatgaagccctattgtttaattcacatgttgctaaatataaaagtgtgaagataccaataatacctatttgtatttgtgtatgttgtaaatagtgcttggactctctaaaaccctctaggctttcagggtgttttacaaacacttcacagaaatctgtgaaatttgccttgtggctaactaatatttattggtgatttcatcagattacgctgctggattaaagagattatcttgagagcttttctttttactttttatttttaattttaaattagaattaagactctgggtccaccaaaactaagccttataactaagacaagaacaatagtcaaacaaaaggttttgcaaaactgtctaaattgttttgtttaacttttcagaaaaagtcaatgtctaaaacatcaagtactggcttaaaggtggtttatcaagaaaatagagaatatatacatatatatctgtgtgtgtgtgtgtgtgtaaatatatatatgcatgtgtgtgtatatatatgtgtgtgtttgtgtgtatgtatatatatacacacaaatatatatatacacacaaatatatatatacacacaaatatatatttatatacacaaatatatacatatatatatatttggagaaagggtcttactctgtcactcaggctggagtgcggtggcacttatcatagctgactgtagttttgatgtcctgggctcaagtaatcctcccacttcagccttcaaagtagctgggactacaggcatgcaccaccacatctggctaattcttttgaaatttttaaaactttcttcttagagatgggttctcactatgttgcccaggctggtctccaactcgtaggcccaagtgatcctcccaccatgacctcaggtttacaggcttgagccaccgcacctggccaatgaagcagagaagctcttgaatgcttatgttcacctggtcttctgcggaccctcaaattttagataatatatagtttgtagtgctctttaaaattgatttaccaaacaatacatagcacatcctgaggatgggacaatccattcaccagtactgaagagatttattacatttcacaaggttcgcttcagaaaaataatcctaaaaggatacctttgcaatgtacggtagcaatttttcatgccctaaaaatccaatttggagagtttctgatctggcactgagtggaatgctcatgaatgaggtcaccaaacagccacttagtgatgcaccatgatttatgcacaagccagagtccctcgcttcactaaataatcaggcatgaaggtgtgtcagggacaaaccctgcaacaatgttcagaatcttagcagctccaaaacctcttcctgattggtgtgtagacatgccaaatcattacaaatattaaaattccgactctgggcagcaacatgagccaatgcttggtaaagtgggtaaacttgtttggaacaaaggaacctcttaactaagtccactcagaccaggtcctgttaacagtccttttgaaagatatgccagaagaaacatgtactgttcatgttatatccatgaataaccacaatgttgagccctttccttcatgagcacaattcccacactgtcagtgagggtcttctgccctaattcaatgtccccacatcctcagctattcatcacatagctcatgtcagtccccttctctaccctatcatctcctgtgaatattctatattttattaatattaaacttgcagttttctcttattaaaattatgttgcctctccccaaacagacagccatatagtcctttattatagacgcttttggcctgtgcactctgatggtctgtgatttcctgtaactttctggaatctgtcttaacatgaaggacttgcatttgttacctggcagttttctcacacagaggtcaattcaagcaatggattatacattttggtcatcagttccccgatttcatccttgagtgacttccaaattctctgggagatgctctctgatcttcatgatttatacacatttattctgccacgttgggcctagaacatcctgagtattgatcactgtttgatatagtattttaaccctaccaatttcagaaaacaatttgagagtgagaatctcatcaccatcaatatatatcttttaagctctcattatatgccaagcactgtgcaaggtgctaggcttacaaaggggcttaagcaatggtttttcccatttctgggtgtgcagaaccattaaggagacaaatcaatggcatgcaacacagtatatgtgtatatggtagcacggcagcagttcacatgcacgaagcttgtcagagagggtgttcctggcaatatatgaatgtgaggggcttagactacttgaaccagaagagaccatatttaagttatgttggcttgtcagcaactacagagtactgtatgtgtaacaaaaattcaataaatatacaaaaaaatgggaagagaaaatggtgaaagtgaggtgcattcacagcaggagaaatgctataagcaaaatcttaaaggaagatgtattaaggacacaaaaaaataataaattagatataagatatagctggttagtgatagaaaatgaatttgaagagagagactggatagatattgtagactaagagcacactcgtatctttttaagctaatacattattatttattagccattgtaacaaagtttgttaacacttctctgttttaattttttgttaaataataaagactacatgtaggaacatggtctcaaatatatttgtcaggattttttaaatggttctctcctttgttctctcacgcacatatactaataagcttttaatacagatattaatttcagttttggcaattattaaaagctcaattaagaacttagcatgcccagaatcttgctgctgatttaatggagaccaccaatgcaaaagcaagttattacaatgtcacagactaacagaaataaagtatagagggaaatgcagaggcttttgattacgatctgattacagttgcaccactggttgcttgcatgaccttgaaaatgtcccttaacacctctatagcaggtctttctccctacccagggcagggatatatctagaatcttccaggcccattgcatccattcctccacatttccttgctcagacactggttcttggcttaccctgtgggttgcaatgtgaaatacatggagataaagcctggacttcactatgaagccagcttagaatagtcaactaaaggatctcaaagctcatcattcaacttgaataatcccagtggttctgtcctaagctcttttgctgattttagatgatcttataactggatagagctctgcagaaaaggaaacagggaaaaactggccaatcagcattgtgaaagcaacagctggtcttcaccccagcttcagcaggctccctccagccctctggctccacatttagcccatgaaagctcctcactgatgcccatctgttttctcttcttaacactagaatttgctgaaatgtttcagagaatttcccaacatggggcctaacctctttaaggagtaaatgcactcacacatttacacatgtggcatttaaacacatcacaaggacagggagtcaatgtgtagtcttcaggattaatattcatatggacacgttctaggggagaccagatgtttgcagtcccctacaaactggttgcatgtgtagtgggataggatccaacagctgatatcaaaataaggaggatgatctgcttaaaattaattctcctaaatccactgctattaaattaatcttattgttaaggtgcttaatgattcccagcaatctcaacttgtaattgtattttcaatatgtataaacctgttagtcctcactctgattcctcttaatctaaagtgaatgtctccaaaacctaagctctgattttttatcttgcccaaattcctacctaaggggtctgtggagtcatgccctacaaaccatcaattctcctcagatgggttttatttgaccctgtatatcatgacttactttccaatctgactctggcataacaaggaagaaaataaaaatgttttaccccaaaatatatttccttgccatacctgggaattactctgccgtctcttgtggggaaaatccacattctataaaaaatctcctttcccctttgttttccttccttctcagatccaggatttaatcaactaagagccaggcacccttttaagtctgataagaaacattttacaacctgcactctctgaagtctgctatctgagaacttcctctgcacaacttggtctccacaatcctttagcttaacctgaacattcctttccattaatcccaggacttcagataaactcaaccaattgttaaccagaaagtgtttaaatttatctatagcctagaagcccccatccgctttgggttgtcccgcctttatgaaccaaaccaatgtgtttcttaaatgtatttgattgatgtctcatgccttcctagaatatataaaaccaatctgcacctgaccaccttgggcacatgttctcaggacctctggagggctgtgtcattggccacaatcactcatatttggctcagaatcaacctgttaaaatcttttacagagtttgactcttttcatcgacaagagttaatatctcaactttaacatccagcaaagtattcggatttttaaaatgtaaatatagtcaatgatgctagctaggtgtaatgactgagttgaagagatttttaaactaatccttatttatttaatgtttagctaacaaggatgaattcttttgtgtgtgtgtgtgtgtgtgtgtgtgtgtgtatgtgtttctttgttgttgttttcttatatagattatctcagctttgaagtgtgacatggattctgtgaccatgataaatgactaaaaccctaaagcactgtttttcctctgtaaagtggatgtaatgagggtagtcacctcatatgatctgtaaaggagagatttctcaaaaacgagcatgcttcaaaatgtcccacagaacatgtcaaggcaaggcctactgggctccgcctgcagaaagcattcagtagacctagggtgggactgagaatttgcttttgtaatgaaatctcaggtgctgctggtgctcctggttggggacctcactttgagcaacagtgcgtaaactttaaatggactgaaccatacaaggatctttacatagcattatcaataataagggatgtcattgccatgaaaggtaggtgtatgtgatgtgcctgggggagaggcccagaggacactggctctcagggtctgctttcttttgagctttgtatacaaaaggaaaagcaaacagtaagtcagtctttctctcacttgataaactaaatactcagtggaaacaataagatcttgtggttgcagatgaagacagtttacccaagcaggctcattagggaccattcgcatagagtcctggcagcatacaggggagctggaggaggagcctgggggagttactgatgcccaaagaaaaggactctaggtcaaatttcgaggccccaggtgtctacctggctctagccaaatggaaatattccaggcctggcaggaacatcaacaaaaccaagaatctctcaagtattttttttttaagttgaaaaaaaaaaagcaggcttcattgaagttattattgcaatggtaacaatcaacattaagaaggaaagcataatacagtaaccacaagtttctactactcttaagtacggtttccagttttgtgggccttaatgttaattgcagataaaggtaactaattttagtcactgattatgtgaggctaataaaagtagagagtgcaaacaaaataagtgtgagcaggcgttgctcttgtgtttcacgtctctgaccaattgcaattgtccatatgagaggcacatttcctactgccttgtaaccaaaggaccgttctgctgctgtggctgctcttggaatcagagagagaagctgaatgatgcccctaagtttgtctaacaccctagacttgtcttgaaaataattctctaatttagtgactcaagaatttttcggaagttaattcaggagctcataggaaaaagaaacagttttcccccacccccccaagtattggaagtacagagaaggactcataaaaattgggctggagttatttaaccttgaatactgtgggtgatttttttttccttttgtaggaagggagtattggaagtacagagaaggagtcataaaaattgggctggagttatttcaacttgaacgctgtgggtgctttttttttttttttaccttttgtaggaaggaagatgtacttgcaaaaaatctccccaaagaatcatggacccctaacatcctgccttatctgactgtaatttagggtatcaagcatctgttaggcacattctgcaggtactaaattaaggaggattcaagagtagaatgtggaaatttcctgtcagaggtaagaagaatgcatggacaggtacaaaatggaggaatatgcacagatgggcacatagatgagagcatgaagtttctgacttgtcagtagaagaagtgctatgatttttttctcccagaaaatattttgattttgcaatgattcagccacatttttgtcctacctgcctgtatttatgaaacaataattgagagctagagttccacgaatggactgtaaaacagagtagaaagaactgatgaacagaagacacagcaggtaagcatgagcaagctagcccactacgtgtaaacagctcagctgactgggtgtggcacctcccttgaatatgaagcattctgcatgtagatgagagaaaggaaaatgcagtgcaggtgcaaatgacagtgacccaaagccatgttcctctgagaagtagacactttcatgcctgggcatcctccaggccttccctatctagtgcatatttttgcaaaggcttatgttgtgtttcagacactgtgtttatatgtgagggctataaatatgtgagaatttaagaatgtatgtgtgtgtatagaagaagaaccaagccacagcttgggcggggcatcctaaaccccttaataggcacgtaatttaaggaaagatcctgtgcttaccagagaagctttgtttagaggcccgttcctaagtccccttgcatcaagcttgctgctcctgcatccctcaaacccagaaatgccaaagctgcaatgctggcataggtgtatataggttagttcatgtccttgattcatgggtgatgacccaccaccctgcccagcagagtccaggccatcttttttctgagccctctctggggagaggtggcagctcaaaaagcccttgagtcttgtttctttttctttggtggggactctaatctgttgctaatgattccttcatacactcccccctcattccacgtaatgtgtttgagttctcttcttgaaatacatttgtcatttattgaataatttctgaaacaattaaatgacaactcaatgaatggctttgtcaattttgtgtaatggaaagtcaaattatcatgtaggaaaagcaaaatctttctttttataacattgctaaaagacttcaaaagtaactgcataattataaaaaaatttgaggtattaaagtttgcaaaatcaataagaatatctcataaacctatttatttttggaaattgaaaccatacacatggacttatttaaatgtaaatgtaaagatgtgaataaagaccaatatttgtagaaggcgatcttattatttaagacaaagttgaaactttaaacatatacatctgtatgtgtatatatacacatatataatagtacataaaatatatatttatttacatacttaaattatatgtttttatatttgtagatttaaatacagtaagttctcacttaacatcatccatgggttcctggaaactgtgactttaagcaaaatggtgggtaacaaaatcaatttttttctcattaatgttataatgaaaagatattgaagaaaacaatgttatttgaggactcattgtacattgttttgtttaaagtctgaatttccaagaacttgtaaaagacactaaggaattaccgtatatacttttgtatatatatttaaataagtttaaataaatatatgtgtggtataaatatatgtgtctatacatacatatctttaattctcagcttgtttcatcttgatttcttcttatctataaattttggttattcaaactttttaccttcctatagtaaatagaggatttagaagatttttgttccactacctccttggcaggtatgccagctgccttactttaaaaagcaacaattgcaattcttcgagacaattataattcattgctttccctaatcagcaggacctcagataaatggacatatgaagatttgttgagagtattgttctgtggttcaatgacttgtgtgatttccttatttaaacaagaacaaagaagccaaagaaaataatgtattttaaaaataattgggcactacttatcagagtggttggtggactggatactaatcaggatagtagactccaaattattttttttccagttacaagtacctttgtttattcaacagtagacacagtgctggcagcaacctgtaactgtactccatggatttagataagaagatgatggggaagggggatttttaagtcacactagatcaggattatattgtttcatttgagtctcttttaattcaagtgtatttaataacattctcctttatgaacggatttggagcatgaactttggatttaggcaaatctgagtttgaatccctgctacttactgatggtttcaccctgggcagcattttatatcctaagccttagagttcacatctgtaaaatttttataaaacctacattagagcagtataagaattcactgaggcaatctacatagactcccaatgtccctgacatataaaaagtactcaagttagaaatatttaaatccttatctaaagaaaacttgaatgctgaccaagactttagcagaatcccaaaagacacatttcttccctcaaatgtaagaaaatattccctcaaatgtaaatgtatcttcaaaatatcccagctcctgcccccagatgtattttcctaggcctgaggcatttgcaaattccagaggccatggcatgccagtgtctgttggctctgctggtaaggggggcagtctccctttcgtggctcctgcgcagtccagcctttctcctgttgggtgatgctgctaagcatgctcccaggatagaggaagcatctgccatgcttgtgggtagacatgggttactaagtaacatgacagaaaatgtaagtggatctggaaacaaggtaaaccaccaggagagccagaaatttaacaatgaccagattttaagccactggcattttgtttaagtcagttcccagtaaaatcatttgagcatggctttagaataaaagctggggacttggttgatgatgggatgctgtatggagtaacttgatggaggcccagaatctcaggaaccatttgtcaacatctcttcttgcaacactaagtaatagcagagccatcgtacattcatttcagaatgggctgcctagccattcaaaatgagtgagtcagaatactgacttttgactaatttctagaagcatgcagttgttttgcaacttgtcctaccgcagacacagattccttaacctccttccactagataagatattatctaacaaggattcccatataagcgaacattttgttacgcgaaagctcaaatagcagcagagtttgtacaaagctgtggaagaaagtcctaaagaaagaatgcaggttagcaaggagaggtcaggaaagtaacagattttgtactagaagagaataggaataagcagccaggtgtggtggcatgcacctgtaatctcagctactctgaaggctgaggcagaaggattgcttaagcccaggagtttacaatcaacctgtgcaacataatgagactccatctcaattaaaaaataaaatatttaggctgggcacagtagctcacacctgtaatcccagcactttgggaggccaaggcaggtggatcacaaggtcaggaaatcgagacaatcctggccaacatggtgaaactccatctttactaaaaatacaaaaatttagccgggtgtggtggtgttcacctgtagtcccagctactcaggaggctgaggcaggagaatcgcttgaaccaggtaggcagaggctgcagttagccgagatcacgccacggcactctagcctgggcaacagagcgagactctgtctcaaaaataaaataaaataaaataaaataaaataaaataaaataaaataaaataaaataaaataataatttttttttaaaaagtaaataaaagcaatgggaataagggatcaagaaaaatgtaggagtctttaaggcaccaaattcagaatcatccctatttggggaaacttaaaaaatcttttaagagaggtgccaagtacaattatcacaggatttgaagtaaggaatccatgccccattcctggctgtgtcccttattattgtgtgcattttcatagccacttaatccctctgagcttccaaggctgtatcttatccagatgcacgtatgcagcccaggcacatagtaggtactcaataaatgctggctttaaataattaaatgtgatgtcattttcaagaaacattagctaggtaggtattgtgacaagtcacaagattgtttgaaaaaaatacatataacatcttttaactgtgtagaaaataacagaaatgtcatcagtttggctgaaacacagggcttgtgctggggtcctaagagataaggcttgatagatatattggctgatgtatcttatgcgtttgctcaggaaaatatggtacattgcttacatctgttgttctagagtaattattaattgagccacttgtcaatataaaaaaaaccttcgttcggataatatattatattgtcaatgtctttctagctgccatcaattcagagtgagcaacttatacttaactcagaaataaagcaaactaaggatatgccgtacctttgaagtatgtgtgacaagaagctggatgatagtattagttgctattacatggtgcttataccagtgtaaattcaggagagggctggcattttttttttaagtttaaagtttaagcatgaggaaaggcctatcgatagataaaactttggttgtgagtctccaatggttttataagttcaccatctttaggaacatacatgaaattagagtgtacaataaggcagtactgtagaaaccctaactgctaaggaagttcctgcagctggctcgtgaaaataatcaaggaaggagcttacctgcctctgtcgatttttattaaaagcaaaatgagtttatttggagaaaagatgcccaatagaacatggattagcaaattaaagaaggatatacttagttttactaagtttcagaagaacaaagtcactcttctattctatggaagtgtatgtaagagctataagattaaactcacttctttgggttagttttaaacttgtgcacaaatagacttgatgtggtaggttgaagagtgctcccacaaaattcctgtgcacctggaacccagatgtgatgttatgtaggaataaggtgtttgctgattaagtacttaaggatctaaaggcaaaatcattctgaaattagggccagataaatctaatgactgatatctttatgaaaaacagaggggacacctaagacaggtcatttaaagaaaaaggcagatactagagcaatgcatatacaacccacgcagtcccaaagactaccaagagcctctagaagctaggagaagaaaagggaagattcttccctggggttttcagagatcatgtgtccctgttggaattatgcttctggacttctggcctccagaaatatgaaagaataattttcttttgcaaatcccccagtttgtggtaatttgttatggcaaccataggaaaacagtactctttaaatattcattattttgcaacctctgctattactcctcacttaactctgagctcctctgctagggtgtggccaccatgcactgaacacagcagcctgcacacaataatttgtattcctccagggcacctagcacaatgccactgctggttcaatacgtccatgactggttatgcattgccaatcttctggatcattaagcctttgctcatactaccatcttcacctggaattctccttcaaattccccatactctcttgacacatacgtctccaccttctgtaaattcttcctcatctttcaagatctagttcagctctaatcccaggtctacaacaacacttctcctgattcaattacttcaagtaaaagtgatcctttgcacatctgcactccctttctcctttctgggtcatctcttcggacttggaacaattcttctctagatttggttataatccacccccctccgcccccacccaacatgttgctccatgcgagttagtcttgtccatgaaactggatagagtgattttggaaaacaaagtctcgtctgatttttaccttcatctctctacttggtctggtatggagtaaacattcaatagtaacttgctgactatttgccctggctgtctcattccacagtgataaaaccgaaatgttctctaaaattacttttccatcattataaatttgacttgaaagccatgcaattgatgcatttgctggggattatctttcgcccgtcactcattaaatctgtcctcatatagcaacaatatttataggaacagctagacgttagcccccaagtgagaaaatgacccatgcaaatgccctggcatgacataaatacccacagcaatgcagattgtgtgatgactctgctgggtggctacagttctggggtatgggcgatggatgagctaacttggagaaggcagcctagagtcgtcaggggaaagaagagggtgcagtacctcattaatttgttcccagccaacagttttcaaagattagccacataataatgcccctagaatatgctctttgtacatgaccaaagatgatctgacaggcatttcaaaacagtaattgttggattgatgacgctgctgaggaaagaggactcattatacccaatttggaagattgtgaatatgtcgtataaatgggttatgaggatgcatttgggtaaaagagctggacaaatgcatgatgacattacagtaccccaatgggtgtctcagacatacagtacattctctcacccttcattatttgaagactggggaacaatactgcatgtttaagaaagtacaagttcaaattgtggccagatgtacgctatggtaagggaatgaagtggttctctagtgcatatgcaatcctctagggacataggcagttgtgactgtgctatcctgtgcctcacttaaaaagaatccactggacaaaaaacatttcagcaaagaagattttatgatgactgccttctatgactcacatgccttcctacaataggacatgtatgcatcattggacctttgacattaaacaatctcgaataattttaaaagcatgtattaatatccagtaatactttttttttttactttaagttttagggtacatgtgcacaacgtgcaggtttgttacatatgtatacatgtaccatgttggtgtgctgctcccattaactcctcaattaacattaggtgtatctcccaatgctatccctcccccctccccccaccctacaacaggccccggtgtgtgatgttccccaccctgtgtccaagtgttctcattgttgaattcccacctatgagtgagaacatgtgatgtttggttttttgtccttgcgatagtgtgctgagaatgatagtttccagcttcatccatgtccctacaaaggacatgaactcatccttttttaccgctgcatagtattccatggtgtatatgtgccacattttcttaatccaggctatcattgatggacatctggattggttccaagtctttgctattgtgagtagtgccgcaataaacatacatgtgcatgtgtctttatggcagcatgatttataatccattgggtatatacccagtaatgggatggctgtgtcaaatggtatttctagttctagatccctggggaattgccacactgacttccacaatggttgaagtagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgtcttttggctgcataaatatcttcttttgaaaagtgtctgttcatatcccttgcccactttttgatggggttgtttgtttacaccgataacagacaagcagagagccaaatcatcagtgaactcccattcacaattgcttcaaagagaataaaatacctaggaatccaacttgcaagggatgtgaaggacctcttcaaggagaactacaaaccactgctcaatgaaataaaagaagatacaaacaaatggaagcacattccatgctcatgtgtaggaagaatcaatatcgtgaaaatggccatactgcccaaggtaatttatagattcaatgccatccccatcaagctaccaatgactttcttcacggaattggaaaaaaactactttaaaattcatatggaaccaaaaaagagcccgcattgccaagtcaatcctaagccaaaagaacaaagctggaggcatcacactacctgacttcaaactatattacaaggctacagtaaccaaaacagcatggtactggtaccaaaacagagatatagacaaatggaacagaacagaaccctcagaaataatgccacatatctacaaatctctcactttgacaaaccggacaagaactagaaatggggaaaggattccctgtttaataaatggtgctgggaaaactgactaaccatatgtagaaagctgaaactggatcccttccttacaccttacacaaaaattaattcaagatggattaaagacttaaatgttagacctaaaaccataaaatccctagaagaaaacctgggcaataccattcaggacataggaatgggcaaggacttcatgtctaaaacacaaaaagcaatggcaacaaaagccaaaattgacaaatgggatctaattaaactaaagagcttctgcacagccaaagaaactgccatcagagtgaataggcaacctacagaaggggagaaaatttttgcaatctactcatttgacaaagggctaatatccagcatctacaatgaactcaaatatccggtaatactttcaaccagcatagcttaatatgcatcataaaacaaatggttttggatgagagaggtacattttttagctttaaaaggaaacattcattcattcacagagtaagagctgtacactgaaatgaaaataccatccaatgcaaaatatgtggaatcccttccccacagctctgactctagttagatataatacatgtcatacttatagacacacgtacacaaatggagtgcaattgtcacatcttaattttgaaaaatgactgtatttaccaaataattattcccttttaatatgtcattttaaaagcatcttgagagataattttatatttttattttttgtgggtggaaatacacctcaaattttataataaaattagaaatggcaaggagttctatgtatcagaaatttctttatggcaatttaagaaataaaattgtcattctgaaaagcgatacatatcaatatcaatgatagcccacataaatgaaggccatgttcatctgctaattcagtgaatcttattactaaagaggtagtggctattctgtgttgggactcatttaaatatagagatatctaaaaatataaatatcctccctacataaaactcttcaacaaaagcctcgctgcccaaactcccaacaatcttccctctcagcagaattcattgtctcaggagttttccccaactgtcccatgaagagaacacgtcgcactttattttataagctttttatttgtcttgctccccaaaagagagtgagatttgagagaaggcagaaactgtaacttacataaaaatatcaataacgattgatgataagaagcagcagcagcagtagcatcgatagcatttcccaatacccctactcctgccccaagcacaaatctgcctcattatgtcctgaattcccagcgtccaggtgggtggcagtgggagccctcctcctcaggagatgttccacctgcctgctacctgccgcagtgtttgccttgtaaccaggccattctgtactcaggagctacaggcaagttactatttctgcagtgacatttccttatttcttggctgtcaaaaacagaggctgttcaggtaccagtcctcctgctcttgagtaagagaagaaaatgctgtatttgtagtgaaaagggtgctggttcaacgctagcaggattttccaattgaaggggtcaaggaaacatgtgcagattaaacaagcacaatttttagtttcattatatttatatgatgattgtagctacttattagttatttataacccaccacagctggttcggtggctcatgcctttaatctcagcactttgagaggctgaggcaggaggatcagttaagcccacgagttggaaacctatgggcaacatagtgagatcttgtctctacgtttcttttttttttaattatccaggcatggtggcatgcacctgtagtctgagctactctggaggctgaggtgggagaatggcttaagcccaggaggtggaggttgccaccagtcaaaatcacaccactgtacttcaatttgggccacagactgggaccctgtctcaaaaaataataaatgaataacccaccccattctaagcaggactatgatgaaagatatataatagaaaagtatgatatgaatcaattagtgaatagtggaaaagaagaaatgattgtacacacaataaatccagtgtgaggctaatacctcaaattagattacatacatagtagagttttctatgacaagcgtcatctttgctaacattgctattgcttaagaaataccagcatcattctgtaaacttaataaattcagagagaaatattagcaatttatccccggttcaccttttacttctaaatgctagtcagattacaaaactgcctagatattttgcaggtcattgaaaagacactagagtttttgggtggaggacaaaatagaatttttccaacagcattctgtttttttttttttaatactttaagttctagggtacatgtgcacaacatgcaggtttgttacatatgtatatatgtgccatgttggtgtgctgcaccgattaacttgtcatttacattgggtatatctcctaatgctttccctctcccctccccccaccccacaacaggccccagtgtgtgatgttccccttcctgggtccaagtgttctcattgttcaattcccacctatgagtgagcacatgtggtgtttggttttttgtccttgtgatagtttgctgagaatgatggtttccagcttcatccatgtccctacaaaggacatgaactcatcattttttatggctacatagtattccatggtgtatatgtgccacattttcttaatccagtctatcattgatggacatctggattggttccaagtctttgctattgtgaatagtgccacaataaacatacgtgtgtgtgtgcctttataacagcatgatttataatcctttgggtatatacccagtaatgagatggctgggtcaaacggtatttctagtctagatccttgaggaatcgccacactgtcttccacaatggttgaactagtttacagtcccaccaacagtgtaaaagtgttcctatttctccacatcctctccagcacctgttgtttcctgactttttaatgatggccattctaactggtgtgagatggtagctcattgtggttttgatttgcatttctctgatggccagtgatgatgagcattttttcatgtgtcttttggctgcataaagacgtcttcttttgagaagtgtccgttcatatcctttgcccactttttgatgggattgttttttttcttgtaaatttgtttgagttctttgtagattctggatgttagccctttgtcagatgagtagactgcaaaaattttctccccttctgtaggttgcctgttcacgctgatggtagtttcttttgctgtgcagaagctctttagtttaattagatcccatttgtcaattttggcttttgttgccattgcttttggtgttttagacatgaagcccttgcctatgcctatgtcctgaatggtattgcccaggttttcttctagggattttatggttttaggtctaacatttaagtctttaatccatcttgaattaatttttgtgtaaggtgtaaggaagggatccagtttcagccttctacatatggcagccagttttcccagcaccatttattaaatagggaatcctttccccatttcttgtttttgtcaggtttgtcaaagatctgatggttgtagatgtgtggtattatttctgagggttctgttctgttccattggtctatatctctgttttagtaccagtaccatgctgtttttggttactgtaataatggtttacattattagctactggttatttttgctatatgtaggaagagaatgttttcaatccctacatgtcagagaaatggaaaccagactccccttaaaaactgtctggatgctcaaaccgtgggtgttcataagaaacttctgagttgattcacaaagtgagttcattttaaccttgtaaatgtttgatactatttttataagtaacaagaacaaatggccacttcctgtaacataacatagaaataatattccggttgagagtgttcgagtaaacaatgcagtacccaaatctatacccttcccccacacacacaggcacacacacacacatacacacacacacacacacacacacacacacacacacacacacaccaatcgccatggctaatatcaagattaggttcaaagacaccagaactcggacagttgatccttttgaggcaacataaatatggtcagcctgagagtcagtccagtcaaggttcctgggaaaactccagaatcatgtctgagggatgtactaacacagggcaaaaggttaggagcaagactgaaattaggttgtcagtggagagctcaggctcatgtggggtgggatggaatgagaccaactctggccaaggtaggagggtcctggctgattcccctcaaccatctgcagtggttttgtggctttgctcgcatgccagaggcagaacagacagacagccgacagcagctctggtcattcctgatattttatttgtgttcttcattggactggaatgctctgctactatgcgtgtctacttgtgtctgtgaagtgtgtgcatgggcacgtgtatctgagtctgtgtctgtgtgactgggtgtgtctttgggcatgcgacatttccttttcccaagttagtgtgctttgtgctgaaagccacatgaagcgtcagtaacacagacctcctaagagatgacagagtggctgttctcacccataaatggtgttgctagaggatgtggggagacttctcacttaaggtgctttggttaggaacatgtaaattcactgtttttgaaatgtaagtttcagacagggactggtaaaataatgtccagcctctctcacactgtcacttccccacctaggtgcacaaggatgtgaataaagctcccactgtgcactgctttgccatctggaatcccttaagcgagaactgtatcttttccagcgcagctcatccctgctcattcgcctcattccttggtgtcaatttcaccttctgccgccattaaggtccaaatgggcggcagggcacctctgcacactctaattatgctaataacggctcgctgactgcactaatggggtcattatcgcccctcatgaccatggggtgcaaatcgccactttaacatcatcattcctgtcctaatccatcactatccttcacactagccattcttagaacccaaaaaactctccctaaaaaggatgctttgtgcctgtgcttccaggaagcattcagagatgaaagcatgggggactgagggcaacatgcctggcagagattacagcaagttacggaagagagaaggccctctggcaaggttttgagatgcagggaatgaaactaattcatgggtaaaggattctgacatgaaattggaggtgcacactctggcttatctaggtgaccgagggccggcctgggagctagggacctgtcttctgctccagcagctctggttggactacacaaaattaatgggccttcacgtttccatttgcagcatgagaatggtaaaaaaaaacagagtcagtcaggttacgggtcagtgcaaagtcaaacctccaagcggataattcagtagccacaaggggacaaactgcaaagtcccaaatgtgtctagtgttgacaaccttctctcagctcgcactacataaccaaagcttatgaattcagcctccatgttcccaccaccaggctcccatccttattagctccgtggctttgagcaagttgcttaatcttgccaaagcttagtctcctcatctataaaaagaaaaattaaattattgggcccataagactgatgatatgttaagccctattcccaaaccttatacatggtaagggcccatccaatggccattgatattacttttatctacagacttggatctaagtttgaggcatcttgcactatgatatcccagcatcaccatgtatgctaaccagtcagaattttctagtctacaggactacacatgaccatttttaagaactaaatcaacatattatattaaactgagtggatgaaatcaaccacatggcatttatgaatatagtatcaatttctttacagactttagaaaccgatttgactctacttgtctctgggagagagctaaatttcgccttccaaaaaaaagctgaacagccctcagaatgatttatgaataggtctttgatgcataaaatctcattttctttagtgcatttgtcaaaagatttccccatgtgtgtcttgtgcaggacttggttgttgtaaccctctcagcctcccatgcaggaggagtatttttcctgatgctttctcttgataggtcttgggatgatcatatttgactgatgtgttagtgttcttactttaactcgtgcactatgaactttatatcatgttttacttcccagcatattaatgctctggtcttcagtgcagatggagtgaagccctaaaactcagccccgtcagccaattaggattcatctgacaagcgacactttgtcttttgtgtgctagcctgggaatggcaaaaagacagcatcttgtttgccttttcaaaaatacacccccatagaatagaaattacgtacgcttttgctggcttaagcataatatagatttattatgtgggaaagatagatgagagattttttttttttttacaatgctgggaaggctttaaaattatttactgtcctcattatcattaggaagcagacattatctgatctatctctccagttttttatggtaaaactctattttaagattcataatttttaaagactgcctgcccctgaatggaatatgcaggctgcacggggaggagtgatacctgatggggtgtcccactgccatctcaaaagcatacttgaaaagttgagaaaacattttctaacaggatgtgaaaactgagtcttgaacggagtggatactgctcagaagaatatttgcgaaggaatgactgctgaatttatgtagtgtgaacatttaaagtaaaaattcaaatcctcacctttggggtcatggtgattaatttccattccaaatgtaactcttcttataggcaagaaatccagtaaatattcccctgtgaccaacaaccccgtgagctgttggcagaattaataaagctgtcaggatttctttgggatattgcacgtctccctgtatgtcatttaattgtgaagtgtaaatatgcatatggcccatcaggaagactaaatatattagtctttagggcttcagctcctgtttctgtactcatttatcaattttgattaaattaggggagaacattttgatacaaaaatgtataaaatttatgtagctttctaggagaatgacttgcattgtttatacagcataagcatctggggagaaatatatatttttctaatatgcagctttggataatataaaatgttctgtatacaagattatgttcacagcttgggagaatttggggaaaatgctcctggcaagcaaactgtttttaagaagggaaagttgaaaaccaggagcagagggaaaacataatgcaacttctattttctcgaactttaaaatatgcagcttccgaggctgactcacaatccaagtgagacctctgtcagaagagtctgagtatgcagagggaggggtgcagatggagtgagaacacttatggtaatgtcaggatccagctcaatatttcaaagcaatgctttctgtacaagcgaagcacatttgcaaggggattggcctttactgtgtgaactcagggctatctttcgaccaatagataccggccaagctaggaatgagtcagtggtttgtgactgtctgcactggttttgctttgaaacagtcaaagaagagaactgccatttaaaagagtagcaagaaatgtgtgagcattgtaattggacattagtaaaatccaagtgtgagtttgttgttgtgttgttttgttgtgttttcccttccctttgagtgtcgatttgtaaattgatgtactgaccactttgtataagctctgtgttgtacagatattataaatttaaattcaagcaaaagataggtaagaatatcccccttttacagatggaaggatcgtgttcatagacattaagaaatctaccccaaccctacagtgatgtagtgctcttctgaccaagatgggtcctggggccaaatcgtaaatagaggcctacctaccatatgcttacttaggtaaatgttataaatgatgctaccaaacttaaataatttgtgttctctactcctttgttaacaagtatactttcacagcaatgtggaagtctagggtgaaatcagagcaatacatgatacacatcacccctgcccattcaatatctgactccatccttcaagtcactgggggccaagcttacatttccgggttgcccacactgccccagtgtctacaccttggtcccataggtgcccacactggtcttgtggcctggcctattttcactgggagagtccttcacaggcccacaagtgagcttagagccctttggtcaggaaattctgaagtttggatgcatgaaacatggtgtagaccagaatgagagggttgggtggaaaggcagggggagggaaggcttccaagttcgctcatagcctgccaggacccctaagtgctcgtggcatgggaaaacaacagcaacacccaaaggaggaccaaagcaggggccctttaaagcaggaagcccaggagagtaccccctgctccccaccacccatctaagggaaatactaccacctgggcattgtgattgaaaggaattaaattcaaatcaagatcatgggactccaagctgatattttatccactctactttgctgacttcctagtattttaaatgaaaacctaagaaaaaataaaaatgtgaatctggtcatctatttcaggaatccttttcatagtaacaaaataaaatattttaagagtcacatcccagtgcagaacctttgagtaccttgtgcccttgagaagtggccacaggtcccaaaccagggcccccattaagctgagctaggtttctttctttggggtcttgttgaattgagccttaggagcaccccaggactgcttatctgctagtaatgcctgcgataagatattcagggctctgttgatttcccagctgtgcttccagtgagcgacaggagttttgggacactttgtgcctgcaatcgctgggagagaacagccatgataagcaccagggagagggatttttttcgcctgtagtctgaacacggaaagtgataagagaggaaggcctctgcagactgacccgaaaagcaaatgcaggtggaacaaaaggcagccctgactataagaagataaggcagctgcacaattggtagctggctgcaggatctccatccattcaagtcacgaccttatcctacagcatgtgatggagcaaagaagtaaaaaatgtatgttttaaaaaagaagtctcaagattttctgtagtaaaataggtcaaaacatccagtcaaattgaaagaaagcaatgtaaaaatttgagtcaactggaaagctgggcattgtttggtcagatcgatatcccacttactcaaatcatgtctgcggatgttaatgaggacaaactagtgctagagtagcgaaagcataacagttcttatattttttaaaaaatatacaagtataaataagctatcatggggaccgggtgtggtggctcatgcctgtaatcccagcactttgggaggccgaggcgggtggatcacctgaggtcaagagttccagaccagcctggccaacatggtgaaaccccgtctctactaaaatacaaaaattacccgggcacgatggcctgtaatcccagctactcaggaggctgagattggagaatcgcttgaacctgggagacggtggttgcagggagccgagattgcaccactacactccagcctggatggctgagcaagactccatctcaaaaaaaaaaaggactttatgaaataatttttaaataatcagatgtcaaatctctcatagggagcttagcagtgattctgcataaaggccataggcccaggtcccagccacacacctcatttcagagatcacagtgaggatgaaatgacaaaaataaagctcctaggtcaggggctggcaggaggtgagtgtgtaggacagtccaacttcatttcatgcatgtttggagacgggccagggtcacgtctgtttgacaagcagaatatttgagttctctaagtttttaaggttctgtaagtttttaaggaggagagtgagaatgactactgagtatgtaatttggtcattttaagtttgtaaattaaatgccacatgtgcgcgtgcttgcgtgcatgtgtgtgtgtgtgtgttttaggccaagacaaaatgttaccacatcaaaattccttatccaaaaaagtcatgtcaaataatcacattccaaaatacatgtaaatggccatatcaaaatgacagagtcaaaatgtcagatctctttctcttccacctcaatcctcccactgttagaatatgtatgcttatcacactacgtgcccccatgttgggttcctaagttatggtcttcaatcccatcaagcgaagttttctgactgctggactgtggcaaggaataggatttttttatagagagatgtcgattctttcagcccttggagctgctggtctgggcccgtgtagaacccctgtccctgtggtcgtgagcaatctcctactgtgctatacctatataatcaatgaatgtttcgatgtgaaaaaggttggaaaccatggccaggcaactctagaaagggaaaagatgaaaatggtttgaataagtcagaaaaaaatgtatgaataggtagatttttaaatgcacagtcttgagagaagcacagaatttaaaaaaaaaaggaaaataaattccataagaggagaacagcaagagacaaaattaggagtgcaggattagaaggtgtgaaggaaacagtagtgtggctgacattctggaggggcatgtctgggccaggagactgcaaccgaagcccatttcatggtcagagaggcctggagatgggggttggctagaaggcaagagaaaaaggtggcctctgggtaacgatgtaacaggatgaatgtgtggtttgggaaaatgcactattaactgcatgcaggactgatggaaggaaaaggtaatggagtcaacaaaatctgatcagggtctctctgaagttatacttcttaggttttcatcagaaaaactttggcttggaaaagatacagctttaatttccttcatttagtttttttttaatctatctatctatctatctatctatctatctatctatctatcatctatctatctatctatctatctatttattgagacagagtcttgctctgttgcccaggctgtagtgcattggcacgatctcggctcaccgcaacctccacctcccaggttcaagtgattctcctgcctcagcctcttgagtacctgggattacaggagctcgccaccattcccagctaatttttgtgtttttagtagagatagggtttcactatgttggtcaggctggtctccaatacctgacctcaagtgatatgcctgcttcagcctcccaaagtgctgggattacaggcgggagccactgtgcctggcctaatttccttcattttaaatttactttatatatttctaaaacaaataaatacagttttctgcttgagaaattcctcttggtatggtttttaagctttaattgtgtatgcttgtgacataaacttatttttcttgtcctccacatttgagactttgctatagatagctaacatcaaaaattaagcagcaaagaagcttatttctgagatatttttagttttcccaattcctgatctggacttccagttttcatttattttcttaagttctgataagatggattgctttggcttatgaagtaggtactttttctggcaataaactttacttttaaatatgttatgaaagtggattgaaatgctctttaatagaaactagctgtggcatatatataccagacatttttatacagaatgtgcttacagaaagggaatctgaagcctgagaactttgcagaaaccatctgctctctcccccacctcttcagaggagggcagaaaagaaacagagagacaacatgttaaaccctagaattttaaagtcaagataatgtaattctggctttgtcattgcacagaagaggaagaaggagtgggtgaattaaataaatttgaatacagcttcctcaccattcattagctatatgctgatcagattgcttcagtgctctgagcctgtttcctataaaattagataacagtatctgcctgacagcactgttgaaatgattaaatgtgcaacaccagtaatgaggtaaaagttcattaaatcatatctatacaatattatttcattaatatttttatgaaaaataattcaaaacatcgtagaaaagattattaggttctgtttggtaaagtaaagaattcaatgcatgaatcttctaaaaactatgtctaactattggatgaacaaatgcatgaccctgtaggtcatttcctcaagaattctgcttagttcttgaccctcttctccaaaggatagtgctaaaatatagaaggcacggtgacggacttgattctgatactcactagctgtgcagccttaagaaagccattcagattttctggctaagagatctaggagtattaaataagataaagtgtgcaacatacccagtataatgcctgtcacatattaaatgctcaataagcattggtcctgtattcttagcacctcatctgtagtgctagaatgctaccagacttgcctatttctcaggttattttgagttcaaaagatatagtgggtgatatagtgagagacattatacatatgcaagctaaaattaaaagcaattatccaagatcagtgttctgatatggaacaatagatgagaaatggaaatcctgatagcttgaagagaaagatggacatccaggttccccttattgagtatctgctctcgtcctcatttaatttgtcagcttctggagctgacttaatgagtttttctcagctgctgtcattgtttccttctccatcttccccttacaattagagtttcagaccagaatccctacaatttccatttcccaaagacagaacatatacacggtgtgctttcaggatggatgccatgttgacctaccaaccctggaaaggaacaaagggagtgtcccccttaaccccgacctgctaagctgtaaaccctggttcacctgaatgtgattggagcatggtattgtggtctccccaacaaagtccagaaggagtcaagtgggggcacaacttgtaaaatttccttcataatgaaaatgtgtgttctttataaatgacttctctttgcagtaattctcttccctataactttatttataacaatatttttaatgttgaccttgaagctcaaaaactttaaataacttgaccaactacatatgtccagttagcaaaattgctggagaagaggtacaaatttgtgtgagtccacatttgtaggctggcattggcctggagaaatatctagcaagctgcatattcagcattaaatgttcaaatcacctcattaaaaaagctcaaagagttgacatcaacttagcaatatatttaagcaaatgtaccccagatattattatttcaatatatgataattcaaaattatcagttagcttgctgtttttgttttgctttgtttttgtattaagatctttaaaactcagtgtgtatgttataccaagagcacaccttaatttgcactagccataggtcaggtgctgaatagccacatactggacagccacctcactagccacctcccatttttaacatctttcacagacagcatctaagttataaggtacactttaattttctaacacttgtggaggcttgaaagtgaccaacagtgaaagaacaaaaagtcctatgtttattttcaccgctttttccctccctcaatattgtcactggtaaactgagatcttttcccattttgtgtggattgcacagaagaacctccagctggaaaagacaatcaggtttttttttccgctggccagggaatggagaaggcactctcttgctctaaatgcacctctccccaaacattagaaagcatagggtttttaaggactgggtacatggccagagaggaatgtttgcatgtgcagagtgggactccagacgtgcagacttaattcataagtatgtcttcatacaacccacgtaaacaaaatagcagaagttttcttttagaggtggaatttttgcattataataatatgttaatgatctaaaggccactagggattgtctgctccagtgttgctggtttggggttcttatctccctctggtaatctggacagaggtcaagaagctctggcaccatcccaggccatctgacttctttaagcagctgtgcccataaataaagggactgtattaacccattttcatgctactgataaagacataccagagactgggaagaaaaagaggtttaatggacctacagttccatatggctggggtggcctcacaatcatggtggaaggcaaggaggagcaagtcacattttacatggacagtgtcaggcaaagagagagaacttgtgcagggaaactcctctttataaaaccattagatctcatgagacatattcactatcatgagaacagcatgagaaagacccacccccatgattcaattacctgacactgggtccctcccatgacatgtgtcaattgtgagagttacaattcaagatgagatttgaggggagacatggacagaccatatcagggaataaagaaaaacagtaagaaaaagaacttttccagttgtttaatcagggctgtcctggtaatgaggttgagtttctaaatctcagtatcagaccattcattctaattccattaccctaaacctaaaccactctgtccaatcagctacagtcacgtgcctgcttatgaaccacaaatcccaggatgatcacctcattgcctaaatccatattttcaaatccagcacaaaaaaaatctactgcatgggcccaggtcctgacacattacctcattatctatgtgtctgcaccatcttctggctgttgatgcctcatattgacatctctgtgtctatttcaatttctgacccaatgttttatcctaatctctaatcccccttccaatggctgccttgcttcttgacccatggtttttcttacattctgccaagagtacctctttaccatggtttttctcacatggcataagacttgcttgagtaggatgactttttagttttgtctacaatctccagtattcttggcatttactgcatgcttactcaatttcagacttccacaaactacatgatctgaatttcattagatgcctcccaagtgacccaatgagaacaacagacttgtacctggtcatcagactttctcctgacttggattcctcatgtgacttttagttgccctgccaagtttgctgccaatggaactgtctaatgtctgccaagtgaaagggttttttgttgttgttttctttatttgtttgtttttttcccttaatttcaagtactatgagatttctcagaaataaacctagcatccttattcagcaaacttcacactgaaacactctgtactcctgggaaatattttaagagccacaaaagccaaaagtatatggaacagcttcttaaataagattttccccatgaacttagatttaccttgtgtgatataatacaagtctaaagttaacaatttcagaggaaataagaaataaagaggaaagaaaactaatatcccatgcctaagggcatatcaggcacacttcaaatatgaaatgatgtaaaaacaaaataccttaataggcaagattatatccctgcttttaacataaaggaagtattgacttatctaattaaagactgaatcaagaaaacaactgagtggaacagcttctcctagttggcatttttacaactatgtcccttgatttatttaaatgatacatgcacctagtagatttcaaaatattaattcatcaaaatctgtacatgtttggatgatgagcccaatccaaggagtggacatatttgggcccaacctttcaaacttccaagttcagagtctagatgaaaatgacttcccaagtctaaagctgatattagctaaacatgtgacagggcctttcccccacgattcatctataaatcctttaacactatcattctctgggctggtcagggaaaatcttcatttgggcgttatttttaagtattacacatttaaagactattatagacaaatgagtgtgcacccaggggacaaacaccagcagagtaaacatattaaaacccagtaacatgtaaaaggttggaaaacattacagatgctcagtctgaaggctgttattttggcaggattaagagaggagacatggattccatgacaagaacaagaagccacagaaaaatggggctcagcaaacatcagtgggtgggaccacctcctacctgaagtggtgcagatattagatgggggaggtgaatttaatgaccttgacaggcctctccagccctgagattctatcataaaatattcctttcccacaccacatgtaaaatataaatgttgctccctgaaacccaaccaagaacaggctgcttttaaataagtgagaaaagagaatgcctgctagtgaggactttatactttgacctggggtttgtttctctataaataaccagcaatgcacatcgccatgcaagatgggcttggcctcagcatatcctcctggtctcattttccttatacctgaagggtagaaagctcaggccctttttggccttgggcaagagagcttttattgattgcacttgtcatgagtaatctgcagccaaaggagagaaaccatatgagtcctataaacagcaagtcctggtattgcatttgccatattttcaaaatggatatgatatacaggagtgatgcagaaagctaaacagtctataggtttattcctgtctccatgaaaccccaacatgtatttctttaaaaagtgatggggtaaaattagtctttattaactttcatttccaagaggtttactaaatactaccattttacattaaaataaatattgggccaataattctttttcattatttttataattgccatttcaaccatctgtcaattaccttagcacatcatttgtgaataggttgatctgctagcaagaacagctctaatggaggcagggcatggatttgtcttttgccatcagaaatccaggcaattcaaggctgatagggcaaacatcaagaaactagtaagtgcaggagctatgattttaatctagattcatttgcagtcagggtccatgcattagcaatcaccaccatgcggatatgcagaaggggccagcctcaggaaacaggtcattccataactgcccttgttaccttcccatcaagtgcccctgttctcccagcagaggaaacagccacgtcattgtgttaagctatcagtgccagttcctcctccagtgggtatctgcaacatcttcactgggggagattactgttaaaaacgctgaaagaaattttaagacagagatggcagatttcacaaatacagatgaagcccattcttaagttatatgggataataagctcattggagttgcacaaaaaatccaagatcatcaaggcaatggacccaatgctatatttaaggagagacattaaaaataagttcataataagatataagcagattctactcatttaattaatttctaccaaaagaataacaaattaacttgaagataaaaaaataatgggaaagaagtgataattcgattaaaaagtaaggcatttgctcctatagagaaataacataaacagatttttgaaaacatttacctttgcctaattattcattacgctcagctttatatggaaatgaccaaatcttaatatcccagatggcccatcatgggttcactttctatccacaatcaaaacaaagccctagacagtcagtgagttcaacattttctgcaaattagtagacattttgagcaaacaagcctcatgtggatgatgcagtacttcaactgaatgatcaagagcttaagatgatgtggaatgctgtcatcaaacccaatctgctcattccaagctgtgatttctgactgaaaaacaggtgacctttagcaaatagcttgaactaaggtggaaagatatgcatacatattgagttacattggtttctagcctttgattttaccagtgttttaaattaatctcctcttctttcctccttttccaatccttattcttttctcatattttcttatttgtgtcctaagttcagtatgagtaaacacataccttcttaaagaacatttctaacataatttagtattgatcttgtttatacatcagtttaggatgtatgtagaatttgtttctattcactcatttaattttctgttcgatatttactgaacacttgccaagtgtcaacaggagacctgaacaagacaggttctagaggaccatgggctgccacatatcctagacagagctaacactagggtgacctaatagccaagtatttcctgggacagctctgattgacgccgctgtctgagcatgactatactgactttttcatcttcaagtgttctagtttggaggacaaagtctgtgatttatctatattcttagttaaaactgtaggaagtgtgtgtgtgtgtgtgtgtgtgtctgtgtgtgtgtgtgttttaaattggtgagcttggcagcctgtcttcctatgtgtagtttccactaggttaagaaacctcaagtcatatgattgacaagggagtgacataatttgcatatggaatgaagctctgacacctaccagaaaacagaggaaccacccagaattctgtgtagtatgagctcatataacagaggtaatgataggtaacattcactgactctacactatatgtaccagactctgtgctaaaggccctcaaacttcattcaaacctcaccaatatccatatggtagggaaggacatttatttctattttcttattgaagacacagattctgataagtaaagttagttttacttatcaggggatccaaccataacctctctggaacctaactagggaatgatgcatattgactcactgcatctaaaaagtgctaccaattacacagaatctcttctcacccggctgtaaatagggtagagagaaaggatgtgagaggagtcacaaccattgcatttgatgagcttgtgtggtttcccactttctggtgaaacctgttggattcagggattcatcccttaccacccatactccaatctccttaccttcaccctccccagtccctacatatacatattatacctttgtcacctaaaaaaaataaaaaatgtacatttaacctctgttccatgcctttcgtcctcctaatatttttctttactttatacttaaacatgtaacttaaatatccatccagcatttgcttctagaaatttagtgttctctcaactatatcagaaaattcctactgcatgtgtttcaagacctgattgtcatccttaacctcttatttctgtttaaacatctcagccaccttctctgtgattattttatatatatacatatatatacgtatatatatacatttttttttatttttgagacagagtcttgctctggagtgcagtagcacgatctcagctcactgaaacctctacctccctggttcaagcaattcctctgtctcagcctcctgagtagctgagattacaggcgcccatcaccatgcccagataatttttttgtatttttagtagaaacagggtttcaccatgtaggccagactggtctcgaactcctgacctcaggaaatccacccgccttggcctcccaaagtgctgggattacagtcatgagctaccacacccagtcactgtgattattttttttgccacaagttttctacaccaccagtggcacaaggctgttcgttgtatagagtgagattttgctgacattttggtgacaatggcgagtgatttcagcaccaaagggagacagcaaaacgttgagcattgggtgtcattctacctatggccatcagctattatttagctctagataattaagtggcctctagctttggaggccccagtcccttgcaactattatgtcttcaaatcaagacacttctcttatcccatcttgttacatgaccccagttctctaaaaaaaaaatacatttattttgtctagttattaaacaattctaaaaataacaaaaagtccccatgcagcagaataatcatttcccctgagaaaggaagccaccatttctgttattgtaccttgctttaactactttggtttagaccttcccataaccaaaatattcattaagctgtttctctaaataggataccaagatatttcttctactgccactctagaacaaagaaatactgaaattagcttttaaaccaaaaattttgtcctaatgatgtaaataaaatatatttaattaagcatgaaaaatgtatttattgaactcctgtaacactccagcaatgaggggaagaagattatggggctataaagcagcatagtatatgaatcctcaaagaattgtcaagtcagtttaagagagaaaatttttgaagaataaatacaaaggaaaaagaggataaaaaggctatgcttttcttttacacccccttctcctgcctcattagagaaaattggtatgaagattaaaagaagtctacgaaaataaacatattctttaaactttaagtaaattaattgaaattaattcagtgcttatttatttcccaaactcctatcccttgagaaagtgatggcactcggagattttgcaaaaagagtattctaaattgctgttcagtaaaatatctcattgagcatggtcaaagtagaaaacatagacttatgaaaaacattttaccatggaaagtttcaggtgagtaattcttttctcaaaaaagatattgtcttgttatgtttttacacatgaagatatttaaaagattaccatctttataaagctagtgtcatcctacagttaagcgacaagaagaagccaacaacttgaggaaacttggcaaatgtggttctcctgggaccaattaggtaagaacaggagaaatgagcttttgcttgcttttttctgcagtggtttcacaagcgggcttcagggttgttgctgaccgactacggaagccggatgggaccttttaagccagaaagcgagaggcatcttttagagctctacttcctcaggctcaggccgaacagcaatctctttctgtaactaacccaagctcttccctcacgtaatttctcccaggagcacataatttctcccaggattcccggcggcatttgtctgcaggcacgttacatcttcactctttttcagaaaccaccctccctgtcctttcctctttgcctgggatgaatccccagtcccccatatgttagatgcaaagatccaaggcaatgaggttttcagggtctcaagactagagctgctaaaaagtttagacataggtagagatcccaacaagcataggcacccaaaaagggcaaagcattactgatggtaaaacaaagggctttgaaatctgacacacttgtgtttgaatgccagattattagtatactaacggtgcaccttgtgtctaatgtttagctacaacaaacctcggtatacttatttctgaaatgggaatcatagtgagttttgaggtttagaactgatcagtataaagaactaggtgttcaataagcaaatgtcatgtctttgaaatgaaaatgataaacctacgtggatttattttccctttattcatctttggaattggttgtaacagataatttatgccctacatgccagagagtgttcacagccagtctgttctgactgatgcagatctctccagaatatgctcacagcaccaagcacctctctgtaattgacaacagctgaaagtttctatttattaatgtatgtagtttaaaatgtgttttctaatagactgtaaacttcttcaggtgaaggactttttttttttttgcatgaatgtttccaaggcatacaaagattcctagtgcaaaattagcacacaacagataaatacattaaatcaaattttaaaatgagccttcaaaaatggttttcccatttcacaggtgagaaagctggggctctgaaagaacagtttttctaaagtagcataggtagtacagagggtctgagattcagaccaagaagtgattctctagagtcaatattagtttctattatatatgaaatagataatatatcattactgtcatttttcaatcagtgaataaacagaagtccagagaatgttaaacagatgtttgcagagttggggctcaaacccaggcctccaattagatgtccattgctcttttttttttttttttgacctactttcgggtcaccatgaaaaccattctcaggatattcctaccttaactttgctcttggctggctgtccaggatttgcttgcctaggcaggagcaaatcttttttccactgtatgaatttgtggagtcagtagtcctgccagagtcttggtttggtcttggttgaggaggtagctttcagctatcacctgcttgcttgttctagttttgctggagagcattttcccctcaacatttttggcaggcagccaggcctttttattatgtggaactgctcctcaggacacaccacaatggaatgtcagagtgtgatgctgttgggaggttaagtaaaagaggtcacaagtcttgccagctcaggggcaaagaggtgagctatctgaccctagcatctgctgcagcactgctgtgagtgccacagttggagacatcctggcacatgtgtctttgggactcaggtgtgggctctgtgagttgtggactcttgtaagccaactctggttgcagagaggctggcttcaatcaagcacataggaataaattcaggagacaatggaaacctactctgtcttggcaatattaaatttttgctgagaagacttgccttgatcatggagaatgaaagagggactattagtctgtttgggctgctgtaataaaatactacatacgaggtgacttataagcaatatatttatttgcttctcacagttctagagatctggaagtctaagatcaaggtgctggcacagtttatatctggtgcgggctttctgtttcatagatggcacctcctagctgtgtcttcacatggtctctggagattttttataagggcactaatctcatttatgagagcctcaccctcatgaactagtcacattccaaattgtgcacctcccagtgttactgcattgttgattatgtttcaacatgtcagtactggggtagggaagacacaattattgagaccatagcaggggcttttcctcttagcccagtacttgtactttacctatgttctcattgttcagctcccacttataagtgagaatatgcggtgtttggttttctgttactggaacacaggatgttctaaatgccatgctgagggtgaggcctacaagagtaagccaagcagagctcttgcccttcagaagcttatagtttagcagaggaaccagataaatcaaaacaatgtataagttttgttaatagttccaaaaggaggaatggtggtttttcaaatataaaacaagtctttttccacaaggctactgcctggggaaccatttctagatgggtcagggaggcccccagatgtactttttagatgctcaatcatgagaagagttggggtttcctagggaggggctaggttggccagaagctatttggaagctatttgttcccaggaagggaacaacacacactgacacctctcaggaggatgggggaagggagagcatcaggataaatagctaatgcgtgtggggcttaattcctaggcgatgggttgataggtacagcaaaccaccatggctcacatttacctatgtaacaaacctgcacatcctgcacatgtatcctggaacttaagattaaattaaaattttaaaaaagaaaaaagaaccaaaaagagagcatcttgtgttctcaagaaactaaaaggcccgggcaggtcttaatagagactaaactcacagcattcagtgatgtactggaaaagaatgaatgtttgaaacagtgtcatcaagctttacacacctataaaattgttatgcctgcttctaaggtggagtgtgtgctgggcagaagcagtaggctatccccaagaacacatgagtcagtggggaatgagagaaatgacactcccaagggaaaggcctgtgtgaaccagggagttcacccagggtattctgagacagggtcttgctttgtcacccaggctggagtgcaatggcatgatcatagctcactgcagcctcaatctcctcggctcaagcagtcctcccacctcagccttctcagtacagtttgtgaatttgaaacaggttagttcttggagtgtgaatatgcattcaatagtttggatgtgtttctgttttccaccgggcaacttgagtagctttagtttgtaagatcccagatagcgttctcttcactgatagttattatccgaatacctttgtaatgcctgagtcagtgcagttttgcatgagttccctggagaataactttcatgagctaacaccactttgatagctttccctccctttctactcttgggaatatctgggacataggctgagctcccttttcatagagttatcttaagaagcgagattaactatatactatgtaatgcatacattaaacaggaggaaactagattatatggagtcatttaaattgctagccaattttatgtgttggctctcatctcatctacagttttagactttctgtctttctacgtgctcataaagaaaaccctggatgtggcctggtgtggtggctcacgcccgtaatctcaacaatttgggaagccgaagaggttggctagcttgaggctaagggttcaagaccagcctgggcaacatggaaaaaccccatcctctgcaagaaaaaaaaaaaaattagccaggtttggtggcgtgtacctgtagtcagagttacttgagaggctgaggtgggaggatcacttgagcccaggaggtagaggtgcagtgggctaggattgtgccactgcactccaatgtgggtgacagaatgagaccttgtcttgaaaaacaaacaaacaaacaaacgaaaaacaagaagaagaaaagagaagagagaaaaccctgggtatgtaaatcttgttgacactgtctcaaacattcattcttttcaaggacattattggatgatgtgagtttagtctctattaagatctcatttgggtacccttttattcaggtgataaaatattttgttattaataatattttcattgagtcaatacttattatttactgatctctcattatacagcatgtgttttaaataaatcacattttattttgataacagaacactaaactaggtatttgaatcctgatttttaactatgaagaaaccaaaagccggaaaggtaaaatgatctccagcaggccatagagctactgattggtggttctgggactcaattcgaatctgcctggctctggctcacaaaggcctttcccttgggaatgccatctctctcattccctgctgactcatgccttctcggcgacggcctacttcttctgcccagcatgaactgccccttggaagcaggcataacttctttacagttacattccagagcagcaatgctcaaatttggtggcaccttagaattacctggggagctctaggtcccacttctagctatcctaatttcgttgttctggactgggactgagcatctggatttatgaaagttttctgtcaatgtggatatgcagcaaagttacaacaattgttttagagcagtggccctcaagtagaatgtgaacacaaacctcctggggatgtgttacagaaaatcctgattcagcagaattgaggttggacctgagatactgaatttccaaaaagcccccagtgatgctattctgttggcctacagaccaagacattgctggcaaggccccagaatctccccattttctctgcatagcccgcccatctcctcttttccaggtcacccttctcctgggagaaattctccagttcagggtttgcactgtgttttcaatgtagctgttctctttcagcagctcccgttaatcattggaaagttccatctcaactaaaactctctgttagctgagtagaatagggggtggcatgtaaagaagtcgaggtcacaagatcaatacccaagtttaatacccacagggaccagttagcttttctgtgccctgaacccaagtctccaggccagccatggctcagatgtatgggattgtccctgagagatgaatgcttcatgtccatcacacatgcaatacttaccagaacagcagccacagtctgactcccactcgctcaaaggtcaatagcatatcttgataggaaataaagacacagcaatgttagctacaatcgggtgcttacctgtgccaggcactgcggtaaacattttagaatccttgcaacattctttgaggtaggtggtctcattatctccattggataaatgaggaaatggggttcatggttttcaccttctgacagcatgcaacctgtagataacccaaaatccaaggacttaggccagtatgccgggtgctaaccaatgtaaattagggttgataaaggatttgcagctctttggcgttggaaacttcaaaatatgtttttctaccatgtccctgtcaagcttcgttaatctcggcattgtcccctctctcaatttatactgatgatgactgccttgtttatttattgtgtttttagagaagctcaaattagaccatccgtatgtttaaaaagaaaaattgaagaactgcgtaatattgggagcattttagcttcatcgaatctgtgcagcaaatgtatccacagatttacctaccataatatgagtctggtccttccaatctacccctcttttgatttgtcatcagtgtacaaggtcataattctcatctaagagcctagagatttccccagtcaactttgttttattctaatgtacctgactagtggagtctgcaatatttctataggttaaagaaacactaatgttttatttttaagtgaaaaattcaaggaaagctacatcttttttgctttagtgttcagaaacacaaatttttgatatttataatgaatactgactaataaagactacggattgtataattttgatgtttgatgttagtttgtttatttgagacagggccttgcttgctctgttgcccaggctggagtgcaataacgcaaccttggctcactgcagccatgacctccctggctcaagtgatgctcccacctcagcctctcaagtagctggaactacaggcttctgtcaccatgcctggctaatttattcttttttcatatagacaaggactcaccatgtttcccagactagtcttgcatgcctaggctcaagtgatcctctagccttggtctcccaaaatgctgagattacagacatgagccactgcacctggccaggacagtatcttttagtactaaagacaaactgctaaaaattaagtaccagatagcaaaactttttagaagtattcaccattagctttctctgctcaattcaccaattatactctcactgtaaatcaagtcaatcaattagtcaacagatttttattgaaaactctatacatggggcactgtgttgagacccaggaattgaaagagcccaatctaaggcctcctcacaaggagatgtgaccctttcttgtaaatagaattttaaaaatttaattgtttgcttcctctataaattattttctcttggtgtcatggaagatctataaattctgataaatacttttattttgagttaacttccttcagcatgctttggataataataaaaaatggaactcatgattcttgctattttaattaaattaaacccttgaaacccccgtctctcaagtgattttccactcccttctatgggtttatttcctaataggcactttattactcttgaaagtcatttatttattcctttagatacactgcccgtttttcctgcaatgaatgtttaagttctatgctgctaaaagtttcttcctggtttggtgttcaaagccaagaacagtgactggaaagtcagagaaactcaaccaactttccttgaatgattgtgtgaataaatgaaaattggctatgaatgtagtagaagtgaattctagccctagatgacaagttaaacaaagatgcctttttaagtcctctgtcaaaccataagactttagaattttacaattcagttttctaattaacaatgataaccactacttgagcagaccaatatataatcagaggggttaggtggccagtgacccaaagatgctagtcatcaaaacagcactcagtattgacattttctctgttgtattgtgctgtgtttcagtcttcaaaggtgtctggtatatatattttactttttaatcttctaaagaccgtttcactaattagacacctatcatttttggcaaagagccaaagttaaccttcactgtattgctctaataaagattgtttttaatgaaataggtgactaagctattgttaacaatctagagtaataaatgtatggaggattttcagctgtctaaagaaagagttaagtgatatagatataaaatttgtttcacatggcttaaaagtgtagacaattacagaagaatgtttaagggatatgaaaatgtataaggttgtgaatacaaatttgtcatcagtctccataatattaaaataaaagtctatttcttgaagcataagaaaattgtttcagcattagaagaaacgtaataaaatgaaatctatacatttataaccaattaccacttacgaacattcattgcatagccagacagaggaccaggccttcaatgtatattttttaaatgttactgtaatcctgtgaaatagatatattgccatcattttacagctgaagaaaccgagagctggacagattaaagaattaatgtgaagctaaatctgggatttgaaccaggtatccttcctgtgccatgctctttgcctctacagcattgcctcttgtgggtctggctgaaattacacacagtataaacttgatatttgaagatgcttaggtgtgtgtacacttttacccagtagtgtggcttttgagaaactctacttgtgggattatgagtactttttaaattttctagtttatatttattattccaaatttattcaagaaatatgtcacattttaaaatgtgcatctaaaaatattcattgggttttggggagggtgtttataaatctttgaagacattgcaaagggtactatctgtgcttccctcgacttccccttggaactgctgtgagaaacaagctattaggccgggtagatcgctggtctgactcagcatggcatatctgaagatgaactattcactaagtcatattgaatgtgccttccagtcttatagccgttcctgaaactcgatagctaatagaatgccatattcaaaaggcattgagcactgttttccccagtgctttgagtttggaaatcatgatataagttattactacaattattttccaccttcatctgccaaagaaagtgaaatcaattcatccacatcttgactgcaacgctgttgtaaaagatcctctacctactctgaacatggatctttaaaattgaacctactgatgcaacataaattttagaaaagtcatcttcaactgccaggctggccgcagtactatttaaaacatgatttggggacctctatttcaatttccattactcacaggtcacaagtcttcacctttgtttaggcaagtcctagactaatgctctcaccgaacagaatagttctgctgtcatccacaggttacttgacctctctctactatagtttgttttcgtgtaaattgggaactgttccatctgcaattcactcagtaggcattttgtgatgctgtttgtcatggtggtcctatgaggaacccatgagtgtttcatggtcctgaactttattgaagttacagaatgggccctccttctgatttcaactcttactcaccacaggcattgcagaggccctgagccatgccaagtctcatcttccttcctttatttatttatttatttatttatttatttatttatttattttaagcagggataattgtagatgttcctcatagagttgttgtgaataggaaatgaaatagtatgtgtgaaaacttgccacagtgacagtcacagagtgagatcctcatgggcagtagatgcaactgagcagagatataaatgccaatcattttgaatgtgataatcttgtatttattttgtaattaataatcttgtagtaattattgtttgttttttgttgattcatataatttgatttgcgtatatagtcattgttgaaaaattggcaaagagaaaacggaggcagagatatctccacagatagattctatcactgctacctacaaccattttaaattactgttaaaattttggtgttttttgctttcatttttattaacacaatcaatattttcactgatataattatatatacttatacaagttttatgataccttcttcattctataatgaaagataaacacttaatattgctattacaaatactggcaactattaattaatattttcagtctgtatgtaattatttttatctatttagaaactatagatagtaaattaagaaaaaatcagtatttgtaattctgtacaccagagagagccacattttaagatattttcttctgtttttttttttatatgcgtagacctatgatttaatctaagttgccagtgattgtcagacctacaattatttcctaaggagaaaaaaatgctgccaaataaacactgacacactgctttgtacctcttagaacttctgttttgtatgccttgaaatggccttcaaattatataggcagaggtatttattgtagtatcagtctcggtcatacattaaaaatagatgcaaaattaattgggtaacatattcctcggacaaaaccacattcacagtctgtctctcttgactcctgtttggcttattcacatctgtgtccaacatggtgtggtcttctgtgctgctgtttctcccaagtaaacaatcttttttcaatgttgaatcacagcataatattttaaagccattttaaatagcaattaaacttaaaattgactcataaaataatgaagctgtgcccagctttgcccaagtctacacagttttcatgtggccaagcacaatcatatgaggaccaacagtgacctattgacaggagggtgcaccccagttttaggcatgctacagtgcaaaaaatatacacagctagaacaacttgaaaaattacatattttttcctttagggtgctttatttagttttatctctcttttttttattcccattcaatattgagaacatttcccagtatctttaagacccttagaaaaaatctctttcaaagagatttcaaatgctcttcaattaatgtagcaccaaaagccttcagcttttgaggcttttagaaaattacgattattgaaaacaaaccttacaaacaggaatatattgaagattattcctacaaaagcaaaggaggaacggagcaaattaaatgatggacactcagatatgtacaaaatttaattttaaaaacccataattacatgttggaatctcttgacttctgggaagaatattttgatagagctcctatttttaaatagataaattcatatcttatatcagaaagaaataaaattgagaaagtctatgatttcacataaacctcaatctgatcatagattgaagagaagcatagaggcttatttgacaagttttattgtataatatttttattaaagaaagatattataaaaggaggagaaaacacttcgcatataaaatatttgactgaaatatgttaaaaaccttatgcaaaaatattagaattaagaatatcctccacttatcaatgtttttctgaattttgcagagatctcagcatctaaagacagaataaataatatcgtggtctacaaagaagccgcaggtagttatgtcaacaatttccaacatataaattttaaactataattctgaagaaaactgtaagcagttttctataaaaattaccatattgaaagatatgtttttcagaaaaatgcaataatgaggtagtagagacagagctaaagtataaagtatatgaataagcaaaaagaataattgttattttagtttttaaaaataattttattggtgaaaattgttttatttcttaagtttaaaaatcccaccaatataataaagtcagtttgtgattcagcaaataaatatttttaaaaatttttaaatttttttatacttgaaaatcatctctcatatggtgtttaatatgatatttaaccctttccttactgtagatcatttaggatagttctacttcctctactgtactcaacagaaatgggtatctctccctttgcaattctgatcattttgttaggatagattccaagtactggaatttctaaatcttacaaaaatttcaaaactgaattgcattgaatagtattctctgaatatcaagaaataaaaatattaaaattccaatgcataatttaattctatgcataatccaatgtagttaataacaatccaatgcataattgaaacaaaaatattttgaaataggttttaaataactaaaagaatatcaatagcactttgtagtaacataatgttcagcaaattatatgaatagaacttgtgaaaattatttttaaatagttataattttcaatcaattatatttttaaatcaaaggcatttactaggtattggccgtgttctatgcattatgcatacttctctctgaaaggaaaagaaagaaaagatcttgttcttaagagattcttctggtagtgactgaaatgcatacaccgagataatcaccataatcctctacaattgtcctagtaaaacacccgaggacagcaaacacagagactgaccaatctcacctgcaggaaagtaggactgggaccaagcatgcttggggtagatttcaaaggaagcagtgagagtggagctgagtctggggggctgagaagtttgatagcagagatgagaaagaatgtagatatatagggacaacatggatgtagtcctcaaatagggaaaagcatggtgtatttgaggaacagagaccactgtgaagttgatcccaggatgcatggggctgggagaaagggtagggtggaaggaggctgggtgtcttgtattaaattgggatgtgtcttatttgtcccgacatggaagctctgattgcattaaattgcacttttctctggaggctggtaattatgctactatcccacatagcatatttattcaagaaatatttagtgataccttgttttctgcgtactagacactcttctgatcccaggaaaagagtcttgggcacaacagataaatgcaatagcaatacatgaaaaaaaataaggtaatattttaagtaatgagaagtattataaaataagtaaaacaggaattttttttttttaatcctcaggctggagttcaatgtaaacatattctgaattaacacagcaggggtctctcttaaaagatgatatgtggtctatagagtccagccatctttagtaccagaggagaagaaatctaggcagtggaaaccacaaaatgacaagtgcaaaagccctggggcaggatcaagcttggcagtttgaagaactggaggaaggccagtacctgaagttccagaacagaataaggatgagatgggtacaagaagggaatgtagaggtatttggaggcttataggtctttgtgaggagctcgaatttgatgctaaatgctatgcgcagctactggaagtttttagactaaagtaacattttccggcaacaaaaaattcgcactttcactttaatgtggaagtgagtacatgccacatatattactcagtataatgcatccatggctttatataatatttaaaaatatagctttgtataaaactagagaggagatggctgggagcgccgaggcgggcggatcacaaggtcaggagtttgaaaacagcctgaccaacttggtgaaaccccatctgtactaaaaatacaaaaactagctgggtgtggtggcgggattacaggcacccagctactccggaggctgaggcatgggaattgcttgaacctgggaggcggaggttgtagtgagcggagatcctgccactgcactccagcctgggagacagagcaagacttcatctcaaaaacaaaacaacaaccaccaccaaacaaacaaacaaacaaacaaacagacaaactagagaagaggagagcttgcacatggttctcaggttgatttctttttttttttttttctttttttgcataactgtgaagatcaatttggatcgctactaactctagttttgatcatttgggctcatgtttggcagaggtgggagagtcgtttatatggaatggattatgtggtgtacagaggcctaccaggtagatacctcagtttcagccttgtatgctcgaatatatagagaagactttctgacttttctttcagtacaatattatttgagaaatgagttaattttccttctgattgtccttatggcagtggttactgaggacagcgaaaatcacctggtgaccattgaataggtctgggagacaaaattgagtgtggatcttcttctgtctgtgtatttatagatgttgtttctgtgtgatacaaatgagttttcattaattgacttaaaaataattagtgcttacaacaaatattttgtcaggaaagtaaaggaacaaaagaacggctactccataggcaaagaagccccaagacctgctgtttgcctattttatgtttatttctaaacaaaaggtggattattcatgagttttccaggaatgaggtggacaattccagaactgagggttcctcccaattttagaccatatagggtaacttcctgacattgccatggcagttaccatcattctgactttgattgattttcactcaacctttttccaagaggtaatcatctgcaagaaataagtgattaaaggaattctttaggaaattaataataacaaaaagttttagataatcctcccctgagcagtatattatgtttgcatattcaatgaagaaagtcctaaaacctattatgtacatttatatagtacctttcccttctattcatattttggcctattcttttttatatgtatatcttactagatccattcatatcatgcaggctgctattcacttgattatagtgatagtgcacttttttttcatgcaatgtgtcaaggtaattaatattagctgctcacaacagaaaatcacccttgaaattccagtggtttaatgccacaaagatttatttctcaggtctgtgattgggtggccattcaccatcttgtagcatgctgcttagaacaagcaccctgcaaagttgcaaaggcaagtgaaacaaaacagaagatgcagagcggctcttaactgcccgcaaatggcccacagcacacacccttacagagtactgggcagatctggtttcatggctaagtgtaatggaggacatgaaatggatggtgaacactgtctttgtcaccaccagcctttctgtcaccaaatatctgctaccctcttatacatgtacactcccatcttttcctgtccctccactcattggtggtcatgatacaccacacttttgtcattcatgcttttgaaagtcattccaaagtgccatccaattaccttgtctacttccaagaccacgtgtgtggtagtgttttcataaagtcggcatgtggcctctcttagtatagagaccttgacttaaaaaagaaataaaattaaaaaaatgaatatcatcccttctcctcaataccccctctccccataaatgtatacacatatatatccaatgtgcaaaaatagaacaggaaaaggatagctgcagtaggcactgctattcattcagagggtgagactggagaagggctctctgccactcaacagtccccagcctgcagccgttctgcaatcctgttcagcaaacgttgcaacatcctcctgccttggaaaatggaagcttgatttgctctctggggcagctcctttgtctatcactatccaggctgttagactcctctctggaaggttattcttttcctattactttctctggcatcagcaaaaatggaaattaggggatatgccttttggggttatactttctcctctcacttcctatccacagaaagttagagccacaaggaatattttaagcaccaaatattaaaaagtccttttggtccaaactcatggtatgtttgataaaatatttgcctcaaaaactaagtgaactactggtcaatatgcctggttctccgtgccggtaaccacacccacagttctttcggaagttttgacttccgtcgcagcaccccctccctgagcctgtctctctcaatttgatttcaaataatctttctgggaaaatgcacaggaatgatacaccctttggatctttacactgaattgctttatctaactgagagattgtactgggtctttgctgctgaaaatctttataaaatcctatcatttcttttggttatctagaagcaccgttttttccaatcaaaaagttcccacatttctgcaatcttccaatgtctcctgctccctcatatatacaatcttttttctcttttttctaaatcttaccacacacagctgatatactcttctgatttgcagcttcttcccttaagacttaagtcctctgtgcatatagtctgccttcaaaggtcatgatttcaataaaggtttcaccatcaccagacgtagtctccatctttccaacttccattatcaggctccttgccacccatcggagaactactaagccaggcaatccacatccaattatttattattattattattattattattattattattattattattattattttgaaatggagtctcactctgttgcccaggctggagtgcagtggcgcaatcttggctcactgcaacctccgcctcccgggttcaagcgattctcctgcctcagcctcctgagtagctgagattacaggtgctcaccaccacgcctggctaatttttgttcttttagtagagatggggttttaccatgttggtcaggctgatctctaactcctgaccttgtgatctgcccatctcagcctcccacatatccaattatttactggcactcccttcttccttttttcttatttgtttcttttttaaaacttttattttaagttcagggatgtaaatgcttgtttgttacataggtaaacttgtgtcatggaggtttgttatacagattatttcatcacccagttattaagcctagcactgttcccagaccgaactgagggtcgggctgcttattttcatggcccaaaaatgagatgaagatgagctgggaaagaagggagtttatgtctgtaactgggtacagggagaaggcttggaaaatatcaccagaccaactcaaaattacgaagttttccagagcttatataccttctaagctatatatctatgtgtaagtgttcattcatcaaaagtcataagtgattaacttcctctaaactataactaaggtctgagtcctgaagaccttcctctggagcctcagtaaatttacttaatctaaatgggtccaagagctggggtgattgaccttatcttgtctcctgctaaatcatgaaggtttggggagttttttcagacccccaataaacttgttgtggaggccttgggagttccttcagaccccccaataaaacttgtttaatcctaagtgggtcctgttaagaattccttcattatcttgtcatacttcaagacccagggatggcctaggcaaaactcttggtgggcttttgttaccttccagcctttttgtaaggacactggctctatcagcttttaatgtttaacttaaccacttagtgctgaaacaattgttctagaggcctgactgctgactgttcagccattaggaagacctggcctgccacagtgtcataggactatctccttagtttagctaaacatgggggatccttgtcacacagccatgaaaaataagtctcgcagacaatttgaaggggaagaaaaatggaatttattggacaaaaaggaaagaaaagggaaacagggacacgtcacaaacccagagagagaatcctgctagtatatgcttcccacatcacagattaaatcccaggttccacgcaggaagaggaggggccaggctcttccccactgcaattggtgcatatttttgtggctcccccacagtgtgcattcctcccagtgcacaggctggttggagtttctcaggggacccctttttacccggctgtctcaacagtactcattagttatttttcctgatcctctccctcctcccaccctccaccctccaaaaggcctcagtgcatttttcccttctatgtatccatgtgttctcattgtttagctccctcttataagtgagaatatgctgtatttggttttctgttcctgcgttagtttgctaaggataatggcctccagctccatccatgtctctgcaaaggacatgatctcattcttttttatggctgcattgtattccatggtgtatatataccacattttctttatcgagtctatcattgatgagcatttaggtcgattccatgtctttgctgttgtgaatagtgctgcaatgaacatgtgcgtgcgtgtgtgtagaagcacttgatttcaagctaccaatttccatactagtctaagtaattaatactaactgttcatggaagacaaacttccaaactctcaatgttgaatgcagcaatgtatttctcacattataattggatgtggatgaggcatccttccttcatctaaagcttagccacctggaatgcctggtgtctgaggtcacaaagaccatggtgaagggaaggactaatggatgtgttaccctagcttttaaccatcttgtcccatagttaatacacaccactcttgcttgcgtctacttgctggaactagtctgatggctccaatctcaattcaagtatggctaggaagtttaggagaacacatgtaatatttggtgaggattaaatctctttctcacactattacaaatcagctttcctttgtaaaactgctttcacatccatgatttaatattaatttcaactgtttcttagaggtgagacagcaaagtcatgactcattccagctctgtggatgagaaaatctatgagtatccacctgtctttgattacactgacttccgtagcatttcctcttatcttaggtttactgcacacagaaatctgttttcttattctccaaacactatcactgaacccaaacatttccgtaatcacaaagacacataatcacaaggaaggcaaataagtctgataaactataacaagtgcagagtcacctcactgagtctataggaaggatctgctggaggaagggtggtttaagctgatgcatttgggatggataggaatgagtcacgtgaagataggagaggagtgtagttctaggcatggagcagagaatagagcaggctgggaggaagaagagcgtaagaatccttggtacgatggaggaaggtcatcaggtctgcaatgcctcctgtagaggggacagcagtggggctggaccacaggcgagtggcagggatagaagcactggcaggccacatggaagaggttagtttatgctgaagatggaagatttaagcaaagtagggccaggaactttttcattcccttgccttcctccattgctctgcaggctgcaaggacttagaacaggtttggcctgagggacaacagcagcttttcagcaggcagtttctccagatgattaaacaaaggtaaccagagggccaaagggcatgactctgctgcagctttcaccttgaaacactgaagggaaatctacttgcccacaggaaatacgaaatccaagcattctagatataatgtatttctgctttggagaaaaatatatcctcaaatacttcagtacaaaataccacagtgaaaagttttaaaacatggtatgcttttaaacaaaatgagctccctgaagaagctgcagtatctaagctcacacttgtttcttcttgaatttgtgatttagcagttttgggattaggcatcacgtgctttacaaagatgttgatctgtaattgctagtactgactcttttgctttcatgatggattatataccatttgcaattgatagtctctgaatctttattttctttgcaaaagtagcatgtcatctccaaaaaccggacagcagtgcttgctaaataaagtgtagtatcgatcaacgtgttaaactatcatgcctttcacaatttgcgaactaacattgcactattcgttttgctcttatccatcacacttaactcttgcctgcatttctgctccccaagcagggacataagaaggcaatcactagtgaaggatttatgcataatgtggtattcttggctatcctcatatagttaaatttcattgatgctgttttggaaaatgactttataatgaggtgaaattatgctgctcagcttggcttactacctatagtgctatgtgacactcatgtacattatactccacaaaagaaagcaggacacactcatatcccattcactgtgtacttcctaaaacctcattcccaaaagcttctattcaaaccatgtttcatcctctcccagatcttggcactgtatcaggcctatgatgatactcctgatgcaacagcaactgttgccattttgcctctgatctcttgggtgactaatttctggatccaccttaaaaactccacttcagattattgttggaggacactcaccacaggtgactccttacgggaaaatgtcactgaagtactgttatggactatattttattatccccaaattcatagattgaattcctaacttccaaagtgactatatttagagataggacctttaaggacataattaagattaaatgaggtcataaagtgaagctctaatccaataggactgatgtctttgtaagaagaggaaaagaccctaagatggcatacacagaggaaaggccttgtgagaatgcagtgagaaggcaactgtctgtaagccatgtagtgaggctgcaacagaaactaaaacagctagaactttgatctgagatttccagtctccagaactgagaaaacaaacttctattgtttaagccacatggtctatatttggttatagaaattctagacaactgttacacagactatatactgttaagaataaacaaataaataaataaataagtaaaagcatgctatccctatccctttgctctgtttcacatttatgtgccggtcttagcttagtttattctgctataacagaataacacagactgggtaattttaaataaacagaaatgcatttggcttatgggtctagaggctgggaaatccaagagcatgtctctggcatcttatgagagtctttgtgatgcatcatcccatggcagaatgtgaagggacacggagggtgagggcaagagagtgagagaggaaaagtactaaacctaccattttaccaggaacccactcctggagtaactaactcactccgcaaaatagcagcattgatcccttcatgagggcacagcccttgatgaccttaatcacctcttatcagtccccacctcccaacactcttgcactggggattaggtttccaacatgtgaactttgggagataccagcaagccacagtggtacccatttttgtcatctgtagatttggctctttaccctgaccaaagacttctgggcttgagtaagctgagtgtgttgcaaagagtacttagtttagaaagtagctagtccaatgtgaaactccttttttgcctttggtgaaatgaatcttgtcaccagattctggcctggatcttgcatgtttactgctcagagcttcttcctaggaattaaatcctttgttgctctttgttttttgtattctgactacgtagatttgctctttgcctacataaagggacaaacccaccttcctgttgttcctttcttagctgatctagctttttgtatttgactgcagtccccccttaaattgtgttttccaccagcttccactgtgttgtggaaacaccctcactccttctcatgaacatttgggaggtctatttttttcattttttctaagccctgctgaatcattaccagcatatggggaggagggaggcagaaaccaagtatcactcccctgaagctactcaaacaggacagtgtctgtttggacacatagccagagtgttatggaagaaattcttgtaaactatgtattcagtcatgatacacatttctaaatggtgagtttcaaaaatagatgattccaccttgcaaacttgtgcaaatgtatataacagacagagaagcagcagcctgtccatgtcaacagccatagaaaatgtctgacacttcctctgaggctagaaacagctgttgatggagctcacagcaaccaagacaggtgttcaagttagaatcaaacagttgtcaaaatttctacttctctctgtttctttaaaacatcgacacattgaagtgtaatgtagttttcagctattaatggaattaaatatatagattatctaaaagagtaaaaaaggtttaaaagagcaacttatttgggatcagttatttccacatgatgaggcatgacctaactcaccttctgaatcataatcatcataataataacaataataacagactgggcaccatggctcacatctgtaatctctgcattttgggaggccacagaggggcatcgcttgaggccaggagttcaagaccagcctaagcaacatagaaagaccctgtcattacaaaacattaaagaattagcccagcatgattttgcatgccagtagttccagatactcagaaggctgagagggaggatcacttgagcccaggagtccaaggttacagcaagctatgtttgggacattgcatttcagcctgggcaacagagtgagaccctgtctcaaaaagataaaaagtaaatacaaataatcataaattttattaatgccaggaactatgctaggtcctagggagatatgatgctcaagacaaaggctctaactgtatatattgtatactttagcaactttataagttgtatactttggcaacaaggataattgaataaataactaggcaaatcattagaaacataagtaattataatttctatgctaaggagaagtactttgcaaagggagaatttataaattgagcccttgacctagggctggggaccaagaaacacttctgtgaagcactaacatttgtgctaagatatgaaatatgagaggggataaccacagggagaaatggcaaagtagactctgcaagaaaacagatgatataaaaacactgaaccaagaattgttcattagaattgcagaaggttataggagccagataggaaggggccagatccttcaggtttctgatggcaatgataagtaattagttacttagagttctgaaagcactagacagctgtaaagaattcttaagtagggaataatatgaacagaacctcctttaaaaaaataacattctggctacaatgttgagagtcaattggaaagagacaagaacagtgatgagaaaacgaaggaggaaactagtagccatcaacaaggaacagtggcatctctcagttcatgccatatacaaatggccagaggcttcctaatttgcttcctaattttcaaaagtattctcaggacctaggtgtttctttgaagatgacctcattcattcattcaacctccattgtttgtgcactgaccctatgcgaggcacttgggttcgcggagggaatgcacagccctggcccccaaggagtcctctagggacaggtaattgagttatggtagattgggggttatcccaggagtaaacaaaagaggaatagtcacactgcaggccacatgtggtggcacacacctgtaatctcagcactctgagaggccaaggcaggtgagttgcttgagctcaggagtttaagaccagcctgggcaatatggtgaaactccatctgtacaaaaaatacaaaaaaaaaaaaaaaaaaaaagtggggtgtggtggcacacacttctagttccagctactcaggaggctgaggtgggaggattgcttgtgcccaaagtttgagactgtagtaagctgagattgcaccactgcactctaaccttgatgacagtctaaaaaaaaaaaacagacaaacaaaaaaggtgacactgcaaatggcacctaaccagaagctggggagttaggaagtgtttcacagaggtaatgctggtaatgcacataagcgaaggaagaatgaaaattatccaagtgtttctcatgagtattggctgttacctataagttattagtttgacatttaggaaagttgaaagcaagaccctaaaaactattttgcttagttatgtcattttttttaggagaaaaatagttaccatgtctgctatggcttgattgtgtccttaaagttcaagtgttggaaacttaatcccagtgcaacagtgttgaaaagagaattcctagtaagaggtgattaggtcattaggactttgtccattactgttatttcaagtgtgaccttgttataaaagtgagtttggccacttcttgcccttttgctctttcattctctcttgcctttctgctttacattatgggatgacacagcatgaaggctctcaccatgtgccaacatctttatattgaacttctcagcctccagaattgtgagatataaatttcttttaaaaaataaattacctaatatttttattcttttatagcaatacacaatggaagaagacaatgttgttttgcctgtgtcccttatggcacattttattatttgcctatatatgtctctgctcagttctcaaatattgtttttaatcaggtctcatctttcctactcaaactaatttccagttctttgcactcttcctgcttctggtgtataattccgtctccttagcatcttttattagtcagagatcgtgagattgcatttgacagaaccacaactgaaatggcttagtaaaaacaggaacatggttagtttatctagcttgtaattgaagactacaccagttcaaggcacctctggatacaggaatcaaataagatcccagctatgttgttcctctcttcctccccaaagtgctcccagtcgctcccaccctctcagtctcagccaccctttctgcctctcacttctgcttcactcccaggcagatctttccacctggaagtgagttagacacaagcagtcttaggatgacagcctaacagtgtgtcccaaacagaagaaagcagtctttcccccccaaataagtctatggaaattcagaactgagctccaaatggtcagagagttaatgactctggccaggaatatgacctatgttggttgcccagacatcagcccacacacacactcctgacaaagaagaagtgtggcacctgcttcacacagatggcatgagctaacagtgtgcactgcacaggttctctagagagtgttgaggtgctatcaccagaacgagaatgctatggaacaatctctaccccagaacacacctgcatggtcatcatggtcatgtatttgcaaacttggtttctctctctctctttctttttttttttttttttttttttttgaggtgaagttttgcttttgtcacccaggctggagttcagtggcataatcttggctcactgcaacctccgcctcccaggttccaatgattctcctgcctcagcctcctgagtagctgggattacaggtgcctgccaccacgcctggctaatttttgtatttttagtagagacggggtttcaccatgttggccaggatggtctcaaactcctgacctcaggtgatcctcttgcctcagccttccaaagtgctgggattataggaatgagccactgcagccagcctggtttcccatctaattctctttctcccgtggaggcagggatgaagaagattatcttagtccaggatgctattagcctggatggcttgaataacaaacatttgcctttcatgactctggagcctggaagtccaaaatcagggtgccagaatgattgggtttttgcttactgccttcttactagctatattgtcacatggcccttccttggtgagacagagagaaagagagagagagagatcttgtgtctcttcctctttcataaggacacaatcctatcatggtgctccattctcatgacctaatctgatcctaattagctcccaaggtcccatctccaagtaccattacactggggattagagcttcaacatacgatttggggaaggacgctaacctactgtctacaacaaagctctactcactgaaatcacctacatttgcttctcctagaactcatcttgctgggcattgcttccaccttcaatttttgttaccaaactggagcactgtatccaggacctgaaatctgtgaactcaagggtttttggctttagcctcagccattatttttctattggttgtattctgatataatgtgaccccagattcagaaagtaggaagacaagttcttgctttgggggctgaaatgcaaactgaaggtgaaggaaggacaatgaatgctcagttggcatttcttaggtttcaagcaaagaagaagagatacaggtggggaagcaagtgatgatgtagcaaccagattatgtagttgttgatactcactgctttatttcccccactggccctccatagctttaccagagtcttccctaaacctggctggcagctgattagaaatgccaaatttctaatgccactccaggcctgctggatcagaacctacaatatatgacaaagctggcgggtcattcacaacaactttacagttagagaaacaccgctctgaaagtctgagtgccaggtactctgtggttcagggtgtggggagagatttgagatcctacacttggctataatgttaatgggacataattatttactaagctcctcccacaagcaaagtgaatttcaaggaagaaatgttgggcttacatgaacgtctcttctctttatggaaagttacttttcattgctaatattggaagactttttttttgtaagaaagttatattttctttcctgtagaccaaggttagttgtgacctcacatacctaaactgccagtcttggtcattaattcacaccccaactctgcttacaaaccgtttatccatcccctgccctggtttctaacatgattctttattacctgctcagctagcagactaaatttattcaattttcttttcctttggcacaatcagccaatcccaatgttgcaaactaaaatcaaaccagatgtgctaagaattttattgactattttatgtaacaagctgaatgaccagaaggctcaaaccaaattaattgaaaattaaagcagagaagatttaagccagacactatttaaacaggcttaaaaggttagcaaaggaaaagcacataatcagtttgtttgagtgataaaataagaagttaagctgaattggggagagaaaacttgcctcttgaactgtagatttatcttctaaatgaagtatcaggtgttttaatgtttttgcaattaaaaatgaacaaatatataaataaatataaaagcactaactgggccaacttcttgcatgttacactgaaaaattatctggtagatttgtaaaattgaaaacagaagctttgggaagtagtaaaagaatctgtgtctgtgaaccagagtgcactggcttcaaattcccacagaccctgtgcgtgttacaactcaccagtcaagctgcacaaccctgagttatgctccttacctgtgaatggaaatagtccagtgccccaacttatccaaggggaatatgtgccaagacccccatggatgcatgaaaactcagatgagaccaaaccctatatatgtttttttcctagacatacacacctataataatgtttaacttctaaattaagcacatcaaaatattaacaataataactaataataaaataggacggttatgacaatatactgtaataaaagttatgcaatgtgttctctctctcttaaaacgtcttgctgtactgtactaacctatctttggactgcagatactgggggcaaactaaaacctaggaaaggaaaactggatgggagggatgactgtgacagcaactctaaaggaccattgtacagattaaatgtgagtattgatttacagagcctgacatatactacagatattcagtaaaggagaataagtaatattgagggtaaaattgatagaggaggcatgtcaggagtgagattgtttgatgccagtgaacatttatttgacaaatccacttaaactgaaaaaataaagtcacctctctattttcatatttgatcttcaaagccagcagttacagtaggataggtagataatttcccaacttaataaatatggagggaatacaaacagcaatggggtccaatgatgatgtaaggtccccagccattctgaggcagagctagggctgaatcccagcttcccaatgacaaaagtctggggcctttagccagagcggtgcctcccctgaggatatgctactacgcatgtgatgtcccttgcagctgtgtcccaaggcccctgctgatgaccatgtttcccatcaagatagttgagacatgaaagagaagggctctgcatagaatcaacaaaatatcgtctccacaaggcaggcgatcttttctattccacggatttatctgaaatacatatttatcctaagggcataacaggaacagtgtcttgcctgtactaggcatcgggaatatttgttgggttaatcagcaagcatgtgcttccgtatagcaatggaaggtggctagcttacacagtctgtctgctctgggcaattttcatcttcacgaggcctgaatctcttaccttttttttttttttatgagcattaagttcagggagatggagtggttctcaaatgttagtttatgcataagaatctcccagggtgtttattgtaactgcagatttctattcctagcatcagaaactaagtcagctgattgaggtggttcctggaaccctgtgttgacattaatgctggcatattggggcaatgcattgcggtccctgatgtagattgtaggtggaagtgtgggctgtgtgtctgtgtttttgtgagtggaaaaggagggaggaggaaggtgttaagtgagaaagaaaagatttgaatgagtggaacttcctacttagtgggttggtaaactctttcccctctattaataataacttttatctccacctcccttctgaaggaaaggtcgggattggctagaatcgtaacttcccattacagtttaatttccttccttcctctaatgccccctttcccgtgcccaagccctcccttaacaaaccctcggagagagcaagaaaagaaaacaggcctcctcaatttccctaatgattcttttgaaaagcctttttttttttaaatttgtatttttagatctcttcaaacaatgttcctattagaaggttgtcaaaggccccgtgggatttatggaaattttcattaagaaaaatagggaataatttcaaggacagtgtctaatgtcataaaaatggctatttttaaagttatggataagtagaagaagcttccttacctcatgaaccgcacttgcagtgggagcttgaggctggcaggtggcagagggagacccacataggtttaagcccagcgctcagcagccccagggccttgtgcaagtgcctaaccatgctgagtttaatgccagtcctcgacactttcatgactgtttttctttaaatttagatgaaaatgagacagtctctgtaaataaaactcagtatatattcctggtagtgagagaagcactccagtactattgggttccttactctgatactgcaagacaacttcaagtcttctcacgtcttcctaagaatcccttcagatgagcttctttgcttcatttttttcttagattgtatcttttttctagactatttctaataacctatcatttttttccctgcctgtattaatccactaggattgccataacagaataccatagactgggtggcttaaacaatagaaatttatattcttacaattctggaagctggaatgtccaagatcaaggtgatggctggtttggtttcgagtgaggcctctctttctagcttgcagacggccgccttctcatggagtcctcacatagcctttcctcagtgcatgtccttggatggaggaaggaaagaaaagaatagggggaaagagagggagagaggagtgtggggagaaagcgagaaagaaggaaagaaagattttttgtctttttacaaggacaccaatcctactaggtctccacccttaattacttcctaaaagtcctttctccaaatatgttcacattgggggctaaggtttccattcaatttgaagctcaaatttcctatgaattttgggtacacatgattcagtccatagcactgcctaactgcagtccttaggttctctaattttctaatgctcccataggaggaagtaaatcatttgtacaagtcacctgacggtcacgtgtattcactcagtgaaactttgctaatagctgtctatatgatgaactctatactaggctctggtttgcccaaattagtaaaacatgatctctgcccttctggaatctaactgggagaggcagacacttaaaaaaattagagcaatagcatattacagatatgatcatacaaactggctcatggtactgcagggtacaaaggaagggatcatcacttatgactggaaatgaagattccagggaatcgtgaaataatggtagaatgtgatgtggaaaggaaacagaaggcaagaaacagcctggaacagcaaaggtaataaacaaactccagacaactcaaaggctctagaagctgaatggaagtaggtgacccagtgtgagccataaaaccagcatttcatatgggggctccttagtggaagaactgatagcttgctgaagagcaaattctttgtccttcaaggcattaagtgtattttaacaataaagtaaagtgtttgaaataaatattaggttagagatatatgggattgagtcaaaagtgagttttgcaagtgagtaagtctttagcagaattcttagtgatgagttatttctttttttatttttattttttatttttctgagatggagtttcactcttgttgcccaggctggagtgcaatggcgtgatctcggctcactgcaacctccgcaccactccccacccgccccccggcttcaagtgattctcctgcctcagcctctagagtagctgggattacaggtgcatgccaccacacccaactaatttttgtgggggtttttttgtttgtttatttgtttgtttgtttgtttgtttgtttttgagacggagtctcgctctttcgcccaggccggactgcagtggcactacctcggctcactgcaagctccgcctcctgggttcgcaccattctcctgcctcagcctcccgagtagctgggactacaggcgctcgccacagcacccggctaattttttgtatttttagtagagacggggtttcaccatgttagccaggatggtctccatctcctgacctcgtgatccacccacctcggcctcccaaagtgctgggattacaggcgtgagccaccaggctcggccaatttttgtattcttagtagagacggggttttgccatattggccaggctggtctcgaactcctgacctcaggtaatctgcccgccttggcttcccaaaatgttgggattacaggcgtgagccaccacgcctggccagtgatcagttctttcatcggggctattgaatgaataggattcagctctgggctctgaatagactggaaattactgtgtgtgcattttaacaatgtatcgagaacatttatcatgtttctcacttaaccctgtgccatcatcgatatgtaacagtcactcaggcttgcacattcaattcgtaccaaaaatagtctatgaggtaactactctcgattattatacgattaatcaccagtcaggagtggttagatttgttttgttttgtttcgttttgttttgttttttctgttacatttaggcatccaatcattaaatgtatttgtaacagaaaaggcaaaacttctagaatctctgttactgcaataggaacttgttcaaggcatagtccctaaattttaggatcatttgacactgaactgttacatcagacccacccaagaaaggtgtgaacagtagccaacagaaaatcaagctgcaggcactatttttgttcacagaattgcctagaaactcaaaattcagcttctgctctcacatacctctttctttttctgtcttaacatacatttctatttgtctcttgacctaaaaacaagaaaggaaaaaaaatctagctgtggctgtgtcctcacaccccttccacccgtggtaactgtctagaatttagattgtgccattgtctggatcatgccatcatgtctttgtggctaattgaggatacagcatacaccctaggcaggccagcccatggagagtaatgtggaatccaataaaaccacagggcaggcagggggagtgatggtgcgagggataccagaaacctttaatccagatcattcctgttttccattcaattggtggtggtttgcctaggaccccaaaactgtacttgcagatgaacttactacttttcttcctaatggcatcttcagacttagaactaaatctcagacttcagttgcttcccttaataactgaaaatatactgcattatattccttgtccttcaaagtagcttttgatgtgttggcccaacgggtcttttcagaaataccgtgcgtggatgatttgtagtaaaactgagatgctgtatattttccaagtaccagattcacaaggaataatgcgataatgatgccttgttttctcaagctttcagacgtgccggcctagagctggcaacatgcaatctcgtactacttcatctgaattactgaaatgggagacttctgtctgcattctattactgatttccgtgtttcacaacctgcagtttcctagtcttcaggggtaaaggaaacatagctcaaattcaaaagtgccttgccaaagccagtaagaaaagctatttctccttgatttgcagcgactcatttgaatctccgtagtgggccctgagagacccatattttgtctttgggagcaggcgcaacacagagttgattcatgattttagctgaggggacacattgaggcaccaattgactaaattattttcatgtggataatggatttagggccttcacttgattatgtctgacttctcccagtctaagctcaggattcccatcttgattattttaaattaataatatttatgagtttgtttgttttcgtttagaaatataatgcatgcttattttatacaatacaaaatatatgaaaaagaaaataaaaatctctaataatctcatcatttttacccaggcatttcaaaagccacctatgtatgtatttatccaactatcagttcatctattcatccatccatccactcctgcatatcctactttacgaatgtatttgacagcttattttatattatgagcatgttcttatctaataaaatatcattaattacatggtcttagtgtcggttgcaatttttgtttcaaaatttcttttaatattaagggaaatttaactgaatgtgtatatagtatatgcataagtatataatgcatacatcaaacaaacaagccttttttttttttgatggggtgttgctctgttgctcaggctagagtgcagtggtataatcacagctcactgcacccttgaagtcctgggctcaagcctccctagtagctgagactccaggcacatgccaccatgcctggctaatctttttaactgttgtagagacagtctttctatgttactcagactggttctgaactcctagcctcaagtggtcctcctgtcaaggccttccaaagtgctgaggttacagggcatgagccaccacgctgagcccctaatacgcctttctgtctggtcagtcagttttggatactacttagcctatgctatccttcctccatcagaggaaaacttgattatataatatgtaaaatttgaaggctaaaagggagctcagagaccatctggccctgtggttttcaaatctcaagggttccaaggaggtgcctcagggtttgctttgggccaaggtagaagcaagcagaacaaggcttctgctcggctatcactggagctgctccacttctctgttttataaatagtgtcaggtttcataagatgatgtatttttaatgtaatttaatttaatgtttagtataaacgttttgctgcttttaaaaaaatacttgaaagctgttgatcttgttcaacttctttctcaaggtggtcgcccctcctacagcaagcctgacaggtggctctgagaagctactttatctcccccagggattcttggctccgcatgaaagtacaaaccctgagctgcaaggggatcctgcatagcttgaaaaaaatctacccctcatggcagtgattaccactttaggaatttaggtatatagtctcttttgggtctaatgcatatgcagcatgagaaaaaaaatttctaggagtttctgggaaagaaagttcttcattctcatcttgaacagaaaagatggctctccttcctacctgctgatgtaagtcctgatataactactgcaactcccgataccagcctgaggatggaccatatacagaggaagccagagctaagagaactacagagacatagatgcagactccaacagaacctcaactacttaccgcccttgaccccaccttcaactctcaactgagttggttttattgccataattatttgggccagcaggagttggggattctgctgtacatccactaatgaatgtaagatgtgatcttcaccatgcctgcagaccacactttcctggaaagggttagtagccctggagtgggttagtaacctgctgggtgttacaaaagagaactagcctggggtcggaggacctgaatatgattccaagcgaaaccagataaattttcttcctgtgaagttgcctaatatctctttaactcaattagcacatgagtgaattggtgataaatatctataatacataagtcacaggactgttaaaaggttcacactgaagcatgttatgtattatacaaaatgtaaggaggctgtctcatatttgtgatatctgcagtgtgctaagaatggctctcacagccgggcacggtggctcactcctgtaatcccagcactttgggaggccaaggcaggcagatcatgaggtcaggagattgagactatcctggctaacactgtgaaaacccgtctctactaaaaatacaaaaaattagccgggagtggtggcaggtgcctgtagtcccagctactctggacgctgaggcagaagaatggcaggaacccaggaggcagagcttgcagtgagcccagatcatgccactgcactccagcctgggtgacagagcgagactccatctcaaaaaaaaaaaaaaaaaaaaaaaagaaaaagaaaaaaaagaaaagaaaagaaagaatggatctcatagtgaaccttcctgtatgccaaggtctacactaaaaacttgactttcatggtcacacacaaaaaaaactgtatgaggtaggtacagctactcaattttatatctgaaactcagatgttctttagaatcccgaatgatctgggttttagaaaggttatgttgagcatgcagtgggtgctatgcagcaacatctgcttagtctgggcagcacgccattattcacacataaatatttctgctgaagaatatgtggctatttacaccgggtggcttcaactaagaccataaaaacctcacatgacttcagggcagacttacctttagattaagttcaggtcagatttgacaacccaatgaattaataataatactaatagtaatgatgataacagtaataattttcaaacatttttgaaaattggaactataaactgtgctgttttatccaatgttaccaatacaaaaactaaagcatgcaaagtttaagcaaattttcacgtcactcagcttttaagtagaaaagctaagactgaatgcaagctgtctcaggagcctgagacagaccactttgcttgccactttgctcgccagtgctcacaaaggctgcctgcccatctaggccctgtccaacccaacagttaatggagccatctacattatctttctcaaagggcatttagaacatcaaaccatgtattccaaatctcagaatttttttttttctggagggaaaacaaatacactttttctgctttaataattctgtataacatattatttggtctaaagagaagttactaataggcaattattaaagtctaagagccagttgagatatccaagtacagttgcccaattgcagatcactgaggacactgatttaaaatacacatacacatatattcaaattcacaaacagacacacaccatacacacgtaggtgcacccttaaagtaatggaacatgtgtgtgtgtgtgtgatacacattattatattccagaacttttgctagagatgtgaagccagcagtatgctagacacagataagcagagacagcacacactccttttttgtttctttaaaaattgcagtgtgagtgataagatctggggttgaagtgtttgtgaggcttcataggggaaatgtaaaggaagtaagtgcttcccaaaagatgcaaaagtgcagcaagactgggacgatgagctgagactgcactggaggcagtggaggagaggaaaggagttgcagtcagcggccacagcacacaccagtgggtcctggttcagtattgcttggccccaaaactacaggcagagcatttgacagggatgagatcacagggcgaagcaaacaggggcaagtcacgcaggcctcttttgctatgtagaagagctgaattttttaaaaacattaacatctaaaccttaagtagtgttaagctagaaactgctgttaaaatataccttcaattcaaacagaatatatattttaaccactcatttttataaggcctagtgttaaattatggcttgaataatcagtaattcttcaaagtatggatgaatctgtctcacatttcaggtacagtgcagagacttgtgatcaggaaataatgagataattatattactttttgctccacagtcaggctttatcatttttaaggaatgtctaaaattctattaagtgtaattgttgaagctattaataaaccaagggaagagtttgaaaaacagcacttagagtttccctttagtttcagatcatgtctgagaatagaaaaagaatctgtataaaatcctggggcagaatattttgcaatattttagctcaatccaatgttaatcctggctacacagcctctctgttccctaagccagaaaccccaaaatctccttccccctcctctcctacctcccacttccaatcagtcttccatctctatctcctaaatatgcctccctctatttctctccagtccccctgcccacaccatcattacagcacctactgggtccttgtgttgtcatcaaagctcaactctccaggcagtcttcctacatcctctcctctagttgggtagaactggtaactcccctcttttgcgaaatacccaaacctcctgggatagtttttagccttttccactgggtatctgtctcccttcctgctctagctctggcctaccctacctgttgagaggaaggatggtgctacactccgttttcctctctgcacttggcatgctgccaacacattcacttgttgagtgaatgacaagatacctataaaggttctcttgcccagttatttcattccttcatttctgtaagtggcttttcctattaattaacatgctcattaatacataagtccaaagcagatggcagttcttcacttttgggattttcagcacattgatatgataagtggcaaaaaaaaaatgtatgtaaacaactcattctccatgatattaatgaagggtctctcattccctgttaaaggtatcaaagactattttgtatcaggattctgccttctggtcacatgaagaaaagctaaacctcaaactggcacagttgaaaataagtacctgattttgtatttcagtgtagactggggtatatttgactcttttccagactaatgttattgattttgatcatgtgtttggtgtgtgtttgtgttgtcatagactccttttagaaattatgcagtcatttttattttccacattactcatctccattctcgaggtcagggtttctcagcctcagcatggttgacattttgagccagataattcttcgtgggggcaagctggtatattgcaggacatttcacagcatcactagcctctacccactagatgccagtagcacctttcccctatactgtgacaatcaaaaatattcagaaaggaagggggttgggaaggtggcaaaattgcctcaagtgaaaaccactgctctaggtggccagtgcaacgtgatggctatgtttttataactccttccacagctttataactatatattaaaaggcatgcatagaattttttgttattctttgtttataaattaagattgtatcccttctctacttcctccaagtcaatagatatgataccaactgattctgttttaatgtccacaaaatcttccacggtacaggtatgttacagtctttttagccaacgctccctgtgtgaacacccactctgattccatttacgtcgtaacatacaattccacaacaagcacctttacagttatatccatttatgctgcctcatttatttctatagcctaccttccctgcagtgagatttctacactgttaagcatgtggatatttaatggaaacagatgttgatagattgctttcctcaaaggctgtcacaatagaaattttctccagcaatgtatgagagcacctgcccaccagcactcattgtcaaggttctactttttaatagatctggagtgatatcccattgtcactgtaatttgcatttccctgactaatagtaatattgaagaacttgttgaataaagtgtctaactgaaatagtgtgacctcagacatctgcaaggccccaagtcccgcatttactgcccacttctgatttctggagcagctgccacagccactgacatgcaagctcagactcacctgacctcacatgctctaaaattacgctgtatgttgtaaacctttaaccccttcatcaaacaagctttctgtgcaccaaaagaaggaaaaaagcataaagattcaagaaccttatttggcagcattcaaggaaaaaaaaaatactttcctcataattaaattgtctgtatttaattatttaaagtattttcacattttatgtgaagtatttctcacattttatgtgtgtgggtatttgtgtgttgagcctgtgtgtgtgtgtgtgacccctccaaacagaaaatgtgagacatgttcactggtggaccgtgcatttctgatgccaaattaagtattctctgtttttaggaatgcgtcacaatgggaaaagagatcaattgtaaaatgaatagctgctgggttgagtttaagggaagatggaatgctctgtgagggagaatggagtcgctatgttccagggctatgataagcagtcattctggagatcttgtaaagtctttcaagcagcaactgcagcatagctccacagaggatgagctgaaggaaacaagcttaccccattgtaaggatgcagaggaaattcagtgctggagctaaaaataaagaaaaggattagaatggctgggcgcggtggcctgtaatcccagcactttgagaggccgaggcaggcggatcgcctgaggttgggagttcaagaccagcctgaccaaggtggagaaagcccccgtctctactaaaaatacaaaattagtcgggtgtggtggcacatatctgtaatcccacctactagggaggctgaggtaggagaatcacttgaacctgggaggcagaggttgcagtgagccaagattgtgccattgcattccagcctgggcaacaagagcgaaactctatctcaaaaaaaaaaaaagaaaaagaaaaagaaaaaaagaaaaggattagaatttcttttgccttgtgttttcatcatctaaaaaaggggaaaagtataaattccactatgaatttttttgaaaaataaatttcagcataaaggagtacctgctcattagagtaaattcaaaacaaaagcaaaaacaaaaatgttttaatagacatcttgcagtggtggtctagaaaatgtatttttcaaggaagtgtggttagaaattaatagaatgtctccaaggttgtagtattgggttgatagtcccaatttccattctgagtttttatgtactctggatcttttaaaatataaaaaaattaggaagttaaggcaggttctgttaagaggattctaattttaaggctctaaatttaaatttaaaatgcttatatcggccaggtgaggtggctcacgcctgtaatcccaacactttgggaagccaaggtgggtggatcacctgaggtcaggagttcgagaccagcctgaccaacatggtgaaaccctgtctctactaaaaaggcaaaaattagcagagcatattggcacccgcctataatcccagctacttgggagactgaggcaggagaatcgcttgaacttgggaggcggaggttgcagtgagccaagattgcaccactgcactccagcctgggtgacagagtgagactccatctccaaaataataataataaaataaaataaaataaaataaaataaaataaaataaaatgcttatattgcttttataaaccattttcttatagacttagttttcaaaacaaatctgtaaagaaaatatattattctcattcgacagatgacaaacaaaatttgtcagggcttggcacctgcagcacaggttagagattgcattcattcccagctctgccagaaaccaggcaagtcatttaccaccaagtgttagtttgttacatgtttgagagggcttatcatctgtagatactcaagttaacctaagaaattttactacagtcaaataccaggtaggacaggcatgtaatataaagggggtaagaggataaatgagtaaaagggtaaaaatggtatttgagaatctatattgcagcaaaatgaataatgaaaatcatgataataaatcagggtcatcggtatgtgtgcaaagtaattatttagtagagctgttctgtccttgttcgtatagtctcagctgaaaattgactaacagatatggcatattattagctgctttgcaatgactccttgggcagttagagttttctgaggaatacttgtccatggagcaggtcctcaggtgatgaaaccatcacttccttctggatcccacaacctcaccaggcagaactactgtctacttgcagtcctcatgctgcctctctaaaattcaaagaattcaaaattatcttttcaataaacattagctgagcatctaacatgtaactagcaatgtgctctgttctgtaatatagaaatattaagaaggattagactatgcttcttcagtgcatagtcttctaaagtagttggcttataaacaaaaaacatttatttctcacagttttggaggctggaaactccgagattaaggcaccagcaggtttgataacagatatggcatattataatcttataagtaatttggtaagtttatgatgttatagaagttaatgtgcaaggcatacaggagacccatgtgtgcccaagcgggtcaggaacactttcccagaggaggaatttgatcaggtgacagaagttctcatgcaactcagaaacttacaaaacagagatctcagatccttatctcatagcatctccagttgcctgacttgatcctaaggctgtaataggggagcaccaaaacagaatcccatagactcaagtcaagacctactcttataaacaaatggaaataaagcttagtacaagtgagagaatcttgtgtgccctatgagtcatacccttcagcaatgtgtctcttgcatcactgaagctgtgcaagggaatcaagtgcagcaaataagtcaggggcagaggttccatctacaggagaggacgacacctgtggacccgactctgggaggcagaagcacctagcctgaggtggagattcaagcctcatctatgtatagccctgacacagcttccacagcaccctcatatcacatgcaaaggacaggtgtgtcttccatttagcctgctaaatcaggcctgccaacccctgcctcctgaggaggctttcagaattaactagaccatgttggcagctaactagacagctaaggaaagaaagcattacctcatctttgcactggctcatttgatattccaccttcaattactccaactgaaagttgaaataaaaataaaaagttatggcctttgtgtgtgtgtatgtgggtgtgtgtggatgtgtttttgtgtgtgaaaggagaaatagagaaagagagcaatagagatttgaggttttagagacagagagaaaagaaggagaaagtatttgtgttaggttctgggagtgcaatttgggaaaagtagagagcattacgaaaaaaagagccaaaaatacattcattaatattcattaatttgcttgtctttttaaagacttgactatctattatgggttaagtactatgatggacagtgaggatgtagcgtgaaccagacagaaatagcccaattccatcacacctttagttcctagggaaccactgaattggtaaaaagttcatgtattcttggaattctggtggcagttctatttcaccctgaagacctgaaccaactttctaggcagcctgggagtccaggacacagacacagaaggagttcccagagccagagtgaatatgaggttgtactgacattgactgttgggcacagagcccttgtaatgaaatgtctaggccatagatgtatatgtcagatttaaataggtctgagagacatcaaagaaagtggaacttggagaatgataacgaaagggagtgagatttgcggtaaatggaatatgggactcaagaagaatgcctggagtgcttgagcctaacagccagctaattgggtcccttgagtttggagggacgggtaaaaagtgggaagccaaattagatgtgccaaccaaaggaagttcaaaggtgaatgggtttctttccttaaggactttgatagccttgtaaactgacaatgctgaaacaatgtggttagtgcaaggaggaggagacagcctgcatgctgtattactgatcagacagagaaggcaagcaggaggactttctgtaggactttctggaggagaactcagggaagagaaagaggaagttagcttttcgacaatggaaaaggggcattttataagacaagctttcatgaatctaaggtttttgtagttctatgagtttcaaggcaatcttgattgaagtattatgagtaggaaagacataagcacacggtttgtgaaatgctcttttattctagctctaagtagaagagtttcacacttaatgaaaataaaggagacagagttattcattcaggaacaggatgctatggcttgaatatttgtgttaccacaacattcatatgttgaaattctaacccataatgtgatggttttaagaggtagggcctttggaaggtgagggtgaagccttcatgaatgggattagtgcccttatgaaagaaacctcggagagctgcctaacgttttcagccatgaaagaacatagtcagaaggcaccaaccatgaacagggaagacagttctcactagatatcaaacctgctggtgtcttaatctcggagtttccagcctccaaaattgtgagaaatacatgtgttttgtttataagccaactactttacaatattttattatataaacttgaacagactaagacacagcgttttcatgatgaggtagtgaggaattaaactggtatcattaccactaatgtgaaagggagaagacaattcacaatcacatcacggaattctgtaaaagctttatctcatcaatgatgtttctctaatacagagtgtctccatgaagtgatttgtttttttatttcatttttggcataagataaactggtagaaaggcattcatcttggggtaaaaaaactttggctgtgagctccaactctggaactcattaacataatttaagacattgatcaagtcactttggctccctgagcctctatttctctacctctcaaatatgaaagggaggtgaggccatttcgaagcttccttcccagtagaatactgtacatttaactatatattgcaaatgagagtgaggattgataaataggaatctgtttgccttaactcatattcatttaaagaaattgaagaaattatgactatagacctccactagggggatgagccatgcttgctgggccccattctacttgcagccctctaaaatgagtgagatggctcagggctttgtacagggagtatgagcatgaaccacaccagctaaaggcttaagatttcagctcagccatgctggctgcaacaatgaagacatgaaatgagtataaggaggataaatgaagataacaaataagtaatacataggattaaatgtttgcaaaatgtgccagagtggagtgcagccacgggagacagccaaagtacattaagtggagacagaggagggaaggtgaggatgatgtttctttgtggaaggctcatcatcaagactgtatccccagggagcctgtgcatggggattaccattactcataagccatgtgcatggcctgtgcaaaataagcctccacaaagttgtgctgtaattatgaggatttcagcatgatttttaaagcactaaacttgtttttcagccaagatcttctggtgtgcatttgtgtgtgtgcctgtgccaacatgtgatagtcgtgggcagaaactccaaaagtaaagcataaagcttttctcatatgtacccccaactatgattaaaaagcctgtgcttgacagagaaaaaaacaaaataatattttattagaaagtaagtttattaaagcagctaagaacatgggctctggaggcagattccttcagagaggaaatctctgctgtcaaatttattagtagatgtgtgacctaaggcctacttcagtttcttcattcttaaaatgagcattataggccaggcatgatggcctatgcctgtaatctcagcactttgggaggccgaggcagcctgatcacttgagcccacgtgttcaagactagcctgggcaacatggcgaacccccatcttgacaaaataaataaatatacaactataaaaataaataaataaatacatacatacatacaaatattagttggggatggatgcacacccatagtcccagctacttgagaggctgaggtgaggagatcacttgatcctgggaagtagaggttacagtgagccaagattgagattgtaccactgcactacagcctgggcgacgaggttagatcctgacttttttttttttttttttttttttttgagatagagtctcactctgtcgcccaggctgcagtgcagtggtgcgatctcagctcactgcaagctccgcctcctgggttcaagcgattctcctgcctcagcctcccaagtagcggggactacaggagcctgccaccacacctggctaattttttgtatttttagtagagacagggtttcactgtgttagccaggatggtctcgatctcctgaccttgtgatctgcctgcctcggcctcccaaagtgctgggattacaggcatgagccactgcgcccggcagatcctgttttaaaaacaaaaactaaaactaaaaaactgaaaagaaacaagcattatacaaatacttgtaaacaaaattctaaccctctccccctacagccatctgaaaggacccctcttttcagctgagtgcattccaaggtcaacctgaaaaactagttcaggccatgatggaagtggggttttgacattataccctcctcagttttgtaattcaggaaaagccaaccagcattaacatcaacacagaccttaaatctgatgaaaagcatttactatctattctctctgaagtctgctagctggaggcttcatctgcataataaaaccttggtctccacaactccttattgtaacccagacattcctttctattgatgataactctttcaaccaattgccaatcagaaaattttaaaatctatctaagaactggaaggccccttcccctttgagttgtcctgcccttccagatcaaaccaatgtaaattttacatgtatttattgatgtctcatgtctccctcagctgtacaaaagcaagctgtaccccaaccacttgggcccatgtcttcaggaactcttcagactgtgttaaggacctatccttaaccttggcaaaataaactttccaaattggttgagaactgtctcagatacttttatgtcataagattgtcgtgaaaattaaatgagtatttttacgttacaaaagaaatagagcagggattgccatatagaatgtgctcaaaattgaaggcttttctgaaaagaatgttttaagaaaaaataaaaaaaagcagagctacagaaagaagaaaagttttttaaaaaagttatgtttaattcaggtcctacaacacatttttttttttgaaggacaatgtattgttcccatttttcatttatcatatataagataaatgagttctagcaagttggtactttagagtaaaaattccacaggggaaaagatggtttctacattgcagattttacattgatgttctctgttcttcaaaccagtagttttgtttttatccttagcttccatgcatgaggcagtgggttcgtagctaaccttgctcacattataggcatgatttaaagtatcttgcttcttactcagaattatttaagctcattcaattcttgaactcatcccagagctcaatccaaaatctccattttttgtcccctaaattagttccttctcccttctcacaccccaggagatggattaaagtttccttctttttatcactctatttaagtgcttataagcgttgtcttttagcaaggcttctcctcaaagaaatgcaaatgataaaggcgcctgtttgttcctgcagaggataaaaagaagagtgaagtatgcgatgtctctgggagaataagtttttttctgaacagttctaataggatggggtgagataagtagttctttaacagatatacaaaagaaaggcttgggaggtctaaagggggtagttttttatcctgatcaggtgaaaattaaaatctttagaaagaagatggttgtagaaactgctggggaaaagggtaagcttcctctttaccgccagaaggttcactgaaataaactgacaatagacaggttaaaaggagaaaaggcatccatgcttatgaacctgcataaccatgggagccatatgaaataggagactgaaagaagggccagatggctgaagcttaaataggacttcgtaggcaagaaggagacagggaatgtaggcaactttgaagggtaataaatgattgctaggggaagtaaatcggcccaaagagcaacattttgtaactggttctctgaaaactgaatagaaccaaagacaagacagtagcttgggataaagttcgtctgagctctggaggaagtgggaagtgaaacttcattgtgaacaaagattattttattacatagataaagtctcccaggtaatttatggaaaaaaaaatgtgtggtgtggtgacaacttttagttctttcttttctcaggtggttaatctttccaggttatttgataagactcttacgaagcaattttaagacttgcatttcttttgaaagacctttcctcagtcagataggggaacttccagagatagcccctcagagaaacaggtgaaggtgggggttgagaaataagagaaggttagaaagtccttggttctgaggctgcttctacagtcttccaactgcctttaattcaaaggtgctcagcatgccaaagctccataccttggtatattgtgctctgagccctaacatttccctgctcaaatatttctaaaagtttcatacatcaaaaactaagttggtggccgtgaagaaaaaaaacatatattttagtagctcggtggcaaaggataccattaaaccactctcctatctccgggtatttgtcagtccaattaaacagttggtttgtatttcagaaggtagtgtttggaggcttcccattaaagttaagcctctatatggctcaagcaaacaggtctttagcaagaggcatttttgtgggcacagaggaaaaacaatggttaatgtttggtgtagtctacaagctagttttttgtttgtttacagtttagaaggcagtcagttgagaagattcctagatttgggtttgaagtatcttcacttggaaatgaaccaggcagtggcaatctcacagatttttctgaattgtagtttatatcagatgttcctgtgaactcgccccaaaattgtacctgtaagatttgggtggattcttctcttcttgaggctcgaaatagcatgaggctctgggacctgtcaggaagtgacattttttacttataagactagaaactctgtgaggaaatcctttattcaaggtatgaggccaggtttccaggggcttctatagctttataatatcaacctcagttcctcaaagctgtctactcatattggaagatataatattccagtcaaagccttggtaatataatcagtgcttccaattgtcctgttacaaaaagagcagatacttaatgaacttatgcaaataactatattgccataataaaagcatactcacaaatagtgatatggttggtccccactcaaatctcatcttgaattgtaatccccataatccccacatgtcctggaagggaatggtgggaagtaatggagtcatgggggtggtttccccatgctgttcttgtgatagtgtgtgagttctcacgagatctgatggttttataaatggctcttcctgcttcacttagcacttctccttcctgctgccttgtaaaaaaggtgccttgcttcctcttcaccttccaccatgattgtaagtttcctgaggcctcctgagtaatgcaaaactgtgagtcaattaaacctcttctctttataaattacctagtcttagatatttcatcatagtagcatgagaacagaccaatacaaataatttccaaattttagagaaatcatgcaaaaaaaaatgcttcaattatgtttacaaaagtatatattaccaaattgctggaagtcatagaatgcttaaaaaatgtctttttgcatctggaaaacaaaacataaaaagaatcagcaacgtttcaaacaaaattcataaaaattataacctctcattagtttagttccttataattaattttgttctacttgatgttgagttagcaatttcatgagtccagtttttgcattagttttggaaattcttaccaggtccaataatatcagaaattaccagaaactcatacttgtcggagtccttttttttccatatatctttaaagacaacagtttataattaatttttcccatatgtccttaatgacaacactttataattccctataaaaaagcttcagacaaaacatcagaataaaacaattagctttaagcaacaagaattaaaatgaccatggttgaatatctgatggtagttcattataataatgtcgcaaatgacaaggaagtttgcttatatttgtagccgacaataatttaatagccaaaattatgactgataacatataccatgacatatcagatatttaggaaactcataaaatttggaacacatatgaatagtatatctatgcaagtgtaactcaaaagaggtcaaacctaattttttatttggcagtgctctctatgtattaaacatatcaaataaccttaattggtttgttatctctgttttgtacctttaggtgctattctggaacttccaaaactcagtttgaggtcaaaaagacttcatttgtattttggaattttttttttttaaataaaggtttaaaacacttcattaaaaataggatcacagattattacaaaataatagtcattcattccactaaccagaattagaattaaaaggctcaaaagaaaatacaagatgttaaatagatgttaaaaaaaattatttactctttcatagaaagtagactccatttttacagctaatcagaagacttagaaaagagagcacaagctcacagaatgtgtctctctcactcatcctctttttgtaattcactcaaaagattaacaatttttttaattttaatcttttatcaatattacatgaaaatcttaattcaaagaaaacattaatgtttacttttgtatcagtgtacttttgatattaaagctcatcttaagaaaagttcataaataatttccttttaatctttgtcaattgattacacataaaatttttatgattcatcctttataaaatttttataactttttaagacattttacaacttttttaaacagatatatatgttttactcatgtaactttctataaatctctctcttctacttactgatttctttctaccttgtttatttctgtactaaatccatatttttaaagaaccttttaaaaacctctacattggacaaaaattactttttctttaacaaaaatacattttcatgtctatttaaaataatttttctcaccaaaacacacttcttacttctcttgtatatcttgcacacagaattgtttccattaattttagtaattttaattacatatattaattaaaattttaattattagcaattgtaaaccagcattctgtagactaacacaattttatactttctataaatatgtgttacctcatagaataacatttcaatgtggaatagtacatatttactaactggcccaaatatattttgtctttttataaacttaagaaaccaaaaacaaataaacatatgtttaataagtaatgttttaatatttcatcttacttggaaatgacctagatattcaatgaacactcatttaatttaatttagtaaaactctaatgatgtagttaccaaagagatttagaaaaactttaagtaaacgtaatataaagcataattattattttaaaaagttcatttctaaacttttattccagttacatgtatttaattaacttgcatttaggtcaaattcatactgttatgattttaaacatctaatagtgataaaagttgtgtgtctgtattagatttaatgttgacagacatcctatttttaaatcaagtaatgttatttttatttaccaaagattataaatccacataaactttagaagcatttgagcttatttttttatttataaatgctcatttatcactaagtcaattcagtaccatgtagacagaatacaaacccaaagatatacacacgcatacataaaaatataggcagaccaaaataaagaatttatagctctgattttataattttaatcatgaggcaagtaaaactcactagtttaaaaggataattggagcctggcgctttggctcatgtctgtaatcccaacactttgggaggctgaggtgggagaaatgcttgagccttgggaagttgaagctatagtgagccgtgatcgcaccatggcactccaacctcggcaacaaagcaagaccctgtcttgaaaaccaaacaaaaaaatgaaaacacacacacaaacaaaaaaacaaaataaaaggacaattggatacaaactgtgtctttgtaaatggagcaagttaaagactgtctatctcacatggacaaagcccttattgaattttagaaaagacaaggtaggaaatttacatatcatcagcacagagaaagaacataagtttttccaagaaggtgtttgggtttgtcaggtggaacaaagaggaagatttaaaatatatgtcaatgtaatataaaataatagcaatccattacaggattttataagaaagtatacaaatgagagcctataagaaaagtttagaagcctgttttaaataactgattgaatataagaaggttgtagttcaaagaccaattttgttagatagatggtttttcaattcattttttgtttcttaactggattttgatttcaaggcagagcccggtaacaaataggaccaacaaagaatttgtggcttctggggcctaatacttatacatgtaaaagacaggtgtaactggaaggcaaagtactaagatctttaaaaattaaggacctaagcatgcaaagaaacaaaacaaatctgaatttgcccgctgcataatgaccagtactgtaattgctgccaattatctttaaaattgctggtcttgctggtgactcatgagttaataaacacccaaaggtcgagtgtcctcttacagtacaaagtagcccttggtactcctaaaaacccaaaagatcacacagctgactgtaaaacagtgcagagcttcagacctcagtggatgtagtccaggactctcggggctccatgaggaaggctgaggagcccaaaaatgcgttgtgtggtgccttttctgtgttccttaaggggtgtctggattgctaaaggcctatttttgatgtttttatgtaataaccagaagtgtgatgttttctattggtaattttttatccactgaccaccaaatggaggaggtagaagctttaagaaaaatatatcaagggaaccagatggaaggttgaggccatcagaaagaagtggaggcatcagtaaatgaaagaacaaatcatagaagagtcagcttgggagtttttcagaaaggcctatggagttttacactatccctggcaaaaatcatgtccacaagaaagaaagacagaggaaacagtgcatatggttaacaaggattcagaaagaggaagtttcagtccactgtgaagttttcatgggagaaacaggatcctatagagagattagaaagacctaaaaatgtggctgtttttaataaaacagttttttactttaaactgaactgaattggggaaggaaaagtctcagtcaggaatccagacatccaaatgatcttctggtcaaaaggattttacttttgttttaggtcagatttttgcttttcattttattagaagaatttctaaggcttgttgtgacactattatgtgtttttctttcaattcaatcttcccataaatgccaattgtgtaattgcataatatgagagttgtctaattttttttttcaaatatagaagactttccaacttaaagaatatattgtctggttatcgacaattaggatctccgatggtacatttattccaacagagactcaatccaatgaacccctttatggaatgactagatgctaaatctccaagttcagaataaactctttaagcaggaggtttccaaaaagggtgcagaagatgcagttgccattgcccccaaattttcatccacagaaacagactaagacggcaaaaagatatctgctaccacaggtggttaaagatggtgcttacaaatagtgtctctagtctccacccaaaatatggggtgctgctagtcacagacctgtcaatctatgacattgggtaggcacttctggtattagactttctcaacactaaccaggcaaccgaagttgaaataacaaaaggcccttagggatgggacttcttattaagagaaactcccctgagagctttgtacattcagacaaagagagtgctgctgaataacaatttgtgtcttgggtttccagtcttctcagactggccacttggcaggacccaaaaattgggctcccagctagcaaagaccaaaggaggaagattcccacctggtcacaaagccaggctgtcaggatataagatgaaaagagaactttatacaccaaagttctttttatgatgaatgacacaaaaagacagggacagagcaaaatgaagaccaattctgggaggaaaaggatgagacgacatgaatattcatactagatataaaccagagttgtaaagaccagtccatacaaatgtttttctcctattaatctaaatttgaaaaggaaggaaagacaggaagtgatgtttaccactcactcaactggattttgtagacagaaattaaggaggctgactggtaaaggtctcttacctttttgccagcttgtcagtcctaggttttctcaactgtagtttcaagtggatcacgatgattgtggtatactgccaactatgccggatttgcaggggtgaaaaacaaaacaaaacaaaacaccttctacctcaccctctgaagtttgctgaaataaacggataacataatgattaatacaagaaaggacatacatatttatttatgtggacaagcttaggagccgtacaaaacacgagacttcatgaatgactaggtggctgaagcttaaataactccctccttatagggatgagggagataaaaaaaaaacctaggcaattctgaagcgtagtaaatgttttttatgagaaatgaatgggcaaagagcagataacagattttaaatgatattctttggaaatgaaatgggaccatagtacagataatagcttggaccaaggaaggtgaggtacagaactctgctataaacaaaggttgccatattatacaaaaaaagtcttccctccctaaaggggtccaatttttgggtcctgccaagtggccagtctgaaaagactggaaactgaacacacaaattgttattcagtagcactctgtttgtccaaatgtataaagcagaggttttctttttttttcattatactttaagttttagggtacatgtgcataacgtgcaggtttgttacatatatatacatgtgccatgttggtgtgctgcacccattgactcgtcatttaacattaggtatatctcctaatgctatccctcccccctccccccaccccacaacagtctccggtgtgtgatgttccccttcctgtgtccatgtgctctcattgctcagttcccgcctatgagtgagaacacgcagtgtttggttttttgtccttgcgatagtttgctgagaatgatggtttccagcttcatccatgtccctgcaaaggacatgaactcatcattttttatggctgcatagtattccatggtatatatgtgccacattttcttaatccagtctatcattgttagacatttgggttggttccaagtctttgctattgtgaatagtgccgcaataaacatactggtgtgtgtgtctttacagcagcatgatttataatcctttgggtatatacccagtaatgggatggctgggtcaaatggtatttctagttctagttccctgaggaatcgccacactgatttccacagtggttgaagtagtttacagtcccaccaacagtgtaaaagtgttcctatttctccacatcctctctagcacctgttgtttcctgactttttaatgatggccattttaactggtgtgagatggtatctcattgtggttttgatttgcatttctctgatggccagtgatgatgagcattttttcatgtgtcttttggctgcataaatgtcttttgagaagtgtctgttcatatccttcgcccacttgttgatggggttgtttgttttttccttgtaaatttgtttgagttctttgtagattctagatattagccctttgtcagatgagtagattgcaaaaattttctcccatttttgtaggttgcctgttcactctgatggtactttcttttgctgcgcagaagctctttagtttaattagatcccatttgtcaattttggcttttgttgccattgcttttggtgttttagacatgaagtccttgcccatacctatgtccagaatggtattccctaggttttcttctagggtttttatggttttaggtctaacatttaagtctttaatccatcttgaattaatttttgtataaggtgtaaggaagggatccagtttcagctttgtacatgtggctagccagttttcccatcaccgtttattaaatagggaatcatttccccatttcctgtttttgtcaggcttgtcaaagatcagatagttgtagatatgcggcattatttctgagggttctgttctgttccattggtctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtgggaatggccctgaatctacaaattaccttgggcagtgtggccattttcatgatattgattcttcctacccatgagcatgaagtgttcttccatttgtttgtatcctcttttatttcattcagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacgatggcattttctagataaacaatcatgtcatctgcaaagagggacaatttgatttcctcttttcctaatcgaataccctttatttctttctcctgcctgattgccctggccagaacttccaacactatgttgaataggagtggtgagagagggcatccctgtcttataaggagttcttctataagggccttttgttattttaacctcagttgcctggttagtgttgagaaagtctaatgccaggagctggcctcaaaaaatagataaaaagtctgaatgtgtgtggtgataatttttagtcttttctcctctctggtggttcatctctgctgattagtgagattcctagggagagggttttaatacaattgcaattttctttagaaaaaatttcctcagtcagataagggaacttcagagagagcccttctctgccattggaggttgcggaaaaaacaagaaaaagttaaaaagtccttagttctgaggcagcttctgagaccttcctgttccctttatttcaaagtgctccaaataccaaagtgccatactttgggatatttttcactgaggtccaacaaaaccaaaggttatggttgctcatttgaaaataaacattcaggtatggtgaatagtgaggtgaaatgtcatgaataatgtcaaaagaagagcagatggtcttatggattatattcacagaagagctgtaacataatctatctgagacttggggtagtcatggaggaaaaaagttagatgggcttagagagaaaaggaagaggactattcttgctgagtgccttatgttttctcagtttcattcaatcacactgtaactttgagaggtaaattttatacccacctttacataaagaaagttcttggacttttaaaaactttgacaagcattgcttagctagaaagttctagaaccctctctctcccattccaacctgaacagtaaaaacacattctttaactttattcaataacgagtcaaggtaggtctcttgtcagggagacaaatgaaaggctcatattttatatgtctccagtgcacttggcataatcaagagtgtagtataattaaaattgtagacaaaggaatgaagaggattaatgtgttacaagtttgttgactaggctggagaaaagaaaaagagacagctgactagtgtggagtgtaatatcacagaataatgatatggtaaactgggccttgtaagggcaaagggaattgtttccttcccctctgaagttttgagtttgcaggaggaaatagacaatagattaactggagaaaaggaatacaaatttttaacatacaaatatgtgtaattgcctgatgggtttttcgtgctcactgtacagacaaaaccaattcactgagaccatgacattgtattaaagagtttaattgatgtgcgggcaacccacatggggaaactggagtcatctctcaaatctgtttccccaaaggcttggaaggttaggtttttgtagacattttggtgggcaggggtgagggaatgggtgatgccgattggttggagatgaaatcacaggggtgtggaaagtggttttcttcccctgagtctgcctctgtgtggggccatagaatcagttgagttatgagtcacaagtcttgctggcgtcagtctgaaaaacatcttaaaaaaaaaacttagaatttgcaatagagatgttatctacaggaacattgggaaggtcacaaatcttatgacctctgtccacattactcctgagcagtaaaggattataggaagtatgtccacaatttcagcagagttctgtcctctctcatattcataatcttgtagcctttcattatttttacaaagggagattagtctggggaagggctattatcagccttgttttaaggttaaactgtcaattaaattcctcccaaatttagcttggcctatgccaggaatgactaaggacagcttagaagtcagaagcaagatggagtcaactctatcagatttctcttactgttataattttgtgaagatggtttcatgtgcactggaaacatacaaaggataagactcaaaagaaagtgtcagatagctgagactcaaatattctctttatgggttggggagcggggtaggaaaatgggatatgtaggcagttttgaggagtaatcagtgattttcagggaaattgaatgtgcccaaataatataccatactctgaaacaaagcacctctgagctctggagttgtggcaacaagttgtgggaaggtaaagggtagaacttcactgtgaataaagattgtactattattcaaacaaagtcccagtaatctcttggaaataccctaagaagaacagataaagtccaggctcacaggtataatcccaagctgtttgggagcctgagatgggacgaccccttgagaccaagagttcaagatcatccagggcaacatagtgataatctgtctctaccaaaaacaaacaaacaactatatatatacacatacatatatatatgtatacatgtatatatatatatatatatgcgtgtgcgtgtgtatatatgtacacacacactatatgtatatacacatatatatatacatatatatatatagacacacacacatatatatatatatattaggtgggaagggtggtgtgcacctgtagtcccacctactcaggaggctaagatgggaagactgcttcagtccattgcagttccaggctgcagtgagctatgactgtgccactgcactccagtttaggtgacacggtgagaccctgtctcacacacacacaaaaagaatccataaaaagtctgtctggtgtgtctcacacacacacaaaaagaatccataaaaagtctgtctggttatttaaataaaacttctatggaggagttttaagacacttgcatttcttccaaaagaagtttgcccagtcagacaggggagcttacagagacaacccctccctgagttgggtggagtactcagaaacaagacatggttagaaagtcattggttctgaagctgctactaagtctctttcattttctttagttcaaagcaataggcaagccaaagtaccatactttggggtatgattttctgagccccaacatttgcctctctgaaatttccttagaagttttacacattaagagctgagttggtggctatggagagaaaaatgttagtaatggaatggcaaagaatctcattaaacaagccttccatttctgggactaggttggtccaattaaacaattgtgtcttatttcaggaagtggtgtttacagagctcccatcacagttaaggtgaacgagtctttaatatgtggcatttctaaatcagaagaaaaacaaaggttgaagtctgcggcaatctatacactagtttctctggattctggagggcagtcagttgagataatttctagatttgagtatgaagcatcttcagttggagcagaagcagtcagtagagatctgacagatttttctggattgtagtttgcgtgttatgagagaatgtctataaataagctgttgtggtgatttccctgaaggttatatcaagctgaccagttttgtcttgtagggcttcagaaaactgataattttaattttagttatctcaagtcagaaaattgggagaaaattggaaatgctgtaatagtttggagactcataaccaggtaccggaggagaccacaaggaatgaatatccagtccaaattacaagcaaaggataaaatctcaaacacgataagcagggttagaaccgaaaaatgggtatattatagttttcttctgaaacatgtgttttctctcttcagtcactctaatttttaccaaagataatcacaggaagtccaatttgtttgcaaaaatgagtttaaccatctaggttcttcttaagactgtgttgctgaaactttgtatgaagaatctcaaattaggcttttaaaaggcctcttacaggtgtgcagccaagccagagacacaacctcaaattctgcccataatacctgtagatttgggttaatcctgctcttctcagtaaagttctcaaactatctccaagttcttgggtttgtcagagagtgacattctttacttaccagcatggcagccccgtgaaccgtgtattcatagtactagaccagtttccagggggctttttattggcttcataaagtcaaattcatttccttaaaatggtcagattatatctgaaagttagactattcagccaaagctttggtaatataacagtgtttccaattgtgccttattagaagaagaataaattcgtattgaacttaggtaactacattgccataaaatgagaatactcaggaataattcacaaattttggagggatcaatcagggagaaaaaaggtaaatgtttcaattctgttcacaaaagtacacattatgaaattgaagcaagctatagaaagtttaaaagaaaaacaaagtcttgctaaatacggaagacaaaatataaaaagaatcagcaatgtttcaaacagaaagttgtaaaaaatcatggtttttcatgagttcagtcccaaataattaattcttgttctgcttaatgttgggttggcaattgtatcagtttagtattctttttcatttgagtcttggaaattatcaaagttttcagaaacctgtacttgtcaaagttctttttatttttcctatatacttccttgaagaaacaacaccttaggattataattgcctacaaaaagctttcagaaaaggcatcaacataaagcagttagttgtggacaacgagacaagacttaaaatggcaatggttaaagatctgagagagttcattataataaaaaagcaattgaaaagaaaatttgattatttctgcagtgtttatacaataattaaatgtaataaccgaaggttataaatgatagcattatcttaagacatatcagagatctagacattgcatacaatctttggacacatattaataacatacccatatgaatgtaacttaaagaaagttaaatattatttcttatttgacaatgttttcatataatttaacatattggataagcctcattggtttaatatctttttagggggaattttagagactttccttaattgtccaaaagttagtttgggggtcgaagtacttttattttgattcttagggggtttgtcaaatatcaaaggtttaaaacatttgatcaaaataaaatcacaggtcaccataatatgatattcatgtagccagagtgacaataaaaagatttcaaaagcaaaaacaggaagttacatagttgtagagaaacttttactctttggtaaagaggagactcagttttcctaagtaatcaaaagacctaacatgacagtataagatacaaagaacgtgtttctctctctcctctctcttttgagagtttttctcagtccattttgtgttgctatatcacaaaatatctaaggctagataatttataaagaatagaggcttatttaactcgcacttctgcaggctgggaagtttagccctggcttctggtgaaagctttcctgctgcatcgtaacatggtagagaatgtaaaagggaaagcagatatgtgcgaagaggccaaacctgtgagcagtctggctttatactaaccggttcttgttgaaactaatctatccccatgagaactcattcagttgtaccagaacaagaacccataaattattgacagaatggctccaagccaccacaagggcagagccctcatggtccaagcaccacccattagtccccacctcccaatgcaaacacattgaagatcgaatttcaaaaagagttttgattaagagaaataaaccatatgcagaccatagcaatttcacccctgccccccaaaactcatgtccttctcaaacaaaaaatgcaatcatatcatcccaatatttccaaaagttttaacttggtccagcaccaactcaaaagtccaaagtctaaagtctcacctgagactgaaggcaagtttcttccagttgtgagcctgtaaaatttaaaaaaaaaaagttatttatttccaagatacactgctggaacagacatttggtagacatcctccttccaaaaaagagaaataggccaaaagagaggaatgataggccccatgtaagtccaaaacctaggtcaggtgcagtggctcacccttgtaatcccaacactgtgggaggccgaggcaggaggatcagttcaggacaggaatttaagaccagcctgggcaacataattaacattatttaaaagttagctggatgtgatgatgtgcacttgtagttccagctcctcaggaggctaaggcaggaggatctcttgggcccagaagttggaggttacagtgagccatgatagcaccacttcactgcagcacgggtgacagagtgagaccctgcctcaaaacaaacaaacaaacaaaaatgtctaaaatccagcagagcagatgtaaatggtaaaacacaagaataatcttctttgatttcatgtctcacatgctgggcaaactggcatgactgttgggctcccaagcccttggaaacccctgaatccatggcttctctggatgcaacctacatggctaccagtctctgtacttggaagtggggagaagcaggaaaatgttacaaagttatcagttcggtgactgcttgtaagaccttttaattttctttgcttaagtgctcagcatgagaaagtgccaggtttagggtattagtttctgagctccagtggcatgaactagcttaatacacgtgggagaagaaagtagacaatgattgtgaaaaacatttcagtgttacagagtcctttgtatggaaagcaatccagtccttagactttaagccatagaacattttgtagaacgttccatggagtagtgttggaatgcacttttcttctaaggtattctaactatatcagaatattcatttttcatcacctctgtgatgggctaggcagtgcttcctagagcttctgaggcctagtttcctctcactcatattttcctctattactgtgacccaaataaaaactcagtggaaacaaatccaacatcacagcaagctcattatcagttgtgtggaggtggagacctgctgtcattagtatgggggaggaattacacagcaacttggagaagcagtttagaattaaatagaaatggaaagaagtgcttatgaaaatctcagctttcataaataaaataatgttgtgggtgggttaaagaggtagatataactctttcatatgtctgtctttatattttcatagtatccattatttttcaaaaaagttttaatcttggctgccaaatttgctcatcacaactaattggaatagagaagaagagaaaataaggacagagttgaagtgacattgccacaatgctgctaaatctctcatgatctcattttcttcccatattcagcaaaattatccgttcctctattattcccacccttctttccctccctcttgcttacatttacccaaagcaccaatcagcttgaactagttactaaaactgagaaataacaaaaagaaaaattccaagttgtttgaacttgcagttttctgaaaattacttaccataagacaagttacaaacatgtgaatctaatgctgttttttaatcaacagttggcaagaccagtgaggtgagattctaaaatgtgctgcagatattttgctatcataataaagtgttgaagtttgtgaatggtttactttaaaaaaataaactaaggtgtacttaagatgatcccagtggtattcctaaaataccacactcacttgcttacttaaattccaagacgttttctgggcagcagaaaaaaagcatgatttgagagtgagcaaaagggtaactgcataacactgcagcactggagaggtaactgtcagtgatgaaataagactagtattcgttcaaggtcattagcaacattgagttgtgactgttatggcttactctggtttattttttattttaactatagatagagatttagtctgaagaaaagcaagatagataaagtaaaatagtgcaccttttttcaaatgagtaagaacacaatgaacataccagttagcaacagcccagcacttagaacttctaaatgaaatgcaagagggtgatgcagatgacaattttaatagtgctatctaattcataacgtgttagaatatataaattctattgattgcaatttaaaaaatcaactaccaatgcttctttttcaatggcacctgcttgctctcctaattaacattaggtaaaatggagagctaggggaaaagaccaagacctgtttttagtagctaaaaatatgtttattaaagaacaaattttgaagttgtttgattaccgattttactactcagatgcttatagataactttgcatacagtattattaaaatccagtactgaccaggcatggtggctcacacctgtaatcccagcactttgtgaggctgaggtgggaggatcacctgaggtcaagagttcgagaccatcctggccaacatggtgaaacctcgtctctattaaaaatacaaaaaaaaaaaaaaaaaatagctgggcatggtcatggtggtgcgtgcctgtagtcccagctactcaggatgctctggtaggagaacccttgaaccccagagggagaggttgcagtgagccaagatcatgccactgcactccagcctgggtgacagagggagactccatctcaaaaaataaataattaattaaatccagtactgtaagataataaatttgtgttttctgagccactatgtttatggtaatttagtacagtggcaataggaaactaatagagacaccaaagcttgaatggtttattaactgcctggtcctgaggcagccccctctcatgacggggcatctggagaaagactagctaaggcgttctccagtagtgtttactatttatcttctttcctacctcttcttcactgcagagcgtgacagagtctgggagactgagggggcgggggcacaagccctctttgttgagtggctaacagctcagtgcagacaacaaatttaccaggaaacctctttcccctcctccaccagggcagaaggacacgtctgagagcactaggcgggcagattgagcagaagaaagctgggaaactgctccacatggggtgattcccctgaggttttatttccaaaattaaatttgtgttgctttccagggtgcgctcctatgatcctatgatccctgtctattgacacacgttttgtgcttatggttgcctacctgactgatatttctatttaatatgacactttagcagctaattcacaacaagcattgcagacatagctctttgtggccgtcaacttagatgattaaaaaggtgaatatgtaagtgtgtatgtgtttacatatacacccacacaaatgtagacatatacacatgtagtgtgtctccttgacaattttttttttttttgagacggagtcttgctctgtcacccaggctggagtgcagtggcacgaactccgctcatttcaagctccgcctcccaggttcacgccattcttctgcctcagcctcccgagtagctgggactactacaggcacctgccaccacgcccggctaatttttttggtattttttagtggagacggggtttcactgtgttagccaggatggtctcgatctcctgacctagtgagccgcccgcgtcggcctccctgataatttttacccacaatagtactcatactatctccacaatttttcagtgtacaagtcttatctttattttgttaaaacgcattttaattttttaaattacctctgataatgttataaattattttcttaattttttcaggttggtcattgctaatacatataagaaaacagaattttcaaatagatttttacttattccttttaatttagattaattttatttcatttcttgcttaattgctctggcttaaacctccagtataatgttgaataaaagtgacaaccgagggcatcctcgttttgtttctaaacttagggaaaaaactttctgtctctcactattaagtatgttgttagttatgggcattttgtagatgctgtttatcaatttgaggaagttgagaaacttttaaagaaatgttctaataataaaccttagtttgctaattactaaaactgtataattattatattaaatttagaaaatgcagacatgtagaaagaagagtatttttaaccaaccctaaatagactaccaaaataaaaccatcagtaacatccaatttggcacataaccgaaggaagatatccgagttcatggtttatctactatttttcattttggacataatattgtatttaacatatttgtatttgtaatttttccaatattatattttatgtctccccaaatttctagaaatagtgttatagaatcacaggatataaacattgtgtgtacatgagtgcatatgtgtgtgtgcatgtgtgtgtcaagctgtttcttatctattatctatgtataattctctctatatgtctatgtatataaatacatatataacattaatatttattttcaagaattcttgttaaattgatgcccttcccagaggtgtgtgttcttgccaatttttggcatctttaaaaaatgtttgtgaacttaactagtagagattgtgtagaagtgttgctttgattggacatgtctggcttaaaatatagtcatgtcactcacaacggaaatacattctgagaaatgtgtcattaggcaatttcattgttgcgtgaacatcatagagtgtactttcacaaaacctggatagcacagcctactacacgcctaggctgtacgatgtagcctgttgttcctagactatacacctgtacagcctggtacagtgctaaatactatagacaattgcaacataatggtgtttgcatatctaaacctaggaaaggtagaataaaaaatgttgtattataattttatgagaccaccatcacatatgccatctgtcttggaccaaaacgtcattatgtagtgcatgactgtattagtttgagcttcttattttcccgtttgtgtaagttatttaattttcttcctttgtgaactgatgttcacatccctcatgtttgttagttttccagtgctttcttttacattgcttgagtcccgtatatagtaaaagcactaactctttgtctaacacacctataagaagactgattctttcaacataatagaaactatacttccaattcagtggcatttccttcaacatagtcacagtgggaaattacacttacttcaatgatggtcccacttattaaaacactgtaagatatttttactctgaaatagtctttagagctctcatgcaaaccataggatcagctcagcccttttttaaatcattgggagcctaatgcagtgtagccatcttgctcattcatctattccctagacttggttttgaaatgacttctggctatttcttttttttttttttttttttttttttttgagacagagtctaactatgtcgcccaggctggagtgcaacggcgcgatcttggctcacttcaacctctgcctcctgggttcaagcgattctcctgcctcagccttccaagtagctaggattacaggcacccacaaccatgcccagctaatttttgtatttttagtagaggcagttttcaccattttgaccaggatggtcttgatctcttaacctcgtgatccgcccgcctttgcctcccaaagtactgggattacaggcgtgagccaccattcccggccgacttctggctatttctaaactcaaattcttcttgaaagatgaaaatttgctgccagtaatagtatgaaaaatatgagacctttgttccaaagtaaatttgttagaaagagagactcttctaagcaagcttagtgttattaggaaaattggatctccttccagctatgactgcttggaatgctaaaatattcattatattttctgatgcatttaaatacatatgtatataaatttaaagtaatttgtgtaaatgcagatggtttgtggcttgttttttttttttaatccttcattttccatggtcagttcttacgccttcacattcgtactattaattctttacacttcttcaataaatttactcaaatataaataacttcagaaaaatttaaaatctacccccgcaaaagcttcaatatctgaagtttatgtggagaatgacttgaggatttttttttaagaatagaaggtataaaatatttttattaggttattttatctataatttctaaatcaaattaacagaaatttattggagatatagtatatgtaaggttatatattttgctaaccaaaaataaatgattaagactaaaattcttggacccagaatgtacatatcatgaagtctttgtgcatcctgagatagtaactcagttaccttatggccctctctttaaagccttttttttcggcatgttgcctcatatttaaaaaatacaggcaagccaagcttttgtgtgtttcctcaaagaggctcctgccctgcacatcattagaaatgtttccctttaaactttctatttttccaaagaacttcgatttacactggcttacactcttctgtatcattctctgatatcaccttatctgtacacgacagatagtgtctttgatagttacatttctctagagaagagaacaagttttgaacatcaaaccaagaaactcattcttttggggaactgggagatgggtttgcagaaatgttgtagaaaagaggcttccagaaaccaaagatattctttgcattctttaacactttgcagacccctgagagtgacctgatttcagggttgatttccttcagggcagccactttctttcatgccaatgccagagttaaagtacggagagaaggccagtcttagagcagtgcttctcattctgtgactatacatcctggctccactggctgtctatcatttgttcagttcaccttctctggcaggaagaccagccagcctggcagtgttcttgttggcataatagaactgtcatgggttcatctgtagccatggacaaggagagctaatggaagctggaaagagtggattccagttggcatattgaagaagcttaactgaatagttttcaaaacaagaagttgtggaataagagttacagggagatagtagcacaaaaggaacgaggaagcagaaagactacaaagagaagcagaagggcaatcatggagaataagaaagaaatgtttccctacatctattgagtgacctggccaagtttagttaaaagacctggggcattgtataacaattggtagtgtcgaagaatattttacttgggaataaaaggagatcagccgccactcattcacacattaatcaaatgtctaccatattacttataacttaatttctgtaattacattactgaagcaaaaatgctgaatacacaacactaagagctggtagttacatggaggagtaaaaaggtaaacaatttaacatattaacataaattatggagctggaagaaacacagaggaaggacttgaacttaattggcagtaggggaaggattccaagaataggtgacagctgagctataatagtggcgtgaagctatttctttagagaaaatttctggggaacacgaatgaccagtgcacttttgcttttgggtacacaaacaggacaggcacacaagataattatctgctacaatgaccttgcctcatttcatcaaatccatctaaaataaacattatttggaagattcgtttttctatgacacattaagttgtatactggtcatcatgttgaccaagtaattttgaagggaataagaagaaaattaatatgaagtgtttattacatgtccagttccaccttacctgtcggaagtctcaatcacactaccgttttataggtgaatattacaaccatttcacacacatagaacagagcctcaagtgagttaagtagtttatggagggcacataaagaaggtgagtgttgggccatcctgtgaaagacaaaacagtgcctggacgcagagaaataccaagtctagatgaagagttttcagagtcctcggtgtctgaacatctgccactttctagctgtgcaattttctggaagttacatgacatttctcagcttctgaagtctgctttggaaagaaaaaacatcatccaaaagtactgtaaatacaaaggaccagagaatgttttgcctcattttttttagcatctgtagtaaaacctgtggtttaataagcacaattctgaatagaagtttagcttccagggcctgaacacaggcaaaactgttctgctcatgagacaggtaaaaataatttggtgttgcttcagactgtgcctagaaacagcaagataactggaagctgaaaatccatgaattgaccccttcttacaatcccatgcatctgtggtaaagttactgaactcataaaatgcttggataaagatgttttgttttcacaatgaagtagtgatgctttgggcctctgtcaaggtgaagcagaactagagaaagatgcacaggctcagatctcaaagagaaaacaattagttctggacccttgacagggccacagaactgggtgagccacattgagcgaggtctccagggaaaggagagccccagctgacatcttgtggaatgacacaaagatcacagtagacaaaggaagcacattttcaatgtaagcgaattcttctatgaatcaatacaatgagcttgaacgagaactccttgctctcagggacttctgaaaatccagcttcagtctttgatccccttgtttcaaatttctcactaaaacaacaaaaacagaccaaaaaaaaaaaaaaaaaaaaaaagatgaaggccattacagcaccataagaagagagtgtgacatttaatctaatggcccaaaactggagattttttttctttgtttttttttcttcagattattaggctggaggagctaaagcatgaagtgaaattctagaatcacacatgctctgcaaacagcaaggttgtctgcctggaagtagcatgctcttgggtcagacaggcaatgcatattttacacagaaaactataagcctgtcccatttcaggtctgctctcaggcaggcggagtgagaatttgtattatcctctctccgtgcatctccatgatacagtgcctcaaattcttatacgaattttctcacttctagagcactatagaacagaagcagtgatatctgtacaagctttaaacaagagaaagaatccagaagtggaacattccatcaggaattaacagtctacaacagttaaaagtgtagacagtactggagacaagaaggtgcataacaaggtttctgggtattgtagtttttcatgggctccattttaattgtgtcacagagagagtcagtgaggacaggtcagatcacatttcagttgaagggagttcatgcatttgataaatgtgctgtagcctggacatttgtccaagagttataagtgacagtatgccacctgtcaggcagatgaaaattatctacttcctgagcaaaaataatgaaccataaaaacttaacaggattccagaagacttgactatgatgaaaccagatacaagtatataaaaagaaaataaagagaaagagacgctatgttgttgagaattaaagaacaaaaacaaaaaacatggattaaattccaaatgaatgaaaagacattaaaatgaccaggtaaaaattattgtctgctttgtttgaggcagtaaaagacacaaataacactgcggatgtttttaaaaaggtgaattaaaacaaacaaaaaaaatctttgagaatctagttcagagcacaagagaactagagagacagtgatttgggatctttagtaatgtctactgacaaatctccaaaaacaacgaaaaacacactttgccaaaggaaaattaaatgtattggacctgccataataaagagaaccttactttgtcagtcctggtagtgtctagaaggcaggggcagatatttttagtagttagggcccaaagtgtattattttaaagctaatcttgccagatgggaaattggctgggactggacagagtttttgacctaagatctttggattgatggccacagaaaatcaggaatcttgacgtgagtctctatgagtaagctgccagtcttgagcaaaagctatttgagccagttctcagttttatcttatgaaacacgtatttcctggggcaaggtctaagccactcttgcttattctgagtattgtttaacacagggacaaaacatgatcttagtttcagctctcaataggtaatctagttttcatttctgactagatttttttatttttctaatttaaaaatatgaccagattttttatatgtagagttttcgtcaataattttgcaagtatatagcccggtttttgataagcataatcagatcaatcttcagtttaggaggtcactcccattgagtctcagagatgactcttgaaccatgagcttggtcttctgtagaaatagctattcttaaatcaggtccatggtctccatgtcccatatcaataatatttttccttttcatttaaaaaaattttctaatactctatttataatataatatatttaatatttctaattacatatgctttgtataagaaatgaatgatactttcaaaaattaaatatagatatttaagtagatgtctacaaaaaataattaggggataaatgttccacagtgtttattaagtatatttttctgcaaaatggaccaagtaggtggattttaaaagtctgcttttttcatttttcacatttctttaaggaacagaaataatgtttgccattggtagaaatctcattttaattttacagaaatacaataaaactagcttttagatcctcttttcttaccctaaactttcacaagggtttgatcagtgtgtgagggatggtgttgtggaatggagcagagctggtcaatgtgttagcaaacagcctcccaagcagcaggcaccctaccctcccactgaaccaacttttccatgtcagccctgtatgctgcatgatttgtctttggtagaaatcctgggaaaatcaagtgactttcctttacttcattttgcaggtgagcccagaggttcaactttcatcacctttttgggaagtaagattctcctacttctactttcaggagtgagctcaaagtcccagcaggcaaaaagcctgcaacattgtgtgggttttacagccaggatccattattatttttttctgagttaagggatctaaacatagaaaggaaagttggacatttgtaatttgcatttactgaaaatgataaaaagtcatggatattgaagaggaaggaggccatttctatggttagaaagactgaccctgtgagctctgcttagcctttggaatatctagtgtctaaaagaatagaggcaatgctaagatgttgtaacacgtctgcaaatgaaatggaaatgattctacttttctcatatattttataaatctgtgagtgttaagagtaggtaagaaaaacaatgcttacagataaaatatagttaaaaacattttcctctttctaagccttggtagtcatatagtttgaccaaatgacagaataaagattgtcccatgatttgaaaactgtcttcagtacaaatcttataaaaatatgataaaattataacaaatattttagaaggtataaaaataaaagataatatcctgcttctactaaaatatggacatactcaattatcttaacactttactttagaaatatgctttgacagatgtggatccatagaacctcaacatcttttttttttttttttatactttaggttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatcatgatttccaattcatccatgtccctacaaaggacatgagctcatcattttttatggctgcatagtattccatggtgtatatgtgccacattttcttaatccagcctatcattgttagacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgctttgcatttctctgatggccagtgatgatgagcattttttcatgtgcttttggctgcataaatgtcttcttttgagaagtgtctgttcatgtccttcgcccactttttgatggggttgtttgtttttttcttgtaaatttgtttgagttcattgtagattctggatattaaccctttgccagacgagtaggttacgaaaattttctcccactttttaggttgcctgttcactctgatggtagtttattttgctgtgcagaagctctttactttaattagatcccatttgtcaattttgtcttttgttgccattgcttttggtgttgtggacatgaagtccttgcccatgcctatgtcctgaatggtaatgcctaggttttcttctagggtttttatggttttaggtctaacatttaagtctttaatccatcttgaattgatttttgtataaggtgtacggaagggatccagtttcagctttctacatatggctagccagttttcccagcaccgtttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggcaattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaactgtgaatgggagttcactcatggtttggctctctgtctgttgttggtgtataagaatgcttgtgatttttgtacattgattttgtatcgtgagactctgctgaagttacttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactacgttgaataggagtggtgagagagggcatccctgtcttgtgccagttttcaaagggaatgcttccagtttttgcccattcagtatgatgttggctgtgggtgtgtcatagatagctcttattattttgtaatatgtcccatcaatacctaatttattgagagtttttagcatgaagggttgttgaattttgtcaaaggctttttctgcatctattgagataatcatgtggtttttgtctttggctctgtttatatgatggattacatttactgatttgcatatattgaaccagccttgcatcccagggatgaagcccacttgatcatggtggataagctttttgatgtgctgctggattcattttcccagtattttattgaggatttttgcatcaatgttcatcaagtatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtccaggaatttatccatttcttctagattttctagtttatttgcatagaggtgtttgtagtattctctgatggtagtttgcatttctgtgggatcggcggtgatatcccctttatcattttttattgtgtctatttgatccttctctctttttttctttattagtcttgctagcggtctatcaattttgttgatcctttcaaaaaaccagctcctggattcattgattttttgaagggttttttgtgtctctatttccttcagttctgccctgattttagttatttcttgccttctgctagcttttgaatgtgtttgctcttgcttttctcgttcttttaattgtgatgttagggtgtcaattttggatctttcctgctttctcttgtgggcatttagtgctataaatttccctctacacacggctttgaatgcgtcacagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggttcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagccggttattatgctcgttagttgatgcagtttcttcctagtcttgatggtctttacattttggcttgattttgcagcggctggtaccggttgttcctttccatgtttagcacttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggccccctctctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttcccttctccccatcactttcaggtacaccaatcagatgtagatttggtcttttcacatagtcccatatttcttggaggctttgctcatttctttttattcttttttctctaaacttcccttctcgcttcatttcattcgtttcatcttccattgctgataccctttcttccagttgatcgcatcggctcctgaggcttctgcattcttcatgtagttctcgagccttgggtttcagctccatcagctcctttaagcacttctctgtattggttattctagttatacattcttctaaatttttttcaaagttttcaacttctttgcctttggtttgaatgtcctcccatagctcagagtaatttgatcatctgaagcctccttctctcagctcatcaaagtcattctccatccagctttgttccgttgctggtgaggaactgcattcctttggaggaggagaggagctctgcattttagagtttccagattttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctgggggatgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactactgtctttttgtttgtctgtgccctgcccccagaggtggagcctacagaggcaggcaggcctccttgagctgtggtgagctccacccagttcgagcttcccagctgctttgtttacctaagcaagcctgggcaatggcgggcgcccctcccccagcctcgctgccgccttgcagtttgatctcagactgctgtgctagcaatcagcgagacttcgtgggcgtaggaccctctgagccaggtgcgggatataatcttgtggtgcgccgttttttaagccggtccgaaaagcgcaatattcgggtgggagtgacccgattttcccggtgctgtccgtcacccctttctttgactcggaaagggaactccctgaccccttgcgcttcccaagtgaggcaatgcctcgccctgcttcggctggcgcatggtgcgcgaacccgctgacctgcgcccactgtctggcactccctagtgagatgaacccggtacgtcacatggaaatgcagaaatcacccgtcttctgcgtcgctcacgctgggagctgtagaccggagctattcctattcgaccatcttggctcctcccagaatctcaacatcttaaatatcattaacaagatagtcctgaaagcgataaagaggatatatcgactaagtattgttgactttcagaatcctatctcactgtctagcatcttatcatacattagacaaatggttctacttatttttatattactatcattttaaaacctagactcctacctttattttttaaatcactgtttacctcagtaacttcgagcatgtctttcagcttctctatcatggatgtcagtacataaagttagaaaaagaaaactgttatttatggggctgtgaaggaataatcattgtagtactgcctggataactctccctgtacctttctgtcaattttaattattctcagtttgcaaggctcagcctcagatttgaccttcttgagattgccatctgtacctttgaagagttcagttcccttagctcaacgtacacccaactgcttaacaatggattttacgcctcatgagcacacaccacactctcaataagtaatcgactacattctatttttttgttcagtgttctatcactgctcaataaatattcaattactgctcaataaatatgcagtcattgttctttaaatatttttgaccatacctactatgagtcagtctcctttggcaactcaagatacagcaaaaaagcatcaatggatgtggcttataataaggtggagaaaacatattaagcaagcaacacacaagtaagtttcacttgtgacagttgtggtgagtgatatgaaggcactatgatgtttgtaatgcctcatattaattgccctgttgctggctgttaattagcacatatccaaccccaattccactgaaaatcttatttgatcacttcttcagttacttcttggacacttcattgtttggattttccttccactttggtgatagtctgctgtcaaatttgtttgtaggaccagattcttttccctgacttgatttcatctattctcatgttcccaaatgtgagtctccaaacagactcccctcctgaactctacacctgcagaccagccctccttcttaacatctccctgtgtcaaactcaacacacccaaaataacatcactttttctccatacttgcctttgaaatcccagtggattgcacttccattcttccaatagttcccaaatcttagaaatattacttttttctctttttctcatatctcacaataatttatcagctctatctccaaaaaatataaacagaattatttatgcaagatgagtgagttttatagatctgttgtacagcatagttcctatatctaataatactgtattgtgcacttacatttttgttaaaaggatagatctcatgttaagtattcttaccacatacacacaaaaggggcaagaacaaaaccttcggaagtaggtggatatgtctattaccttgactgtggtgatactttctagatgtacgcatatgtccaaactcattaaactgtaaacattaaatatgtgtagttctgtgtgtagcaattatatcttaataaagatatatgcatatacagaatcccattaatttttgccactgtgtcccctgctccaagccagtgttgcctttcccatgacaatgtcctgcttctaccacgtatctccttggagactattgtcacttcagaagccagaggcatgcttttaaattttgaatcagatgatggctctcctctactcagtcttgaagagtagctcccatttcaactcagagtagtaagaggcaaaatccttactgtggctacaaagttatacaggatgcatgaaacttcctgagacctcacacttctcctttcttgttgctctttcactctctccagccacattggctgacttgttttttctctaacacactagggtctttgctctagctacttcctaattctggatggctccagggataactacatggctcactctttactcctttaaccccccttttatttccagacctcacactctgcaaatgcgtttgcaatgaacctctttaacgttgcaacctgcctcacttctgtcacctcagcaattgagctttcctaaccctgctcacctttttattttttccacatcacccaaacccttctatcacacgatatcattatcttacttattttgtctctgcctaaacttctgctagtcatataagctccaggagggcataaatcttttcccaatgtatacactgaggttttccaagtgtctcaaagaatgtctggcacagattaggtactcaaggaaccctcagtaaataaataaatagatgaaagaatgaacacatttagtgattctttatttctaaagcaagaaagagatatcatgatgccagttaatttcctgagatagaattccttacaatacattggattcagacattaactgcattaagtataataccagaaagaaaataaaaagtaccagaggagaaaaaggaaattaatggaggataatacagtagagctttacttctaagagttgtgagacagagcagagcagtgtgcttatcttcctagggcattcctcattatgccctaacttcttgcttggcacatagcacatagctggcacaccatcaatgtgtgctgaactaaactgaaattctaagagacataagttaatcactaaaaaactattggccatagagttgatagaactcttcttcatggttcttgaatgaatttttccaagaaatattagaaatcctaatagccgataagaaaaggagggatgaggcatttgagaccaacctggaaagggtagtaagacctcatctctacaaaaataaaatgaaataaattagccgagcatggtgatgtgcaattgtggtcgcagctactcatgggactgagatgggaggtccgcttgagcctagcaggttaaggctgcagtgaaccatgattatgccactgcacctcagcctttgcaagagagcaagactctgtcccaaaaaaaggaaaaaaaaaaaaaaaggatggatgtcaatggggaagaatacttgcgggaatctttgcatatactttgccatttctcagaaatgcacaattcacattaacatgttaggatttggggagatatttctttcttgaaataaggaaacaaatttaacaaagttcagcttagaatttccaaatacttcacaaactattggtgctacagagaacatggcattggaaacactgaaacagttggccctgcatgtccctttccaatagtaacaccattgggaagcagagcaaaagatttgctgtaattccttagacctgaatttgagatccagctttactacctcttataaaagtttcctgggaaagttcttcctactttgtgaaactcccctttatgcattcctaatatgagactgacaattaacttaaagattatataggtcaatgcacatgaaagatctaaaagacacccgtttcataacagtatgttaataagtgtatgctgaatctgaagatcccattcttaaatcttagatctttcatctttaccaggagctcttgcatcaaatagtcaattatgagtaagtactggagctaagtgattatatttcttatattcttaatttacaagtggtgcctgggatgcatttttaaggtcatgtaacttttttcttattcaattgcttgtttatcctataacccctgttacattacaggtatttttaacattggtttttctttggagagatagtctatacagtggggactagcacaggtagggtgagaccacacattcaaatcctggttcttctctttactaagtacttgatttcagtccaattaattagcattagtcatctcagtctcttaatgtaaaaccagaatcacagggctcattccaggaggttactgcaagactcaaatgcagcactgcatataaagcacataccagggtacccagcaccttatgaagcacaaaataacggtacgtactttcttttttactgatattgatagtctttctcttcttccttcttgtttttaatcttcattttctgtagtcaaaatataacacattaaaaaatacaatgaaaaataattatacccaattccaattgacattgaaattcctagcccaagactagcagtggccaccaaggggcttccataagagaaagaatggcattccaagtgcagtgtcctttaaactaccaagtctgtgtcctcaggaaaagaaaatcaacctcaggctgaagccctggatctgaagggaactttctttaaagagaagcagtagcgtgacttttgcccaattctacccctccaggtgttattttaatgacaaaccacagcaacatatttccaaccatttcttcctctgattgacttgtaattggagtcatacctaagacctcaatcatctcatgggaagctttggggctgggagagcccttcaaatttgtccaaattgagaaaagagggctgagtcttatcccagcctcgctcctacacatgggccagtcttaggtaggccccaggaaggaggcataacattggccaaagaggttctcttctgctgagagagcaatgtccagagagaggctcagcagaaggctggtagctgataagacacccctcagctgagcctcagtctggaggggaatctgggccacacaatatggcaccaccccaggggacattgtaactgggtttatgtcatgtctatgtacatgtttgatgcaaagtcagagaaaagaaaaaaggtaactataagttcagagtgacccttagtctgcagttaatgctgaaggataattattagtttcagtttgggactgttgcttgacgaacagagacaagcatttgaaatggtaaaaacagagagaacagtaaccattggactggtggcaggaggcctattagtccattctcatggtgctgtgaagaatacttgagtctgggtaattaataaaggaaagacgtttaattgactcaaagttctgcagggctggggaggcctcaggaaacttacaattatggtggaaggggaagcaaacatttccttcttcacatggaagcagtaaggagaagtgcaaactgtcagatctcatgagaactcactcactatcacgagagcaacatgtaggtaaccacccccatgattcaattacctcccactgggtccctcccatgacacatgggattatgggaaatacaattcaagatgagatttgggtggggacacagccaaaccatatcacctggtttttgctcctattgggctacctccagtgtgacaccatgtaagttactagcccctctggcttccatttcacatctgaatgcagtctgttggcataaattaatctttgagggccttgaggtttaaagtgtactccatctgaaccttagaaaggacctggctccctgacgtgaaggaaaattacaaaattcacaaaaccttctaaaatgctaactcttttattatggctgcttaatgacctttgttcaaggtacaattacttatagaaagaaatcagttcttggaagaggactagcaggtaatttctgaatgtacttgctgttcagtactatgctgtgaatctgaacagatatttacttcccatcaaatatgttgcacatgtgtgatgtggagcacagagagtgtcacgctggacatcgcatgcctttcaaatgtgtctataattcagttatatggaactataggtgatttttttcccatataagtaaggttgcaaatgctggttagattcccacactagcccatgcgttagcctcgtaagcttaggttgaaacaaacaattgcaataataaatagcaagtttgattagtgcaatcctgatattatgtaataaaatatagtataagaaaaacacaggagaaaatggttttagaaattagtttgtaaagcttgattctgtaaggagatacacaaaaatgaaactatgctgaaatgccatttccattcatctgattgacatacagatcaaaacttctgtaatacgcagcgtttttgaggctatgaggagagtcagatattcagatgtgctgctcggaataaaaatcagtacaactgctacagaagccattttggcaatatctaccaaaattacaaatatgacccaggaagttcatttacagaaatctatcttagaaatatacttcacatggacaaactcatgaaatacattagtttagaagttagtctataataataaaataattgggaaaaaaccaaatacctatcagtagaagggtggaatatcattgaacaaggacataagaaagaatgaggaggcacctatatactggtatggaaaactattcaaaattcattaatccatgaaaaaacaagatgtaaaacagatctgaactggtgaacacagagagtggtaaactttgtgctgggggtgggaggcctggtttgcattcctactgcatatactgtgttattatttgtagaaaataagaacaaaaaatatttatttatataggcataagatatctctgaaaagacacagaagacactggacttaggcagctctgacgagagaagctaagtggctgggaactcaaggttggaagagaaatctactgaatacccattttatcttttacaatgtttagccatataaaattgtggcttgtttaaaacaaataattttttaaaaaatagttggatagctgagagtatcaagacaagccaatttaattagaaaaggggaagagagagacaagagaaatggggttgtggaaagcttggtggacccctggctgtcttacagctctgggtagtgttaccagagatgattcttggggcaagggaacaagagagctatctctacccatccaattgtttcaggagagccaggggcttataattgcagagtctttgaatgcctttgtatattttcatagaaagaaaccttggaggccactgagcctaatggaaagagaacttgggtagcaaccaggagactatagatctaattacaaacagtcaattatgtggttttagctgaatcatctaatctcgtggttctcgattctggctacatgttagatttaacaaagaagcgttaaaaaactatagtcaaagttggttttgatggtgggggtgggatcttactcagaccaattaaaacagaatctgtaaggaagagacataggcattggtatgttctagaagttcctgcggtgattctaaatcagagatagggttgaaaaccttttctttccttttgtagttttattttagtgttataacctgtcaaattgtgatttataagcatcaaatgacacaatttaaccttataaagtgttcttaaaataaagacaaggtttgtaagagcttgctacggtgttcactacatgaaaatcactcaaaaaatggtatgtatgcatatgtcacatgtctgttcaaaaatcttcatcggacaaatgcaaggaggtcttgactatatctattgtgcacatcaaaacccaggaaaggcagttccctcaggcttatcagaaagagcacagaaatttataatcagagcaatctggggtcagtttcactagtaccctgctgtgtggtcatggagcagtttcactcagcatgcttcctctggtacaaagtggtcataacaatacttggtaaggttgttggaaaaaaacagacaatgcaattaccacacaatatttttacataatcactactgtatccactataattaaagacaatgtataacaaatatgtagattattctagagatgcaaaataaattctctgatgagaaaacagcatctcaagaattgagaggaaaagggattcaaacaattatcaagtgagaaaatacttcacaaagaaaaactgcaaaactaaagctacgtacgtgaacactgttttgcagagaccacatctagaccctcagcagtaaaggttgtgctttttggaaaacgaagacaaagcagcaggaagaagagaaagggttgcaatggctagagggaagatgagggcttccaggtaggttgtgtgatgctctgaggaaaagccggtcatatacttgggtattccaggtcactctgctggaaccctgcttttaggacttctcaaatgaagtgactactagcctcttctcagagtcacatggaagacaaagaatactgatggaagaaacagctctggacagcaactttggagaccatgatgtccttgagagaaaactgaactcttgcagatgcaagatgttttaatctaccttccactccagatcaaggaacggtaaattagggaaataatgaatacgaagtacaaactgctggttattgatttgagatttgatatcacaatttgatttaccagatccactgtttagatgtccatagcactgactcttggctggagattgagtgtgctgcatgggggacataagggaggaaaatatctttccttcttctgatcttaggttcatggttgaagcctctataacaaaagacagattaacaagagaaaaacatgcacatttatttcataaaacttttatgtgacacaagagttgtcagaatgaagacctgaaataacagttaaacctgagttttgttttgttttagagtaagtttgaagagtttatagtcatgcagaaatattacacagcaaaaaaaatgatctgattgtaataaactggaaagcttagcggagactgtttgtgcagaattttccctgtgttcctgcatcttcagagataaggatgctactgtcctccagatataaggagggtacctctcacataagtgtctatgacctgcttcaggggaaggtcagaaaatctttcttaggttttacgacctgcttcagagaagaagggtgagggaaagtgagagtaacccttttgcttttgctgttttctcaaaattgctttagcttaaaatatcgtggggtaatgtgtcccgaacctcattaggtatgggaagagtacacttgctttgacatctgcagtctcatcataggttcttagtctaccaaagtatgtaacaagggatggaaattctgattgaaataattattatatacgatatggtagattttctcaaagtattcccctagaaaaccttgtaagattcaaaaagacaacatgcaacatgggagttccataatccattaggtttggaaaatgaggagttaaatatctcaaaagaaacattttcaactgcaggatttcttatagagtttagtgtgctaataggctttatgagtcttctccaaacagatctaatacatggcacttcctaaattttggggactcttgcaactgaagcactcttagagaaatgttgtagtagctggtaagataaagctgggtaacagtaaatgtggagggagatatggaaagatacaggaaatcatacatgtaatcttaacatactatacataaattcttagccaatgggtagggaaggaagagaatgtttgtctacaccacttccactttcattgatggatccaacaatacagagactctgctgcactgggtagaactaagtgttctaaattttcaaatcaactgcaaagaagatgtaatagttaatattagatgtcatcttgactcgattgagggatggctaggcagctggtgaagcattatatctggtgtgtctgtgagggtgtttccagaggagattgacatgtgtgagtcagtagacagggagaggaggaatcaccctaaacctggatgggcatcgtccaattggctgccagcctggctaacagaaagcaagtagaagaagggggatattcagttttgcagcgcttcctctctatcttccttccccagtgagatgaattttcatctcctgcccttggacatcagactccaggttctttgatctttggactctgtgacttattccagcagcctatcaggggctcttagtccttcagcctcatactggggactgtgctattggctcccctggcttttaggcatttggacttgggctgagcatgctaccagctttttttgttctccagcttgcagaccgcctatggtgggactttgcttttgtaatcatgtgagccaattctccctaataaactcctttttacatatacatatattgtatttcttctgtatctctagagaaacctgactaatacggaaggatttatatcttactgttgaaggtatataattgtttcctaattcacaagacctaggaaccaacttgccaggcagtgatttgtagccaacttctgacaacgaagtgaatcaaccttaggatgaagctggacctatggatggtagcagagttgcaaagaagttaagttcctgaagctatcatagaattactcaatcaatcagcccttaagctttttttacttctatgcttacgaatgtgtggagtatttaattcctttttatttaaaccaaattgactcagggttcctgttattatagacagaattgtgctaactggtacatgtaccaagaattaataatgcaacacccattaacacaggacgaagcactaactatgtgcaaagcaatgagaatcttgaagaaaaaggaagatagtatcaaatatgcatgtgaggaagatatgctatgacctggaattccttcaacctgatggttgaagcacacttgaggaacttgacatagatataaaagacaaagatgacaaaaattatatccttgagggaatagactaccattcaaactgaagatgagaatttggcagtccaaagacagatatcagaacagccacagatgaaaaataccactgtgatagaggagcagtgccgttcttgacattagcttggagtctcagcagggagaggaacattcgataaattttttatttgccttacaggcaacttcaaactcttggaagacataagaaatgatgacgagaactattatttctaatctaaaagtaggtgttgctgtataaattggaaacaacagaggactcaggaaagcactgattctcatccattgaaaggatcctggcatactcattcaaaattgaccacaatcaggatttccctaaaggggaattataaaagaaacagatcaaggaatggagagacagcccacaaggaaattgtggtttaataaatgaccagcaatgacaaagacaaatgaataaaaaggaactaaagtggtgccacgaggagttcactgataaattgagatttttagcaacatattttccagttttattaaaaaaaagacatgtaacaatagagaaattcaaacggacagcatataattataaaaacactatctagaagactaaggttcagaataattgaggttttcaaaaaagtaaaataaaaataaaacaaaaacccactttcaattatattaaatgtattttcagttatattatgagcaatgtgattaggagggctgggtggtgattataaatgtacacaaaaatttctgtatgaagttatttattacagtgttacttaaaaggatacaatatttgaagaaaagacctgataacaaatacttagttaaaaattttaataggcatatagaatgatgtactaagctattaataaaattatatttatgaataattttacatgtaacattcattttatgatatgttaagtgaagatcacaagacaatatatttgcagtgtgatatcacttttgtgtgtacatgtatatatgtgtgcatgtgtgcatagaagagataatatttatctatggtggtgatattttgagatacttaattctacagtgatcctatattactttgtaataaagagactggtactatatttaagtaaaaataaattcttagattttaagtacaaattaagttaaattcaatacattaaaaacaattatattagagaaatgtcaattatattatggttaattatttctttcactagttacaatatagggttacataaatagaacatgttctgacaaaaaccagatagaaagtcaaagttctgtagttttctatcaaatataatttttgtcaaattggaaagggttgaaccaagttgatcaataggaaaatgaactcccaatagtagggagaacatcaaagattctagttgctctaaatgagttcacatttcctggtcctgctctctagactgttacatctgtgagtactaagagaagaagtcaatcatactctgttcaaaatttgagcagatgctctgaaatactgaaaatagttcaaactaattatcacttttaggaaagtagagaaaacagagttgataaagtattctaggcaaaggtttaagatgacttaatcgatgatctgtgagtgcctagcaggcgacatgctcatcactacaagttagtaagaggacatgtcacataagtcagaccaactctattaggaatgaccacacctagtggcaaaatcttggtttctaaacagcattctccaatgcacacaaccagggattcttggagaagtgattgacagtggagctggggcagggagaatataagatgggcctggaacgtcctatgactcacaaaagtaaggcaatactgaagaaaggttgaaggcctatctcaaggacacagaagtcaagctaataagagctcccaaacttagaacaatgagagagagaaaataaatcatggctatatcaaattataactcataaattacactaaaattctatgaatctaacttgatataaataaatagttgaataaataattaaagggaaaaggagcagctctttcttacagaggaattctaatgaacagaagtagaatgggcaagatagaaaatcaccatgagcacaccacagtaataatggtcgcaatacatggatcatctatgcatggtaaaattagtgggtgaaaatttcaggagagacaagatgtttgcatggcctgaaagtatctctccaaagatatttattaattacaaagaaaaaaaaacagtaaatttcttttatacaattaaagaaacctgctgaccccagcataactggtaagattaacatcaccaatgaaaaagcatacttgcatcatgattctcttaaatgatgctcaaacaaaggcaaaatgtcacttctgtggccttcttgccaagaatgtataacttcaatctaatttgtaaaaataaaaacagacagactcaaactgaggggcattctataaaacaacctgaaagacaaagaaagactgacaagactgtcacagattggaggccacatggtaattaatgcaatatgagattatggattggaagctaaaattgaaaagggacagcaatggagaaactgataaaatgaaaataaagattgtagttgagttaatagtatgacatcagtgtaatttcctggtttgggggactgtgctatgatgatgcaagtttttcacattggcgaaactgaccgagtggcgtacagattctctctgtacagtttttgcagtatttttgtgtgtctaaaattatttccaaaaaaaagttaaaaaactacatcattccagattaatatgttaatggatatctaggcagacaaaatgaagaaatatactacatagtaacactgttaaactcaaaactacttaccacagaatattccaaatgctttgatgagaacatcaccttgaaaagtgtcctcaaaatggaaccaaaggtcattccaggctttggcctgctgttctgcactggaatcaggtttggatgagtaccaaacttgtatatttttcataagaactgaaactggggagaagaaataatatagtagatgaaagcacctagtacccaagttaactggaagaaaaacatattctaagagaaataagcaataattgccttttgtttcaaagcaaccgtctataccaatatagaaaatgaaagatgctgcttatcatgaattcaggcgaaataaaatatgtgagtgacagctgccatttatttaacataattaagctctctttattgaaaatctataatgaggaaaatggaactttttgtattattcccaaaggcagaagcaggagcaagcatagacattactaggaagcaattactggttcagaacaagaaaacccttgcagtggttatttacaaagcacagagtttcatttgggtaagtggaggtattcaggaagaatagaaggtctctgagatcacggaactgagatttgctctgctaagataaaagtttttcatgatctttatgagtgcctctaaactaaaataccaggatgcttgacattactatatgtaccgtgtgtgtgtgagtgtgtgtgtaaaacaaagttgaatgtgctagctattttattatcataagtttatcatttgggaggtggaaatttgtgattgaatagctgtgtgatcatgccattccatgctaatatccaattttgtgtgagcatgtcattccatgctaatatccaatttcttttatttttcaaaagatatttactgtcctgtgagcatccacagagagttcggatggccctacctttttttcttttaagcttaagaaagtaatgagaaatgaattagagttcttccatgagtcaggtttcacgcaccagagaagtactggggaatgcactattgatctattttcttcaactcatttcctgtgtttaaatggaaatattgatacctatgcataggcttcttctgaggttttggggatgtgagcctgtgtcttgtgtttgaatcaaagtaagatttagatttcgtggtattaaaataagaagtgtgagggacaaaataaaagtctccaaggagaaagaagttggaaaaaatctttaatagccttaaggttcctctcacgtagttaccactaaggttttggatgagaatgcagtagacagaactcaggctcaccaaggagttaactaagatggtggttatttacattgggaacactgtcttccactgaatacattatttttgctttaatagaaggatttattcttcaaaaaaggtctcttcccatgtatttaaaggttagctaatgggtcactctttgcctaagagaaagaataaggagtgtaaaaggtgtagaaacaaaacaaaagaaattgtagataaaagttttattaggagctaccagtaatttctgcaatcaaaaatgggcctgtgggtggctgaggtgggcagatcacctgaggtcaggagttcgagaccagacctgaccaatatgatgaaaccctatctctactaaaaatataaaaattagccagtcgtggtggcatgcgcctgtaatcctagctactcaggaggctgagacaggagaatctcttgaacccggaaggtggaggttgcagtgagccaaggtctcgccattgtactccagcctaagcaacaagagcaaaactccatctcaaaaaggaaaaaaaaaagaaaaaaaaataaatgcaccttttttttttatggataataatgcaaatccctgggggaaaaaaaataaattttaggaaatgttatggctaccagagaatgtcgtacctaaaaattaagtttcaaaaaaattctaggaaatacaagagcttttgagctacatatgtgaacaatgaaggaaaaactttcacatccaccctgtaaatcttaagaacaattttgattcaagggggcctcttggctgagtctagacagcctacctttgaattcaagctctttgctacttgtgtttctaggagccaatgctaatttctgggaatgttgtttaagaacttctacttactgtgtactcattttggcaccattgcactccacatactcacaggattttgttaatagggactgatgcttacttaaaagctttattagattatctgagtggattgcactggtccaggtatatatatccatcacaaaacctcttcatcctttaaattaagtacttcatgaggacaacaaaaagactggagaaagtctgaatttactctatggaatcaaccgtatgtaatttacacaattaaaaaaaaaacatgcttttttaaaagcagacattagagaaaaatgtaaggataaaagtaaagttctctatttcttcctccacctaccccactctctctctaactcccactggtaggattatgaaggcgaccatttttagtatttttgcatgtatttttgcagatttttctttaaatataaaagcataattacatattatcaatgtaaaacagtacatattttttaaaactttcctattatcacatgtacatatgtctgatttttttcaacagctgcttaaaattacattgtatggtcttacccgtacttcttcaacaaaagtccttgacttctgtacaattatgttgctgtcagttaggctttcgtgttttaaaaatagtgcagacatggtcgtaaacttatcttgacatacttttatgagaatatttatgggatgtcttcttgggtatgaaactgttgaggttcagagtgtgtatatttatatatctattcttgttggatgatgctcgtatcgaggtattgctgacttcatttattagtgacataggtggatactcgttactctctgtttacatcttgagaaagggaaacaactttctatgtgagaacaacatggaacaagttcactttgcatatgaattaccttacatgtgaggattgctttctccaatgccctatgaaatatggctactgctatctttttttctaatattttctaattttttttctaattattttttagagcagttttaagttcagagcaaaattgagcagaaagtacaaaaatttcccacatacccctggccccacacatgcataacctcctttgttattctctaccagactgaggtacctttttttttgttttttttttacaactgtgcaattgatgaacctgcattgacacatcattatcacgcagagttcacagtttatataagggtgtactcttggtgctgtacatgctagtggtttggacacatgtataatggcatgtgcccaccatgacagtatcagacagtgtatctgcactaccctaaacagcctctatgctctggctattcatctctccctcccctgacccccagcagctgctgacctttttgctgtttccatagttttgtctttttcatacaatatgtatcccattttagtctggcccctttcacttgtcaatatacatttacatttcctccatgtcttttcatggcctgatagcttattccttttaagtgctgagtgatattccattgtctggacataccacagtttatctatttacccactgaaggacatcttggttgtttccaagtttggtcaactaggaataaagcttctataaataactgtgtgcaagttttttgtgtggacatgagttttccactccttgggttgctgctaacattttattaacttgggcatggcctcccttgtgaggtctggcagcgccctcacaagggagttttgtaaccagccctgggattttgctcctgtcagtggtaactgcagctgcctgagaggagtcagtgatgaaattgttgcgcagaggtgtagatggtagcataacctatcttttggaatactgtaagtttattcaaggagaggagagggtgaagagggttacaagttagacccattgttcctgatactttggttgtggaaaccccttgccttacaactacacagaaatcagaattagaattcagatctggattaccatgtttgtttatgttttattatttttcttaaaaatgattctctgtgattctaaacacagtttatttgcatatctaaaactattttcctagttattaatttactgttataattaatcagattttatataaattgtaatagttgaagacattatttcagatatcaatagtttattaagcttattaatagcttaatagtgtattaagattaaccatgtggcaagaaccgcattttgtacaccatcccatttatttttaaaagccatcttatagaataagaaaactgagaatttccatgagagataaggaaaattgccagagctggtacatgactgggctagattcaaagacaggttcctcttcctgcaatgctcgtagtttttcacaataccgaccagtttttattgaatttgtccttggggaaattgtggagcataatgcatttgtactctggtgaagagagagacagataattgctgtaattctctggaaatcacaggagcctagcctaagtccattctgtctccatcaaataagcatattccttacagcacttgccatacatatcatgtactttagcacatatcatgtactttagcagtaaattacagactcttgtactgctcactgttttcctttccatgggtttatatcatctctttcgaaatttgtaataaagtctgtatccaataaatctccctcccctacctccactctcttttgaagcagtttaaagatgacagccagtcagtgaatattctctgggtgtgtgctatgcgcaaggcactgttttagactctggggatagagcagcaatcaaaacagcctgtgccttcagaaaatttacgttccactggaaagaaaacaaggaaacaagcatgctctaaagaaacaattttagataatgatatgtgtcacgcaaaaaagtaagctactagttaatataatagagaatagattggaatatgaaggacctgatatttccctggggaagagagggctggaatctctgagaaggtggcattggagctgaaacttgtcccttcagaacaggacgccatgggtggggacctgggagaagtgagctctgctcagaaggaaaaagaagtgcagggaacttgacgtgggaactagctgggtgtgtttaaggacagatgaaagtctgatgtagctgggtggctgggggcaagtgcacatggcaaagagaatagtggagtaaagtagccacaagtcatgtggacctgagtttgaacttcattcaaatcagaacaggataccaacacaatactttacatgggggagtgatgtgatcttttttattctacctattagaaccagtacaccagttctgggaggatggacagcaggcagaacaagtgcaggagtgacaccagttaagaagtcattgctgtggctcaagaaagaaatgataggtcttagacaagcatgcaacagtaaagaaattaaaagtaatcacattgggatagagacagtgggaaagactgatgggtgatttctgaggcattaggggaaatggtgataggatcacccccccctccaagactgcacactgtgggaagatcctcgtagagaggtgccatttgctgagatgtgtaagtgctgggcaagagctgacttttcagggtcggggtaaagtggggaaatgaaaggctttgcttgactactacaaagtttgagtcacctatgagcctgggagaggtcgagcgggacctacaagtgtatttgctccagggttagacatgtgaatatgggaggtgttgagcctatcagtggtagttacagccatggttttaatgaggccacttagggaaagatcttcctgtggttgatgaagagaatgggacacacgacagagccctggagcctctagcaattaaaaacaagaagggaagaggcgtgaagcaaactgagagagacagtgaaggaggaaggaaatgacaaaagcgtggtgtcagggaagcaacgaaggtaagcaggagcaacaaggggaagtgaaatctaggtcatttttattgtttgcttgctttgtgtttgttatttgatttgtgagatgtattaaggcatacttgcatgcccaaataaataacctagtagaaaaagaacactcatgatagaaggggtaactcaggaagggaagaatgggcaggagggttgagataagccatcaatgtggctaggctggcccttcctgctagaatgagcacttggcttggctctctgcactggaaagaaggtagtctatgcgctcagatgcaggcacagagagaggtggctttgtggatgggtagatgaggtagttctagtctgtttctgttatgttctaaaaatatgaggaagtcatcagctaagtgtgggggtgaggaagaaatattggagatgtgaagagagaagattgcatgaaatcatcttggagagtgggagagtgaattttcctagggaagcatcactgggtggttttaaaaatctgaacaatacatttgagtctcaatgtactcctctttccagcttcatgatgttggaaaaagcagcttaaatactttaaacttgctttcccatcagtacaatcattgtgggtttttgcataacatctatgagatgttgggtaccttcatatacactctccaatttattctgtaaaattgggataatgacacctactagaagagagattatttgcaagaactaaatatctatatgaaaggctttgcaaacagtaaaaaacaaggcacttaaaatattttcctgccgttattcttatccacaaatcctagctcaaactatttagttcttgatcgatttttagaatcccttctagtttgattcctatatctgaagtttggaaattgagcttgtgtttctctaaaggaaaaacaagatgtttaacacagaaaaagatttttttttcttttaaagtgttcttaacattcctcggattctggcattttcttgaaataaaattaggtatgtgttttgaaatgtcaagttttcaaataaactcctacaaacccgctgcgaagttgctccctttgctttgctaccttctgcatatacaccttcagtttcctccaggtgtcccagctccagccccacattcctgtgccaagaatcacaatgacccgtacatttccacatcacctttcttgcaagaagtttaacacatttggcgaacattattgctggagtaataatagttcctcaggtttgtagagctccagctttccctggagcttacaatctgcatgcatattacctgatttagtctcccatcaccgtcttggagcaaacattagtattagacttgcagacgggaaaaccgaggtcttgaaagtttacaggcccagctatatcatttgctttttatgtccttcttcctaactttccagcttctagtagtcttttgaggcccattgcagcctgtctgcaccatgaaacctttcctgttaaccgcagtaataattgattctgctcccaaactacttacatcattgtgcttacagacagccccatacactctggtactgcagtccagtgggaggtaatgtggtactgtagcttggaaagaagacacatcagaacaaaacttgaactacaagtaaactctgccatatgctagctgttatttaaaatctctgaacctctatttctttactagcaaaaattgcaaggctattatgaaggagaaggctgatttatgcaaagtgccttactagcagagttcctaccatgattggcactccatgaatcataactctcgggttacagcaaaagtgtattttatcatttactaattgtttcacatgaatatactttttactctttaataataataaagtcctgcaggaaacaaccaatatcatattatggaatggaattcttaggttttgcttctcttcatgcaattttaatcaatgcagccaagttacacatttttctctaaataattctttagttttgctgtggagtttttcacatttcattcatctttaaatgtattgtcatttcttttatttctcttattattgccccattaatccgtggtttaatatctgtgtgttattgagtttgcagatgtataattttaaacatacattattatattatatattttaattggattagattgtagtcaaacctgtatgtccctatgtggttatctctttgaaagttaaagaggtctctcttgtgacataatgaaggtcagatttttataaatactccaagtgtgctgcagaagcgtgaggatccttggctatgtccagttcacacggtcacattgcacaacatttttcctatgcataaaatgtatcactttgcctttcttctctttcccatatggaaaaatatatacatttatatgttattgtagtaggaaatttggaatttcacctgagtttctttagagaggttttttaaaaaagctcctatgtaggatagagcatagagaaaggaggtgtattttggacataaagaaaggggaagatgcttatcaagtaactattgtatacatggttctttagatatgctccattttaactcccatttggaaaaggcacattaccttcattttaaagataaggaaactgagacttagaaaaagtaagttagatttttgaagccataaatctatttaattagaacactgaaatttcaatccaagttcatcagagttcaaaatctgtatccttcctctgaggaagaagaaaaataactaagtaggcaaacgtgaaataaactgtggatttcttgtccctccgctttgttcttcctctgttatctgatttccccagcgttctaacccgcaaagtgaaaagggccagggatgatctcagagacaggtgccaagccctttcttttgtgatcaccacgctgtgcctacctttcccatccacaattccactcctgacaagtgagagtgcagacaggttgaacaatccagaagaagacagagatgccatatggactcaaaggtgagacaggagcctcactggcttgtgtattcccacagcagcagcaggcacttagcaagtgatgggaggtcactttgcaaatggcaggcacccaacccttgagcaagaggtcctctaccatacctcagtttttgtcataaaagacatttcatttgaacatgaattaaaggtatgaatttggtttgtatgtggatgaggaaagtttagcatgaaaatcagaaagaaaaaaagacattggtgggtaaggatgatggttgtgtttgtttttacggcaggcattaatgggagagaaaacgtatcattattatgaacataatctaatagtgaatatgtgcctattattcactgtgccatccaccctgctaagaattttgcatgcatcatttctctttaccccacttcaatcttatgagatatacatgcctattatctctggcacccatgaccaaactaagtcccctgctcctcccacttatcacaattgtgcaatataagaatttaagtagtttaatctgcaattaataactacctcccccataagactatattctctgggggcaagatccatatcttccttttttataactctatcttcaatgccttgcacaatgcttgctgcataagtaggcacagaaacatattttttggataaatgaatctgcttttacagatgttgaagtagtaagtaagtggcagaatcagtatataattccagacttgcctgagcctcttaagtgctgcaataaataaatgttcacttccttcttgggcaaaaataatcatatatattcttagaggcaagaaaactgtcccatccccaagaagtgccccctgagtactctatccctggaggggttcacattatcctaccaatgtccacttccttttttatcgtgttctgagataatacattcattctttttttgtttgtttgtttgttttcggccgtttggctatggattccttcagagtacatcattcactatgtatctccataatgttgagcacgtagacaacatcgatgtttgttgaatgaattaatgagtgagtgagtaagtgaactgcccaggctcagtgcaccaagagatgtacagtcagttaaccttgttcattgagctgcatttcctgtggagtgatggggggtacctcactgtccttctctttcacatggtctactggaaccaaatgcctgcctttgtatgatagctgcgcagaatcacctaaggctgaagaaacaatgttgtttaaatttcttttccattgtgtgaaggtcattggccagtaaagagatactattcatgcccttaagaagcttgcaatacaggtttcctataaatgaggtactaaccttgtttgaaactcagaatcacagactctacattataagtaaccttggcaatagtttaatctagttctcacccttggccagaatcccctttcctgtaacatacctgcagagacttgaaaatatgcagggatagtgatgttgctacctcatcaagcagtctcttccatagttgaacggcatttctgccaagaaatgttttaattgttttgagctaaatctttcttacaataacttcatccaatttgctgtagtttacagctgtacaaaagaagttgcagccttcttcaataactatctgatggtaattctgaccttccctttcaccttttccccctacacactttgacagtctatttccatatggcacacctcagtgccttcagtgttcctcttgtgattatttcaaatgtctccccagttttgttcacttttctgatcatgctctgtaggttctccccaaaaattgccactcctctgcaatggagtggatgtttgtgtccccccagaatttttatgttgaaaccctaatcccaatgtgattgtatttagaggtggaacctttgaaaggaaggtcattaagtcataagagtggagccctaatcatgggattaatgctcttataatcagaagccagagggctaacttgcttttttcttaccatgtgaggatagagcaagaagatggttatctctaaatggtgaagaggacccttacaaagaaccccaccatattggcaccctgatctcagattgccaatgtccaaaactatgggaaataaatgtgtattgttatgtttaagcaacctaatttatggtatttggttatagcaatcagaggtaagaacccctgcctcccactaaaccctagttgtggcctgataaagatgagtacagagtccgactagaatgtcatcttttctgctggggatagcaaagccatgcttaggctattttggctaagatgccccaccaataattttcttcaaatctattatttctatttctgttttttgtctctgagcttatactctgagatcaaagtttcatgcgcgtccatgtgaagagactaccaaacaggctttgtgtgagcaataaagctgtttatttcacctgggtgtaggtgggctgaatccgaaaagagagtcagcgaagggagatggattatcattagttcttataggttttgggttaggcggtgaagttaagagcaatgttttgcgggcagggtggatctcacaaagtacattctcaagggtggggagaattacaaagaaccttcttaagggtgggggagattacaaagtaccttcttaagggtgggggagattacaaagtacattgatcagttagggtggggcaggaacaaatcacaatggtggaatgtcatcagttaaggctatttttacttcttttgtggatcttcagttacttcaggccatctggatgtatacgtgcaagtcacaggggatgcgatggcttggcttgggctcagaggcctgacacaaagcaagtagaatgaggaccaatttcaagctccttccacagccctcctatcttagccacagtgtcctgaaaaatacactctgagtccaaagcttttgctggggaatgcaatcctagagaatcaggagtgagggaaaatgggatggagacaggaaaacagggaaagtcattctaaaggggtgacatttcaaactagccacctctcctcataggcttcagagtggccttaggaagagattacactttataacagtgtgtctagaggatgaaaagaaaagaatttgtcctccaactctgtcattgatacgttaactccccatgctttcagatgaacatttgtgagcacagactacctcctaaaggcatcatgtctcaggggcaggactccagagatgtgaggcttaggcatgagccaaggtgctgtcagatggtggctaggccagctgaagcctgggggagcagtggcttcagagggactcctggtctgcagtggcagcagtcattgaagctaccaccagaaccctgtgttgcaaagcactgctgatgccactccagaaaggcaagcatgcggttctgcagggatctctgagtgcagcccatctcacctcctgcgggctctagccttcccatatttagcaaaagccttggcttttaagaagcttagggagccagccttaacttatgcatcaattccctgggaaggcattttctgaaccttcattctaggcccagtgccagggttatacactctcagagcatttatatgttcccgctccttgtctttcataatcgtgcgttcacttgtgtgaatatttgctaatgtccatccctggtctgacttcaagcaccaagcacggggccttttttttcttttcttttcttttgtttttgagatggagtcctgctctgtcgcccggagtgagactccactggcttcaatctccgccttccggattcaagtgattctcctgcctctgcctcccgagtagctgggattgtgggtgcccattgtcatgcccggctaatttttgtatttttaggagaggcaacgtttcaccatgttgaccaggctgcacggggtccatttttgtgctcaccgttattcctacagcctcacagaatcctggacacaaagaaagacttaacagggttcattcattcctgaaccaaagcggctgaacgatgtcaacaggaccagagaggctacaggaacgccatattttcttctacatctctttttttaaaaatcttatttcaatggagtcaaactcaataaggtgaattaaaggaaaaagagctgacccaaacaaacaagcaaacagaaaccttttctgtcctgtaatgtttaggcgcagataagaagtgcaaatagagagtttaaaaagctaataaagtgttttgtttgaaaaaaaatatgtgttgctacaacttggagaaaagactgtctgctgcaaatattaatataattcactgtccttttttccaaattctactcgaaataaaatattcagtttttttaaatgattgtcagtaataagaatgtaatgcttagtgtctgtgacattcttttgacatttttcatgtagttcctgctatagctagttagcccataggttttgtcccttgccttctaaaatatgtttttcccttttgtttttcacagttagaccagttttatttttgtcagacaaaaaaattcatctatgtttaacaaatgagttaattattcacatagtggagattctggtctcaattgctttgacacaataaacaaggcatgtctgccttccacaagtagtagagatgcaagtaaataaaagaagaatctgcacacctttttaaaaaataataataataatttaggctgggtgcagtggctcatgcctgtaatcctagcacttagggaggcttagtgggaggattgctttaggctagaagattgagacagtcttggcaatatagcaagaccctgtctctacaaaagaatatgaaaattagctggatgtggttgtacctgcctcttgtcccagctacttgggaggctgaagctggaggttctcttgagcctgagaggtcaaggctgcagcgagccacgattgtacctctgcaatccagcctgggcaacaggagaccacatctccaaaataataatagtaataatagtaataacaataataataataatttaaacagcaacaacaacagaaacttgggatgtttgtcagctcagagtctctttcagctaaaaaatctgaagtatgagtgtccccaaagcacgatcaatgataacaaaagggagatgagcatgaatcaatctttccattgatgatcaaagggctagaccctctccctggctctagataatccaacagctgacagtcaactcctagatctttctctgccttcctttttaaatttttctttgtgattttgatttctcatctgcatcttccgattaacttctcacctgtcaaccaaatagcttagcagctaatcctgatgagtggcttctgactctaaatttagttacatctcttccatgatacagaaagggttaccttccagcacagaattatctactaaaaagccatgacagcccacctgtccctgcttctttcagtgggacgtcactggctagccccaatctgataaatattattatgagaaataacaccacgaggacaaagtaaatagaaacatactggaagcatgtgtagagtacacaaagcagagtgtagtagggtgcagttaatcaagtagactaaaacacctgggaaatacttctttttctagtagctgaggcaaaaatggcaacatgtcagtttgtactaacagaaaatgcccatttagctgtgcagtaaattcattatttttttctataattacactcaaggaaaaattatttggccaaacccttatacaaaaacactgggtgttataatgtacaatattttgaatagtggttttataggtggtgcatacactgtgtgatacaatatataaaaaccaggctcaacaatatttttgtacaacattcaggaagaggtacctactttccataaaggcagaagactggaattgagaaatttctatgaaagtatttctgtaagggagataaaaagtatttgcgttagacatgggttcagagaactgctggttccagtattattctgcatggtccagttagaaaagttaaattctgaagccaaaccagcggcggtttaaatctgcttctgcatattaactaagatgtggccttggacaagtcgtttgaactccatggatctatatcttcatctatgagatgggtataataaaatatacctcacagagactgtctaggaaattaactaaaataatatatttctcgtgtccattttaaaaatacctgttacataacagatacaccatttgttaagaagaatgtataaacagtaggatattttagatctttgagaaattttagattttaatatattaaagtatttagatatgctaattagaatataaaatttagaaaatttaaaatggaaagaagacacaatgtgatcacaaaaatgggtggacatgataaagtcgtctttgtgatgttttgacctgttcatatcactttttacctgatgtaactcaggtaataaaaagaagaaagcagccgcctctcctcatcgtcttctctaaattgccacttgcattgggcaaatggctatttgtcagtccacctcattgcttttctttgcagcctctgagtcttttgttttaactcttgtggaagaaataaaaaacaaaaaggaccagtgacagtcttgtgaatccagagcacttgctgttcttaccgcaaaaaaagaaagggaggccgggcgtgctggctcacgcctgtaatcccagcactttgggaggccgaggcgggcggatcacgaggtcaggagatcgagaccatcctggctaacacggtgagaccccgtctctactaaaaaatacaaaaaattagccgggcgcggtggcgggcgcctgtagtcccagctactcgggaggctgaggcaggagaatggagtgaactcgggaagcggagcttgcagtgagccgagatcgcgccactgcactccagcctgggtgacagagcgagactccgtcccaaaaacaaaaacaacaaaaaagggaaaggtgagagcaggcactgagaatgacaggaaaataaggcaaggagtaagtgatcaaaagtcagggaggttagagaaaagcatgaatctggatgaaggacacagcacaaagtgacttctcccatctctgttctgtgcccagaaaatttaaattgaggcataaaggtatttatcatgggacccttttaaaggaccaattagcatttactatacaccaagattgcttactgtgaagaaatgttagcaggaatgaagaactataaaagctgatgaggaaaaggtcaaataatctaagcaggattactctggtatatgctcaacaactgcccatgatgatggaaagaaatagctttgattgcctttaaaaggaaaactgttaaaagattactaatcttttaaaccagttgtctttacaaatctctaggagtaggtcagttaaatgaaatctctaaatactccgaaagtaagttgacaaaaccaaaatctcttgaatggagacagagctataatgtattgtggcagcttcattgggaattaagactgagattatatcacaaagaagtaaagccatattgaaatttattcatacaccctgtcatctctctcagaaaccctagctcctgctctgaataatttgttcagatatgcttcttaagtatgacatttgaataaatctggtttttgatttgcattttgtttttctttgccaaaaaaaaaaaaaaaaaaaaaaaggaaaagaaggaggggaggaaaaaaaaaagaaaggaagggaaggagaatgaaaaaaagaggagaacaaaaccaaaaccaaaaacacaaaaacaagctttggtcagtttgctttggctatatggttctcaggttaattaaggaattataaagaagcacctttggtttaacactcatcaaaactcttccttaaatatattcaggcatgtacagacaatgaagtctgatgtggaccaatcccaggacaattctcaaagttgtttagctttttaggttactgtgtaaacaatttttaactcttattttattttattttttgttttgttgtctttgcaatcccaaaattttctgttagtttccttatcatgtaatctaaaaagaagaatgggagaacctctttaagtgagcacagttttattagatttgaatccctgccaatttaccactgtagattgtagagtcatatgtggaggctatgtgtaatgtggcatgcggcatcctcagatgtcaaacttctctttaatttccaagtgacaattagccaacccaccgtttcccatgacttctctgactcctaaatatttttgagagtccccagtgattgctcatgtgctcttcaaattcaccttggttgctgctcttcatctcagctgggactcctgccctttttgcagtatcagaatagacttctccagtctgctttcataattctccaaaggctaggtaagacttaactgtaaggcttggagacaagcagaaggtttgcagataggtcaaagcaaattacacacagaaagctttatactgattattatgtgttaaagatgctagacctatgcatggggttcagcccctaatgccaggcaaccctgctggacttctctgcttcacccatagtatgacacttcgttgtatggattcactcagctgtcctcacagggtgctttagaccagatctcctgcaccccaaaaccatgggtgcatacaaacttactgtagggggctaagtaaagcggggcaggatgtagttctgcccagcccaggctcaggctttctctgggacatctcattgtgtcaggctgcacctcacctgaacagggatatggttttactttggtaaaccaaggggcacattgaagttttgtgatttattttctgcaaagtaaattgcaattcttctctatatacgaatgaacaacactgtcagctttaagctagcggtttatcctggcttctagtcaccaatattttaaaatgttttgggtaagttagagaacccagttacattttatataaaatatcagtcatcgtttacacatttctaatatttaactgttatagctattatatgttttctgtagccattaataaaaggtgaataagctgggcacggtggctcgcagttgtaatcccagcactttgggaggccaaggcaggcagaacacctgaggtcaggagttcaagactagcctggccagcatggtaaaaccccatctctactaaaaatacaaaaattagctgggcgtggtggctcacaactgtaatcccagctactcaggaggctgaggcatgagaatcgcttgaacccaggaagcagaactttcagatagctgagatggtgccactgcactccagcctgggtgacagagtgagactctgtctcaaaaaaaaaaaaaaaaagaaaagaaaaaaggtaataaataaatagaaaaaggtgaatgcagagcatgaaaagaggagagacaggaatgaatgaatgagacatccctggacatccctggacaagcactacaaacaatttctgacagagaatggcttagacttccatggacaattcaaccccaaatggcatattaacaagaaggagaagttatatattgaacactcaatgaggatttgctatattcagggacccacaagtaattgacatatgctttgcctttcattcttttaacagctctcttataaacccagtgttgtcattcccatttcacagaggaagaaactaaggcttagaggtagagtagcttgcccaagtctcattgtggtggagacaatattgcagcccatctgcttttccttcacccttccttctcactgcttcgcctctgccgagacacatacattctgctgcccaccagggaatcttgtgaagctccaattcaggcttaatatcccactaaagtatcagagcttcatgtagtggcagtcttttacaaactatatatatttataactcagtaaaatacataataaaattctcttgatcttatcctatgacaaatgctggggtaaaatagtcttccaacaattaaattcacccaagaaacacagaatcttatagaggaagcaaacatgcccattgataaagcaaaggaacaaacaaagttggaatcggggaagggaatctatatataaatatatgagatttctgctctaaaaatacacattcttttataatgaaggtcaaatatgtacacacatagttataatacaaaatagaaagaatcaagtaccatgagagatggagaaataatgtgccatagcagttcagaggaaacagaaagcatgcctcccaagaagcaacagtgttgagcagagagaaagttagtttgcacaggggaacagacctgggttcacatcccgagtccactgcgggcaacttactgacttgtagttctcagtttcctcatttccaaaatgcccagaaacagcataggatgtgacaaaagactgatgtgaaaacatgcagctggatcattttctacatccaataaatattctctctgctctcctgcttggaaaattaggattatttaataaaggagtcagtagttgacatgagcctgaagaataactacaatttaactaaacatgtggaactagcaataacagtagttaacacttatataggtcacatactgtgccaaaacttcatacttcatgctagaactgttctaagcaatatctaaacactatgtccatgtatatggcatgttacttagaataattctggcataaattattagcatacatgttaactaatatgcatgcatatatttatatgtctacacacacacgtgcacgcacatacacatacacactcaccatcctcttgagaaatgcactctggtccctattttaaagttgggcaaatgctagaacagaaaagctaagtgtgtgcctgaattctcacattcagtaagtgggagagcaatgactaaacttaggcaatgtgccccagagtccatcatcaacaccttgctacagtaccatgcaggaatagcaccaagaccctaaaacaagactgcatgtaatgtgtctggccaatgacattgagcagtctaattttttggagtttatagtacattcagggattgtgagaaataagactcaaagcagaacagggccagcttataagaccttgcaagtcaagctaaggaactccatatgcctgtctggcttgattcaaacattgtcaacaatgagatcagaccaagtatagaattaccaagctggatagtctgaaaatcactatttaaacttgggagtgaagcaaagtataaacagggcctgagtgttccttaacacagcaaggtacaaatacgtttatccagcgttaattccctgcattcgatatggggcatacagacctccctggtattggtgcagaggagctgctggaagcatgattaatatcagcagtggaagcactgttgcaaactattggagaaggctaatcaattcacagttctagggggtcccttttttctggatacgaaatgctttaataaatacgttgtaaagaactgaagtgaaatgcaggctacaacaagcattattttgcccccttttctcctttgtaaacaatttatcaaatcaaaaatagcttggtactttaaatacagtgtcagagtcttcttttcaatattataccttttctaatgaatagttggatctagatgctccagaaagccatgaaaataaagaaaaactcactgaatttcttagttgagtaaattcactggtaatgtgaactagggcttgagatagatctttctatatatgaattcaatacctctgctaacctgtcaacaacaacaataataatagcaataacgataacgataacaactgtttaataaacatttggtgttagaatacaggtcccccagtattttgctccaggactttttgtcttgaactatgacaatctgtgcagaaaaaggccagtcttagagtcaaatgcagacagggctactgaccaggagttaacactaagcatcactgcatcttcttgagtctcagtctcctgtcttagcacatcactatattgcaatgatgaaagctttcaggcatttctgtgtggaagaaaaaattaggtgacactcttgtggataggagaggccagagaatttctttgacactgaatttgcatagtgagcaagttttttttctatttagattgtgtgattacttggtgcaggttgacaattctagagcctttctgtcttagaaagttctagctgctataacaaatgtacaatagacttaaacaacagaaatttatttcccacagttctggaggttgggaagtccaagattaaggtgctggaagatccagtgtctggtaagagcacttttcctggtgcgcaggtggctgttttctcattgcctcctcatattagggaaagccaagatagggagggctagttctttttctattcttagaaaggcactaattccatcacagagcattcattctcatgaactaattacctctcaaaatccccacctcctaataatgtgacagtggcattagaatttcaatgtatgaatttgcaggagcgttcagtctatatcatcttctgcaaagtcatctttggaggtcactacaatgatgttatgttactctgaaatacaaataaatgtatgagtgtttaatatatatgattcttttcccacggtattgttatctccatttaatagatgaatagactaagattctgaaagatgatatgaatggcctaaggtgatacacgaaataatggttggaggtgactttcaagggaacattccttcaaagcccagtggtttcaccttgcacatgcagccagcgatccagtgacacttctcaaggggatctagggatagcacgtgaaatgaagaatgaaaaatcgcaactttgtagagccaccagcaaaacattgccatcagacttcacatttatctttagctcaaaggaaataatttcatgataactgatacctgagttaggcaaaatgtttacattttttgtgcttcataatagacaagcagaaatttcctttagtgctgtcctctcctttctttgcactgtgatttacacaaaattccactgagtttctgggaacaaccatatattctctaccttctgtatactatagtttgtgcaggtgccagggatgcaaaatgaatcagggcagtggccctcaaagtacttgttgcctagaagaggagaccaacctaaatacagacattccagctcctttgctgatttccttccatgacagcaaataccattaggatgaacaaggagagtgccaccagcttaaacacagaggttggggaaaaacagagctgagaatatgctttaaggaattagttccctgttgcctttgggggaacatctcgcagtttgatgtaacagaaggagaacacggaaaggagagaaaaagcaggagataatttggaaagcagagggctttatagggaatattaagaaatttttactttatttatttatttatttatttatttatttttgagatgaagttttgctctttttgcccggactggagtacaatggcctgatcttggctcaccacaacctctgcctcccaggttcaagcgattctcctgcctcagcctttggagtagctaggattacaggcatgtgccaccatgcctggctagttttgtattttttctccatgttggttaggctggtcttgaactcccgacctcgggtgatccatctgccttggcttcccaaaatgctgggattacgggcataagccactgcatctggccctactttatcttaaaggtaatgaactcgcttgtcagattgattagatgggagtaacactggaggccaaacaactgtctggaggctattgcagtgatccaggaaggacacgatgaagatgatggtgatgatggagggaggtgggctgtataccaggtatttccttgggtttgtgtttactcaaggccagatctcagagtttacagtaaatatccagtaattctgtctcaatttaccagacaacttggcaagagaaattaattcctttagcttgtaaagatttttcctcctttctctctttcttctttattccattattcttcttgtgttccttttaaaatttgcctcctcaactgctcattttccctaggaagggaaaaatttcattgcttgggctacttacaattcaacagaaaaagttgaaagtcacctaagaaaagaaaaggaacagaggagtgaagaagagaggaggagatcatgataaatgtgggttattatgtggttttgccaaaggctgtcagtgagcttacatcttctccatagagtgctagtttaagatcaaaatctcaataaaatgaatgattaaaaaagacacatgatgtctgccttcatattcctctttcctgcaagaatctgctatctcctcaaagattcccattcagggaggtgaaattatctttggcgaaaattgactataggacaggcaagttggggcttttctgctggtgtagacgttcatccctggaagtgatcctggaaagctctggggaggaaataaggatgagcgagcatcctagatttatttagtcatcatttgtttctcatgaaaccagcaccagccttagcttattctctggtcaattaaatgtaaaggatggcagaaactagagcccacagtctgtgagtagtttgtggggttaacaagctgactttctgcggtatggaatggcatcagggatgaaacacagacttcatatgctgcccattcactccttttgatacttccacctcaaataattttgaatagtctgggtaacatagggcttggtgaaccttgaacactgacactttattatttgcctctctgaagcactctagcctgacacttaagattcctaaatccactgtggtagtagaaggagctctaaactataacgtcataccagtttcctcttaaactaatgacatttcattgagaacattcctcaaaactcctatcctttgttttccatccaaagccatgaccaggaagatctcccattaagacattatattcagattcccgaggagcactattccctcaagatgcaccatgaaaacataacagggcttataatgaaaaaaaaaaaatagggaaaccaatgctacatttatttcttcattcaacaaggatttatgggccacctgttctgcttgagattttaggagaagactctgctctcatgaagcttagagtgtcatcgcagggagataggcaagtaaatgaatatatatgcatatatttagtttgtcaggtggtgataaatgtaggaaggaaaataatgcaagacagagagaaagagaaatcatgctgggaagacaaaaaagatttgtcaagatcacttactaaagctactgccatgcacataagaacataaaggcattatgaagactggcagccttttcatctttgtttctatttttctctttgccccaaggctttaccctgtatacctgagttagcctctccctagctctgggcctggcccttgctgcaatatcactccttaactccaggtgctctaatagaaggttgggctgccctgcctactcccatgctctagttccctacctcattggcaagaaagttgaaaaagatttctatttaatttttgaaaggataaaggcattgtttttttttttttttttttgttttttttctttagtggaatgtgaaaagtgtgattttgctaagagggtatttcagtcttttccaggcatgtgccatatgttggagctgccatacatgttggtgttatctctcagtgcagagacagaaatataaatatatgacactgttgtcaacagtcacttcattaccccctacactttttttttattactttttttttgagaccgagtctcgctctgttgcccaggctggagcgcagttgcatgatcttggctcactgcaacctccgcctcccgggttcaagcgattctcctgcctcagcctcctgagtagctgagattacagacacgtgccaccacgctaatttttgtatttttagtagaaacggggtttcactatgttggccaggctgtctcacactcctgacttcatgtgatccacctgtctcgtcctgccaaattgctgggattacaggtgtgagccatcgtgcccagccaattatctcttacacttaacacagcagaagtcacgcaaaatccagaatttcagaacaaacacagcagtagcaacagaggagtctggtgtcatatacatgccgtcaattacttaacaaacatttatctttacatgcacaacgccttcaagaacaatttctcttctgaatcatacaaaccagtgggcaacaaaggcatgtttctctttgtttctgggttgatgtacataatatcagttgtcatattttatcttctagtactaagtggctcagacacttatcattatcatagggatgctgatagactacttatatacaaaagttcatagtgttctaggaagaattttgagaactttattcagaaacttcattctaaattagtgtttggttgttaaagccataaataggcagaggcccaatggtgatttaggttcttccacatgtaccttaaaataactttatcaatgccctttcttggtgcttgtaactcttgactttcaataaattctatttgtacttacgttattgatggaggagatttaatgcaaataattcacaggcaaggacatttgttcatcaaagtagaagaaggatgagaaaatggaatatagaagtaataactttcatggggcagtgagggtagcgatgcagtagctccatggtcatggggcactgcccctacgggaagctgggcttttctgcctggggccaggtgctggtcactctgacaacactggagtctccagtgggagagtcacttaatggaagacattaccccctgcaaccttcacgggtttactgagtaacttctgctgacaagttctattatatcccctcactaagaataaaaagggatataactgatggtttaggaaggggttccaggagtgtattaggagactctatattgataagatttgcatcagaaataactttcacaggggtaaaagaataacaaagtggtccatgttaggatcccttcatatttcattttctgaagtggccacatcaagcttcaggagaatgaatgacagtgaaggccaggacaaggagactaggaggaaaatgtcaagttgaccactggtggcacgggagcacatgtgtcacagaagatgtgccaaggctgggctgggaatgaggaagcactaatacccactgaagggaatttttactgccagagacagaggcataaacaaatacaccttcagtgtcccaggtacacaactccaacagagtaagagcacagagtcgatagcgactccctgagagaagggagagaacatgagcacgtgattgtcactagcacagctctgagagcctatacccacacaactggtggtgagatcagactggaatgccagcttttctctagtgttggctgaaatccttgtgttgtttctctaatctggaggtcataaccaggcaaagcaagcagggtggcaagtggtgccaatcagtcattcccctcttgccaactgttaagatacaacaggattcttagacagcaatcaaattctgagtggtcttttaagctaatcaaataactgtcgctattaaacgacaagtagatacacacatatgcacttatgatataatagaccctgtgctccaaataaggaagagtgggggaaaaggagagttctattgtttaactctcatttttgtctcctcaaatctatcatttcagagttcctcttagctaccagtagtggccagtgcctaaaacctatttctctcattttcttttctataaacgcctgtctgaaatccatttttgcgctgctctgaatagcagtttggaactttgaaggctgaatgggtttgtcaattttagctttaagtctgtggtttgcatgttaattaccctttgccttattaaatgtatcttcttaaattagaaaagaaaaccaatcatttctaattacctctgtgctgctagttcctccttaactttagtttgtactcttctggggggacatccctttgaaagtcattcagaaaatgtaagtgtcattgacacattccttatatgtagctcgaggtattagcaggtcgttgcttcagcatacactgtcatacaaagatatttttacaagtattttctattggaacccgcctttcttttttttctctctgtctttctttctcttgaagagtattgcatgtattgaagaacctacaaaatgaagtgtcatctgcatatgtattagatgtaagattcacatcttccctggagacttcattttctctattttcttgatgagtaaacagattaagaaaagttttttttatgtttctttgttcattcattcacccagttattcagcaagtctttaataacagtatgtgcagcattaagatgctgtttgtaaattgactgattttgaaaaaagtacacatatttggcttgggttactgaaatccatttcaatatacctttaagaaatactgtgctccatgcactgttctagacaatgcagtttaaaacgagatacaatccagattcaaagaggaattacagtccgggtgccttgctggggatgacagggcaaatcgtattagtccggtctcatgctgctaataaagacatacccgagactgggtaatttataaaagaaggaggtttaattgactcacagttccacatggctagggaggcctcacaattatggaagaaggctaagaaggaccaaacgcacgtcttacatggcagcaggtaagaaagcatgtgcaggggaactgccctttctaaaactatcaggtctcgtgagacttattcactagcacgagaatagcatggaaaaaaacccacccccgtgattcaatcacctcccactgggtccctctcatgacaggtgggggttatgggagcaacatttcaagatgagattttggtggggacacagccaaaccgtatccgcagggatgttaggattagcacccaaagttcatctcttttctttcccactgcttctcttaacatggacccttaggcaaggtggtgtgtttggcagagcaccagacttgcaacagagtctccctgaaaattcccgacatcccctgtcaaggtcactgatgcagaattttgttgttgtacctgtcatttcttgcacagactgtagttaggcaaattaataacatctgcctggtggcaccgggatacttgtaatctcactgccagtcaaagtcaacagtgtaggtcggctggctacagtgaattcacagaatccaaatgagtggctctggtggcagccagctcagacctgtccactctccactgatcagtcccagcaccaatcttgccttagcctcacagtgtctccccataccatgacctgcttaacaaagtcaaggaagagcatcagcacctttgtgtgaccacaggttcttccattcattaaccaaacagtgttgaacacttaggaatgactgagtggcagaagggcagggggtgaatgctgactgatactcttttctttcacttctggcatattcttctgtgtgtcaatcccgagtaagctctccctgtgatctcctttctatgtgcttattttcttttctaatattcaggccaaatatggtggagagttcttggaagaagatgggagattgagattctctttgaagagcaaatttcactctctctgtgaccattacaagaaacttaacttctctaagcctcaagttctttaactccagggaaggaaagacaaactcctaaactgtgtttccgtgtaaggataagatcagtgaacagctttgttaagaatcatatgaatgatatttgagagtaacaaatataataacatttatctcattataactttaaaaggtctatggataaattcagtatattagtacttaaggttgtgggggtggcgggtgggggcggctggggaaaagagaaaaatcaaatttctgagaactagtgcatataatatcattcagaattgtaaatggaaaggacctgcactgattttgcagtgtgttcttgccattaatctctctgagccccagggttttcctcatgaggcggcgagactacattaatgagccacatgtttgtaagatgtactgcaaattcagaaggattaaatacatgtggaggggcgggaacagggtgtctcttttagtgaggaagtgggctgaaaccttctttgatgataagtgggacaaagtgaactaatacatgcaaagagcctagcaagtgcctggcatggaggagacccttgaaaacggtagctatgatgcagccactgcaattacttggttgcagaaaccggactccacttatatatgcaggtgattatgggagtgaagtaaaagggtcactagactctcatcagaatctctataatctagtctcaacttctgataattttttttacttacgacctcggatcacttaacctctccaaaattaagttttctcacctttaaaatgaagataaaacagcctacctacttcacaagaatactgtgatcaaatgaattgatgaatgttctttgtagttattcgtggcctcacactgtcaagaaaagtactgatctggtttccatcctcagagcttaggtctgcctagtttagaattttatatgcatggaatcgtgctgtttgcactctttatggctggcttattttgctcaactagtgtgttgttgcagggatcagcactttgttactttttattgttgagtaatattccaatctactaatattctgtattaaatttcctgtcttgctaggctctagaagtggaaaattagatttttaattttatgttgttcttcttatgtacaaagcactgaagccacaagtttttctctaaggtctgctttaactgtgtcccacaagctttgatacagtgtttttatcaccatgcaattcaaactaatttctaatttccgtttagatttcttctttgacctacgggttacataaaactgtgttgattaacttccaaatatttgaggtttttctagataatttattattgattcctaatttaattcaattgtggttaaaaaacaaactgtacggttttaactaagacctatcttattgtgcaggatatggtctcagtgaaggtactgtgtggactttaaactaatgtataatctgtagttgttgaatggagtgttacatgaatgtaaattaggtcaattttactgataatgttatttgaatctttcatatcctttctgattttttgtcctcttgtataattccattttctgtactttccatcctttttggttttgttcgcatatattttccttctacatgccttgcaaacattacaagatattattttttgaaaaactatgaactgacttttaaaatgtttaagaaagaaaaatagtcttttatatttaaccatgcagttttcatttgatttttaaattgatgggtaatacttgtacatagttatggtgtgcatgtgatattttgatacatacacagaatgtgcaaagatcaagtcagggtatttgggatatccatcagctcaagcatttatcatttatttgtattgggaataattcaaatcacctttcctagctattttaaaatatataatacatgttgttgttaactatagtcactctactgtgctattaaacattagaacatatttcttctatctaactacatgtttgtacccattaaccaatcttttttcatcccaacctcacatatacctttcctggcttctggtaactatcattctactctacctccatgagatcaacttacttttagctctcacatatgagtgcagacatgtgaagcttgtctttctgtagctggcttattttacttaatataataacctccagttccgtccatgttgttgcgaatgacatgatttcatccttttttatggctgaataatacatatactacatttcctctaactattcatctattgatggacacgcattgtttctatatctttgctgttgtaagtagtgctgtgataaacatgggggtgcaggtatccttttgatatactaatttcctttccttttgatacattttcactagagggattgagagctcatcattccttcctatacaccacaaattttacctggcatcaatttcttctacttttgtattagcatttcttagcagctttatagctaataaattatttattttgttcatggaactgtttcttttccttcatatttgaaagctatttttttgagggtgggttgtagaggtcaggggaaagcttcctctcttctttctaaaggttcactgaaaactaacaaatgtaacaaattaacaatggcaggatactagaaagaaaaggcatatcagtgtatttaacatggataagcccaggggagttgctagagactcaataactcaatgaggttcaggtacttcaatacccttcttcacaggggaaagggagatggcagaaatgtggtaattttgaagagcagtaaactattttcagggaaaatggatgtacccagtactcagactatttttaataaataattctttttaggcattgtataggattagagataaagatcatctgggttctaggtgtggtgtttaatttttagttttttcctctctgtaatatgagttgcaatcttccctacttaattacatttcagggaggggattgaagacaattgtgtttctctttggtgggttcagtttccaagtagataaaagaacttcgggaggaggagccaagatggccgaataggaacagctccggtctacagctcccagcgtgagcgacgcagaagatgggtgatttctgcatttccatctgaggtactgggttcatctcactagggagtgccagacagtgggcgcaggtcagtgggtgcgcgcaccgtacgccagccgaagcagggcgaggcattgcctcacttgggaagcgcaaggggtcagggagttccctttccgagtcaaagaaaggggtgacggaaggcacctggaaaatcgggtcactcccacccgaatactgcgcttttccgacgggcttaaaaaacggcacaccacgagattatatctcgcacctggctcggagggtcctacgcccacggagtctcgctgattgctagcacagcagtctgagatcaaactgcaaggccgcagcgaggctgggggaggggcgcccgccattgcccaggcttgcttaggtaaacaaagcagccgggaagctcggactgggtggagcccaccacagctcaaggaggcctgcctgcctctgtaggctccacctctgggggcagggcacagacaaacaaaaagacagcagtaacctctgcagacttaaatgtctctgtctgacagctttgaagagagcagtggttctcccagcacgcagctggagatctgagaacgggcagactgcctcctcaagtgggtccctgacccctgacccccgagcagcctaactgggaggcaccccccagcaggggggcacactgacacctcacaaggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaatctggaaactctaaaatgcagagctcctctcctcctccaaaggaatgcagttcctcaccagcaacggaacaaagctggatggagaatgactttgacgagctgagagaaggaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggaagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcaagccaaaatgtaaagaccatcaagactaggcagaaactgcatcaactaacgagcaaactcaccagctaacataataatgacaggatcaaattcacacataacaatattaactttaaatgtaaatggactaaatgctccaattaaaagacacagactggcaaattggataaagagtcaagagctgtattcagtgtgctgtattcagggaacccatctcacgtgcagagacacacataggctcaaaataaaaggatggaggaagatctaccaagcaaatggaaaacaaaaaaaggcaggggttgccatcctagtctctgataaaatactttaaaccaacaaagatcaaaagagacaaaggaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaagaattgaactcagctctgcaccaagcggacctaatagacatgtacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacaacctgctcctgaatgactactggatacataacgaaatgaaggcagaaataaagctgttctttgaaaccagcgagaacaaagacacaacataccagaatctctgggacgcattcagagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttttgaaaggatcaacaaaattgatagaccgctagcaggactaataaagaaaaaaagagagaagaatcaaatagatgcaataaaaaaagataaaggggatatcactgccgatcccacagaaatacaaactaccatcagagaatactacaaacacctctatgcaaataaactagaaaatctagaagaaatggataaattcctggacacatacactctcccaagtctaaaccaggaagaagttgaatctgaatagaccaataacaggagctgaaattgtggcaataatcaatagtttaccaaccaaaaagagtccaggaccagatggattcacagccaaattctatcagaggtacaaggaggaactggtaccattccttctgaaactattccaatcaatagaaaaagagggtatcctccctaactcattttatgaggccagcatcattctgataccaaagccaggcagagacacaaccaaaaaagagaattttagaccaatatccttgatgagcattgattcaaaaatcctcaataaaatactgggaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaacaggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcctcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatgtcatgaaaatggccatactgcccaaggtaatttacagattcaatgccatccccataaagctacctatgactttcttcgcagaattggaaaaaactactttaaagttcatatggaaccaaaaaagagcccgcattgccaaggcaatcctaagccaaaagaacaaagctggaggcatcacactacctgacttcaaactatactacaaggctacagtaaccaaaatagcatggtactggtaccaaaacagagatatagatcaatggaacagagcagagccctcagaaataacgctgcatatctacaactatctgatctttgacaaacctgagaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactactatcagagtgaacagacaacctaaaaaatgggagaaaattttcgcaacctactcatctgacaaagggctaatatccagaatctacaatgaactcaaacaaatttacaaggaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgttcattaaaaagtcaggaaacaacaggtgctggagaggatgtggagaaatagcaacacttttacactgttggtgggactgtaaaccagttcaaccattgtggaagtcattgtggcgattcctcagggatctagaactagaaatatcatttgacgcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactaggcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcccactctggggactgtggtggggtggggggaggcgggagggatagaattgggagatatacctaatgctagatgacgagttagtgggtgcagtgcaccagcatggcacatgtatacatatgtaactaacctgcacaatgtgcacatgtaccctaaaacttaaagtataataaaataaataaataaataaattaaaaaaaaagaacttcggagaatagccttaacctgtgctttggaacagacaaagtattgagagatggagtgaggaggggaaggtaagagagatttgaggctatttctttagttgtatgtcaaagtgccatattttggggtaccatttcctgagttccagcattggatatagaatgctagattgatagtgttttactttcagtatttttggatttccttttttttttttttttctgatgagtagtttgttgtcattcttgttgttcacatgttacattcaacaactgagatggctttgaataggttggtggctttaatacatctaacaggaagatcttttcttgctattcatccggcacataacttccggcattgataagtgattgattgactttgatccactggtgaacttggggaggggctgattgtagctttgtttagattcaatctgcctctactgttaatgctttctaggtgaccttaagctgctagcaccaggaagtccctgggaccatgcattgaaaacttccagatctcagaactgtgagaccttggatctgcttgaccatgagcctctaagactatgaaactgcaaatgatatggctctgggatagtaggactttgagactgtgagattgcaatactaaggctgcctcttctcagaatgagagtccaagattccttctcattggagcacaccatacattagtcacgggattaactcctataaagcattgccaggtcatgaaacaaatctttaatctggagcatgcgatcaaattttaaacattgttttaagatgtgtgtatgtgtgtgtgcgtgtgtgtgtgtgtgtgtgatattcaatctacaaattatgccaaactcagaaggggcagccagtcatttgaaggtggataagtttctactgcacatttggattagataaataatgctacagacctacggactcacatgcctggggaggtgggatatggtgcacacaatcagtagggaattgagagtgctgaagagaaggttccacagttaggctgtagaaaaacatgacacacttttactctacccaaaacagtaagaaaccaccagaacccatctcccttccttccctcatacatatcaaagtggtatggacgcaaggacattttaaaagaactaaactccacagggaggcgtcctttccaggtgagcagggaaggaggacagcttcatacctgtgccagatgctagtgctgggagcaggggatgtggaagagcatttctgtcaaataaagccattctccatctggataaagagaaaatgttcaaagtttgacaaacctgggagctgaaatgttgaatttgaacctcaagaaattcctcaccactaagtcattcttttatatgagagttttgctgcagaaggggctgcaaaatagaaagtgagccaattccttctttataagccactttgtgatacatgatagtaattacatcaatcgcctaatttcagagctattagctagcgggtgttttgtgcgtagtagaaatgtcaaagattatgcaagataacctaaatccacaggtgctattaaaatataatcaaggttaaggttaaggtctttgaaaatggatttcattaaatagacaaaattatcttacttggttttcactttggtcatctgcgaaagcaatggatcttcttttcattggttgacattgattgcacaccagcaagtaggttttatctatgaatattagaaggtgaaaagaagaacgttgatgattcataatgaagcaagcaaatcggtatgctagctgacatcccatcttaaagatgaggtatgattgggatgatgaaaacgttctggggaaggatggtggtgatggttatacgacaacgtgaatatgcttaatgccctgaattatttactttaaattggttataatgatacattttttgctacgtatatttactccaattaaaaaaatatattaggtgtgagcctttggatttcatcttcagcaaaaaaaaccccccaataattttcagggaaaatgaatgagcccaatgctcagagtatttttaataattcttttttggcattgaataggattagagataaagatcatctggattctaggtgtggtgtttaatttttagtttttttttctctctaatatgagttgtaatcttccctaattaattacatttcagggaggggattgaagacaattgtttctctttggtgggttcagtttccaagtagataaaagaacttcagagaatagccttaacctgtgctttggaacaaagtattgagagttggagtgaggaggggaaggtaagagagaattgaggctacttctttagttgtatgtcaaagtgtcatgttttggggtatcattttctgagttccagcgttggatatagaatgctgggttgatagcattttactttcagcattttggatttcctcttttttttttttctgatgagtagttcgttgtcattcttattgttcacatgtcattcatgttgttcacatccaaataaaggctatgaagtacaatattagtagaccacatagcttttgtgctgtgtattcttttgcttaaacttcacaaggaaatatgtaaaagaacaagatataaatctgagttgcattgtctccctcctgtaacaacaatgaaattgttgaagagtagaaagctgtagaaatttcagactaattactagccaattgggtgatttggagatttttttccttccctttttctctttctaggcttctttttttaaaaaatctgtaaaatggtgataatgataatggaaagtgcttagcatagtgactggcctcaattaatggtaacaattacttcaataaaatcctttccttctaaaagcagattgtcagttatcttccattcctcagtgagtatggacattaggaacatgggaatttcattgtattgttacctttgtaaagcttttaggtgtcatgcctcaggacttgctagaattgctttattcataaaatgtttaagagggatttctttttttttttttttttttttgacagagtctccctctgtcgcccaggctggagtgcagtggtatgatcttggctcactgcaacctccgcctcctgggttcaagtgattatcctgcctcagtctctcgggtagctgggattacaggcacacaccaccatgcccagctaatttttttgtatttttagtagagacagtgtttcaccatgctagccagtctggtctcagactcctgacctcatgacccgcttgcctcagcctcccaaagtgctgggattacaggagtgagccacttcacacagcctaaaagggatttcttaaagaataatgtgaagtatttctgaaaacaaacaaacatgatgcaggattttcacccaagtcatatttcaattgaaatacgtgagaaattaggtatgttctcagtacgagttcgtggagtaacaaatatggttttccactgaaattccatgatagcacagacctcactgcctctcctttcttctctgcagacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctatagtaagtactcacatgtaccctttaccattgctgagtgtgagtggcaccgcctacgtaacatcagtttatctacattgagattgacaatcatcttattttaaagttgtttctagactttcatatgcatatttaaaaatgttcaattcaatcccaaagtagaaaaaacattctacttaggactgtaggaatgtagttgtgatggtgtgataaaggctcaatgaaacattcaaaattaataactcttggggaatcaagtaaccatttgtcctttgcagttaaacaaaattgagtttaattcttccccggaagtggcattaggtattataaagtcttctctgccctgctttcccagagctatgagagaaaagcattcaccttcttgacttgttctagaagacgaggagaaagaacaactaaatgtaattcacaaaatgctttctccttgaaatgatctccttcattcattcatctgtgaattgtttgtattaaatttgaaattagagttctatcttgcacataaagattataaagatgggtagaactagtgatcactctagaataaggttaaaattattcagggaagattcccatccctataattctttcctgcgcgctttatactgaaacctgaaattgcatcataataaatagtttttctgccgtaagcagtgacatattctgcttatatgctaaaattcaatgacccctaatgcataaacacatttgatcactaacactttcatccaaactagttcagtagattcctgttttgggctgtaggaattcttaatgagtacatgtctgtactgttttccatagtgagatcaactgaatgcctgtatcagaatcaataggagtgttgcctagaaaatgcatttccctcaccccatcccatacatactggattataatttctgaaaatggaaatccaaaagcggaatgtttacaaattctccaagtaaactatggatatagagtgtctgctaaaaataaagccctgcacacagggaatttactggtaaaatgactgtatttatcttgaacaagcactttcagaaagaatatggtttagaacagatgcatcaacaaaccattaggcccaggaggaactgccttccactccaaactttgtatgataaagcacagaacacctacaagggtatatgtgtcctatcctgggatgtctggggcatcaagctcctcttgtcacctcctgtttgataacaatttgtcactgctaggttattttaaaatacagtatgggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgccgtccggcctgggcgacagagcgagactccttctcaaaaaaaaaaaaaaaaaaaaaaacagtatgaagcttttatgctacaattaaaagtttgttaatattattatgccagccatctattttgatctaagaatcttattactctttaacatgtccttatccttttgctttttctcagtctgttcagttgtacttatttttcatgccaattgttcacccacagtgtctacttgcacagaaagagtcacagcatcgagttaaatcacaggctgcagggttgaaagatgtctttgagcagcatgtttagcatcttctggtgatgaaccccttggagaatctgataaggaacactctatccagaaaaataataacgataacatgtatcttttctacagtatgagaaggttcagaggtctgctaaagcccagttctaagccaaggaaagaactcctgactttgtgataacagagtctacctttttccatgtaggctccaggtctagtgcatcttccaatgggataaactgccttcaggtcaacctcaccaataatgggaagttaacaaccttggggagttgtcggacacagaatgtctttatgatgtgcctcaagcaggaaccctataatcttcaatcactagtgctgatgctttggtacttttttttatttgggggaaataatttaaaaaacgaatacatttctcagtttgtatctaaaaccaatgggttagcatgccttctgaacctaattctccctttcagcattatcatgttttttatttgactggattggttttctttctttctttctttctttctttctttctttctttctttctttctttctttctttccttttctctctctctctttctttctttctttctttttttttttttttttttttgagatggagcctcgctctcttgcccaggctggagtgcatggcatgatctcagctcactgcaacctccgcctcctgagttcaagtgattctgctgcctcaccctcctaagtagctgggattacaggcgtgcaccaccatgtctggctaattttcgtatctttagtagagatggagtttcaccatgttggccaggctggtctcgaactcctgacctcgtgatacacccagctcggcctcccaaagtgctgggattacaggggtgagctactgtgcccaagtttgactcgattgtttctataaacctaaaatcttactgtaagcaccaccaaacaaaacagcaaaagctcatggccctctttagcaactacctctccttttcctcctctctcctgttcacagaatggcttctctctaaaacttctctttagttgctctccccacctgcttacctcccttcacactgcaactgattccaatcactattgagacatttgatgggcagtttaacatgtcaacttggcctttttatagtcccctgttacccaaccaaacactaatatagttactgctgtgatatgtttggtgtctacaatcatttgactttaagtaaaggagattatcctaagtaatctgaatggacctaattcagtcagttgaaatgcttcaagagcagaacagaaatttccctgagagagacgaaaattcacctgtggactacagtttcagatccttcctgagagtttccagcttccccttcttgatggcccgccctatgtacttcaggcacgtttaaccagacccacaattgtataagccaattccttgcaattagtctcttaatatatataagtatctactggttctgtttctctagggaaactctgactaatacagaatgttctagagaaactacttttctcaagatcaccagtgatttccaagaagcccaattcagtggacacttaatgtttcttaattcacttaagctctcagcagtacttgattcaaaaagctatgtccatatttttaaaacctcgtttttcctcctatctcacttgctaattggctatctcagtttgctaattggctatctcagttcttctactacttttccatctacactgcatgctttgctgaattgacagagttttgtaaacttaaacacatctacatgctggtcaccccacatctgtatctcatggcctgacctcagagatgatgtatgcagcagcctacttgatatttccacttaaagtatagtagatatattaaatagaatatagcaaaatggaactctagattagtggtgccctcagcaacctgctcttctctaacactcctccccatctcagtaaacagcagcactctccatccacttgtctatgcaaaactctgggaagcagcctttgttcttccttctctataacttcaagtcctgcgcaacttatctacagctcacagtaactctatcagttgcttcctccaacaggtatcttaaatccatgtacttctcccacttttgtgagtagaagcctctgtcagttcttacctggagttgttaagtagcctcctgtctggagttcctgcttccacactacactcaccccaaaaccatcttttacacggtcaccaaaatgttctttataaagaaggaatgaaagcatagcattccccttcttgattcatgtgaaataaaattgagatttcttactggcaagtaaaagtccttgttgaacaattgttcccagaatttacagggttgactccttctgccaatgtgattcttaattataatgtcacctcctcagagaagtccccccgactgttcctctaaagtcacctgccttccttcttgtacacccaccattagcccatgattatatgcccatggatatgtgatgtgctgtcatttactttgtggtgtcggccacaacccagaatctcactggctgggtttgcttacttctttcctgtttacctactctagtacctgcacaggaaaaagtaccatgagaccaggcaccttgtctactaacagccagcacttaattggcacaaaaagacagtcagtaagtatttgttgaatgggtacatagatatatcaatccagcctcattctctcagcataggcaacaaggttcatctggaattacttgattttcataatctgttgtagtttctaaggaattacttttgtttctatgggcttaataatttttccaaaagtttagttgagtatgttgctaaagattggtagaattcttacagctctatagtttcttcagacttaactctctacattttggaaatattaacatatttcttccactaatttattcattcagtagataccatttatttagcctttaagataccaggcatcttgcaacactctaggaacatcagaaaataagacctttttctagactttatcagtcttgtatttgtactttgaagcacttttcttgtgattacatgtcatcagttaactgcgtgattgtctaacatctgcttcccctgactcgacaagatagttttgcacagtgccctggattgtcaacattgccaaatgttggaatctgaaattctcttggagataacacatcctaatgaatcttctaatacccagatactttttttattcacaaaatcaaagttagcaacctacgattcctgagcatatgcagctccacgtacaaagtttagctgttgactgggccaagagcttctgggcttgcatgcttccaatcctctatcccttgcctgtgttctcagacctagttctacctgagaatcaccttgggacatatatgcttttaacatacctactctggctgcacttcaattagatcatgatctctgggtagggtctccagtgcttgtataagcattttgttgttgttggttctaggcaagcgtgatgaggaaccagaatttaaagctgttatctcaaacatcacttcattcttagtctgcactatcatttccgtgtctgtgattgctaatcctaaggattttaaatgaaatctgaaaacttgagaagtcagtataatgttaaatatatgggctctgaattcaaaccaacagacatagaaacttgacttcaccacctactagttgggtaatcttgggcaatcttgggtcctctgtggacaccagtttccttttctatgaaaagaaaggtaatactagtgttgcttcaaccaagtaattgtatgaaacagtgctttgcataatgtaagcacccaaaaagtgttagttacaagcatcgttaccttcgtcagatatttaggctgctcaccaaacttccctatatttttttttcccactcttactcaggaccacatctcatctgtatgtccaaggaaggtcagcttttttatataccaggtatccaaggatttcagcaccttcgtcaggccatctggagtctaggctacctgaagttctgtctgggggcttccatttgaatttctttaaatatgggaagctaattaactttatttatttatttattttttgtattttttagtagagacggggtttcaccgtggtctcgatctcctgacctcgtgatccgcccgcctcagcctgccaaagtgctgggattacaggcatgagccactgcgcccggctaattaacttttttttttttttttttttttttttttttgagacggagtctcgctctgtcgcccaggctggagtgcagtggcgcaatcgcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccggctaattaactttaaaaaacattataaattctgataaagttaatgatctgtcaggcctcccagtctcattatgaattacaaacatcattttgtacttcaggtcgcctctgttccacacaagaccttgctcctatttggttaattactcgcaagtggtatcatccaaaattcatcactctcagagctgaagtcatattctccttcctcagataaatactcttgtaattccagcttcagctgccctctttgttgctgttctcatcatctgggatcatttgtcatacatggtagaggccacacagttgtaaatctcacctctgacatgctaaggcccatacagccctatcacagggaacttcagaaggcacagtttacagctctgtcagccctccaagtggggagggacaggatgacagcagtcagacctggggcattggcagtccaatgtgaactttgattcccactttgtaaatcatagcatttttaagagttggaaaaatctccaagatgccagattcattgcagtcccctcattagatttgagaataaatgaaatttcctacccttctttctcatagttcctataggaatgactgaaaaatctcttctatgaagagacaaatgtacacacatacatggaataacaacactaaaataaaagacactgtgatcttccatcttaaatcaatgacttctttataacttttctgactggttgaggatctgaaggctccttcaacagtcaacaaacattacccagtaggctccctctgctaggcttcagagatacaaaaataaataagacaatccttgccctttaggaactcacagattttcagaagctacaaaaggtagataaacaaatgctcataaatatggaggtttaggaaaccaagtctttggcaaggcttgcaaaggagaaaaaaaatacacagctaacactgtttcctgatgaattaatgccctgctgcccagtatgtgatttgactggcgatattgctattattcctgtgacccatatgctaatggcagtgattttaaaggaaacctgaaaagggaaaaatgaccaagtagttggatcaaccactttatgcaacagtacgtttccacaaaaatgccaaggccttgcctcctacaatttgttttgcatttactccctgttgaagtggtcactggagtgattgaccgtgactcccctctgcctcctagcactaagtggcttagtctgtgcccaggtagaatccttaacaaagactgttcaccttcccttaaacataaaaccatactaaatctttttattaaaaaaacaggtcaactaccgtaagggagaaaaataataactatcgtctctaattttgacattgctatttaaatgactctcattgtatgaacatccttttagtgggcaattgtgtcaacactgtggcttaagactactgatgacggtagaagtcaggaagcagcttgtcattgcaggatgctgctgccacaacacgggttgatcattcctttccttctgtgagtttgtggctaagatttctgaaacctcatccccatagtgaaaccttttgctaacctgtctataccttagtggagtgatcactatcttctcactgcccaccatgcacctcttacttaggtgaccatatgtcccagcttgctccttagagttctattccatttcattatttatagctccccttttcaatcccacaagtcctcattagggtaataagttgtagggatcaccataatgcttccctgtaccgcatcttacagtggcatagtgatgcatttgctatgtcgctgttagggtgttcgagttcctcggtggcatggctcacgtctttgttatctttgtatctcagagctcagtacagtgaccagaaggagtacagaatatgcttaatacctgccaatgaatttaggagtaatgaataaaatgatacctactatggaagttccctaaaatgagtacattatttttgtgtaatctttgtcattattcaacagtccagttgaactacaaattttaagtgcaccccgaaagacatctatgcatctgaaatatctaaaaacaaaacaaaacaaaaaaaaacctaagcattatgagaaggcgagtcttactgttagagctagaatgtatttctgctgaggttacgactggaattcagagttttgatttttttttgtactatgattgttttcatgttttcttcttgaaacgcatcctgttttttcatgtgctatcatgcataggaatgtcagaaattttgaaagaaaagctatgttaggagttgtcacagttagctttggaaactttcctcattttcatagttcatctgaggtaatcagagttactgataaggcctggcagtcacagaattggtggaggaatctgtgcaaatttgagctgctgtggaaaccctggtggtttgtggattgctagccaaagcccttgagtcttcagtgcaagagtatggtctgaataataatcatttttcttatataatgtatcatgacataagcttcaaaatgtaattgtattgaaaatcatgtttactgtgaacaactgaagagtccaagtgggactgattgtctcagggtgaatcgatagcttctcctgtcaatgttgagcttcggctttctggcccgtgaggaagctgactctttgtccctggcccactcaggagcccagctggcccacttggggattcaagcttggaatcttctattcagtgaagccctttttttagctggtttgttgacaagctaccaacatccatcaaatatgccagcatatgcctccagaactctgtctttctcagaaaacaagctgtggcagccaggtcagcaattatgggcccagtgggaagtcggccagtgctggcattctcagtactccaggatgggggagcgcatgctggctctgtcttgacccaaaaggagaggttgtgcactgtagagcctgccttcattctaaggactctggagcatgattggcctctccttcatattctagagaagactgccaatgtatcagcatcttaacaaaccacgaattgaattgaattaagtttgtaataatgggttcttaaaaatcgattttgaaaaaaggggaagaaattgttcactccaggaagtaaatatctaacagctgtgttctgggtcactggcatggcagataaaatagagaactctgaggaacagataacaggtattaatatgaaggaaaacattccacaacgaccacattagggttttactaccttggcaaggcacaataaaattgggtaacgggggtaggtagccaggattatgcaggctgaccatgcaagtaatctgatgcattttctaaaacacaaagagctctttctaaaaacccaaaccaatcatacattttccctactttaaatgatttagtagttatttctccattgatatcagggtcacattgaaacccatattattttattttgtttttttattattatttatttatttattttgagacagagtttccctctgtcacccaggctagagtgcagtgacacaatcttggctcactccaaactctgcctcccgggttcaagcaattctcctgcctcagcctcccgagtagctgggattacaggtgcccacaaggacgcccggctaatttttgtatttttagtagagacggggtttcacaatgctggtcaggctggtttcaaactcctgacctcaggtgatctgcctgcctcagcctcccaaagtgttgggattacaggtgtgagccaccgtgcccggccaaacccatattattttatttttaatttgactctccatcatgagacttcctactctagttccgacctgttgaatccccactgcccttggcaccctacacttgagcacagagctcctcaaacctcatcaagaagagcagctactgagaaggctccttaacacaccacttgctgggtcccacacccaggtttttattccttaggtctgcagtgaggtcttacattctgtatttctaacaagctccttggtgacctcaatgctgctggtccacagggtatggttcccttcagcaagtttgattcctgatagatcctagatgggaccctgcactttgtctctctcctccttgccttgagcttgcagctccttccttctggtgggactgcccttcccacttccactccctccttctattctcctattcccaccacacccccacctcaccagcctgactgcctcttatgtctcaggactctggagaaacattgaccctgcctggacaccctcctaaccctctgcccctccctggagagggttcagcgctccctcagcacacagtgctcacctccttccaatggatgtagaattgcgtgcttgctctctccagcttagtcctcgagagcagggacctctgtagagcttgaacacaagaatgcatgagtgaaggaaaaccacaaaaataaaaaaggatagagggtttgagctttgggaagatggtggggatagagagggcattgtacctctaccataacaaagcctcccacatgtgtacatggtttccctgctctcccagaaagggagcaagtgaaagagcaagtgaagaagagcagggaacccagggaaattcagagcaacatttaaggaaaagaaaacttcttatttaacatcatccttcccttctttaaatcagcaatcagcatttttttttttttgagctttggttttcctactttacaaatggggaaaaatatggacctttcagggctactaagaacattaccttaggtaatgtgtgtatattagttccttttccccctgggaaatggattcagagaaagaaatctccacaagtgtgttagagaagttgtgatagagaatatgggagatatattcagttttatgtttttggtacctttaaatctgaagtgatcacacatttcccatctgccataaagagcccatgtctaccctttttactcctttctacacactttctttttttccttttaaaagagaatctgccaagatgcttgtacaacacaaataaagattttgatttctataaccagaccccatgcagcaaattaagttccaaagagatatccagaaaaagtcgttatgatactacctcatgaggaaaaagcagcatataatagtttatctcttattaacagcaacctataaccatgtgggtctttattattatcattttaaatctgcttttccaagtgaagttgggagtgctgagtattcttcttgaaactcatcctgttttttttcatgtgctatcatgcataggaatatcagaaattttaaaagaaaagctatgttaggagttgtcacagttagctttggaagctgattctaagttaatgtacatgctaaatcctaaagaaagtgttgaaaaaaatcaagcaatagtataaaaagcattaactatattaaataaaatagtacattataaaatactcaatactagtgtctgggaaggagtaggaagtattcagttggggaaacctttaatccttctttgaaagttttgaaaacccttttctctctctgggaaatggctggagcctgttgtgtgcaatgtaattaatattgcagaagtgcagagtgtttggctgaaatctctgagaacagcaaagtgtagctcttatcaggtactggtggtggtcggaggaaagctcccgcaccccaccaggctagttctgtgcttactaaaggccgtgcatcctctctgcaccaataagcatgtgtgagtcacacagggatcacagctccagtggctgagcatggcctgcagaagaaactaactctcccagtgtggatggtaagctggctctgaatggtgaaatagatgatgcgcaggaactcaggggagacttgggcaacatcacacttgggcataggcacctcaatggatcacagctcatttcacaggtggttctggatggcatacccttccgagtccattgcgaggctctgaattaatgtggcaaacagcgtacatctggcccttgtcctcatgagatgcattgacgtgttggacaactggactataaaccactgagaaaacagatgagcatctaatccaattgcgaggtgcattatgaagggaatggcaaggtgcttagagggagactaacagggatggaggaccccttagaaaaagggccaggtgggaaccgacagatgagctgagcatcgtggtccaagtgggcagcgcatgggaaagagctcagtggactcagcgtgggtgggtcagacagggtaggtttgaatcctggccctggcacttgctcactatatacctctttgtctctttgtgccgtgtttgtcttatttgtaaagggggaataataatagtattttcctcaaaggttaattgatgtgtttaaatgagttcctgtgcaaaaaaacatctagagaattgcagggcttatgatgtgggctccacacacattatcctagccccacacatacatgcatatgcacatacactaaaatcacagcatgcctggagcagtgtgagggttgaagaaaggaacagaagatgaggtgggagaggtgaacagagcaggatcatgtggagtcctggagactgaaattaattatcagggcaaaggaagttcaatgaaatactttagcaatgctgaggtatgatgtttcttatgctttttaacgttaaaaactgtgtcaggtgaaggtggcaaaagtgaaatctgggaggcagttctgaaactattaatagaaaacggaaagcaggcaatgatgatgaggacatgagtgcacgcctactcagtgtgatgtgaaggctaccgaatcccaaacccagacagaattttttcacaccaagttcttgatagcatctttatgctgtgcttgaaaatcttcactactgagtactttctttctataaataaggaaatgtggggataaaatgttgttgaatgcctttgtattttcaggtctgagattgtgcaattttcacaatgactttgaaggtaggttcctataagccccatcatacagataggagaactggagctcaaagaaatcaagaaagttgcttcaaccaacacctgcccccaggtagtaaggagtaaaaccagaactgaaacccagctctgttagactcgttctactgattggcttagttttctctaggtctcatgacaacgtggagatgtgttttcttaagagataacctatgtccctttgccatcaacatttgtatcctcagttaagtcactagactagccagacattggagggaatggaatgcagatcatagtaacgatgatgaatggagagggaggtgagtgagtgagtggactggagaaaagaaaacatttggaattcagtacttgacccaagaactcaggcctgcatgaggggtccaggcagccaagtacactggagtatgacattataaaatgaagaggaatgggggaaatagcagcaacataatgaatatttatatttacataaatttctccataaccattgcttggacaaaaaagtgtcaaagatatatatatatatatatataaaatttctttatataaatattatatataatttctttatataaacattatatataatttctttatataaacattatatataatttctttatataaacattatatataatttctttatataaacattatatataatttctttatataaatataaataaattttaataaataaaatttaataaataaatattatatgtaatatttatttatataaatattaatccaaattctctcactgctttcttataatcagttgtaagtgtaattgaatacattgttatgcaccattttacaaggatggaaagtgaggcccttagttttgacataaacttaaccccagtcagacacctggtgagtagtagagctgctctatagagggctcctctccttagtttaatgtctttaccagggaaccaaaggcaaatttcctccatgtggttttagttcaccacacaagggaccccacctgccatgttcaggctctgtgctcagtgctggtgctggctgggagatgaagagtatagtggtggtatgagtgagtggacaggatgtatataatttgtggatggtgattctcacatggcatgtgatagcaaaaacagaggggtgtacccagtgctagggaaacccaaagttcagatgcaatatctgtctatgggggtgggacaaatgcatccatgaataatgatggaattgagttactgcttcaaagacaccatgtgtggtatgtctcagcttgcaagaaatgcctcactgggaactagagatctttctgtcccttctccatcatgctggcctcctgcagtactgagatgcaccaaacattctcacgcctctgttatccctcctggagacactgggtccctcctttccctggggtaactcctacatattgttaaaggccaatataccactcactttctctaagaaaccctgtctgaatctaccccctttgaactgagtcagttcagttagcattactgtgagtattaatgtctgcatttgccattagaaactctatgggacactatgtggtccttccactcactgctgggcactacaggggctacctaggacacaatttctactccacagtctggtacagtggcagagtagaagcaatcagaagagaatattaatattgtgtacattgtgatgtacgcactctgcacacactaatttcagctagaatgtgagaagccaaaacatgacagaaaaagaagcttggggctactttggcatccctgggcagtaaacaactgaatcaaaattgaaaaagcatcatttggggtaagaaggtagagtgccaaccaatagagtggccttgataggaactaaaagattcctgttatttcaattactactaatacctctcctatctattattgatttaacacaaataatgtgccatgcacaatgagttcacattgatgtgtcataactttgtaagtcttagcacatgtacttctcaaagcagttttctctaatggatataattatcttcatcctataaataatacaatcaccttagaccaaggtaacccaactaacaaactatgaccatcacagtttagaatccattatgttatctataccacagtcctcactattccatgagtggtggcagctgttggtctgtggccccactttggtctgggtggaatcctagttgagataacagtcataagtgcattgatgaggtagggaggggaggtgctgagaaaggtggacatttgtgaaagtctctttgtatatggacagtttatttttaaagtcaaggtttccatcagcaacattttggttaggacactttgttccgtataaataaattgtgaaattgggttttaaaactaattacagaaaagtattatttcattttccttttcatttcagatcctcagattcacaaagagtgtttctagatccttggaaaaaaaattatcattgtgtatgctcaggctgaggattttaattacatgctgaataatacaaaaattgagttttcttgggtactcaattttaaatagaaaatcccaccccctccacataatcaccacaatcccacccacagaacatggtatataatgaatcagtttcaatttgtaattaaacagtcttacatgtttttctacaataaaagctcattataaaagtttttgtaattaaaaaaatagaaaaaaaaacccgcaaaaataacctagaacaacacattccaaatagaatctctattagatttttggcataatttgtcagatatgtttacacatacctgttacataagtttatctaaatcatggttacttgaccttcaccttgttttgctttgacaataaggaattaaatgttttgtataaaaacactaaaatgataaatatcaccagcacagataaggcagtgatacatttgccctctttgttcaaataacaagtcttcttttgctgagtatttttttccactgaacccagtagaagcctcagaatccttctcaacacagacttctagggagacagtactatgtggagttggcatcataattatatctatttttcatctctaatgttgtgtctgagataaggagatcaagtggttctgactgtcaggaagacaaatcaagagagattattctaagccatctgacatagtaagccagacataggtacttgcggtattttcaccctgtcccctccagcaaaagctgacatatcactaatgagagtttttacttctaaactaatgatcagttcactttgactcagtgtgtggtgattgcttgtaaacgaataattcccttgagtctaattagggtggttctagtctacatgtttcctgttgagactagacctggcagatctcaagaacatttctgtgaactggacatgaaataagatgggaaacagtaacagcagtcatgagaatatgcactaatttttctttcccgctccttctttgttcccagaatcagatgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtaggctcagacttcctcttccaatgccaagggatggagagctcctttactccacagctcacagtgtctgacacttgcagtgtatctggtggaagtcactggagcacaatataagtgatattggtggggatagaaatgtttaaggcatgtatagcattctttgacaccatataatattgacatgtagggagagttgcaaactcattgttatgtatttattgacctaactacgtatttatccatttagttttcttagtaactcaaactctaaaaaaactttcacaagtttaagtatatacacatattataaggaggcttgctcagaatctatgctattaggtacatataagaaagttaagtttcagagggaaaatgacggggaaacattttggttgctccgggttattttgttggggaagaggggatcatatgtgtgaggtgaaaaatctaagtttctaggcattcccatgtctttttaagggaaactcttttctttaggtgccctcactgttccagagtaagccccagactcaccagattccattaaacttagtacagaatgccctcctgactccacacagttaggacatggccttccactgtgggctggcatccatcagggcctgttgcactccaggcaggtcgcgttcattgtcaccaacttcttatcccagagaaggaggagagaggcccagcctcctgtacatgatcaaaggcacttctgaaggaagggtaagctgagtacaaaaggcaggagcacagttcccaaggatgcaaacaaaaaaacactcttctatagaaaaaagaaagaaagaaagagataagctgaaaaaaaaagtaaatggccgtttttcataagaatgactccctgcctcccatctgatatttactaatattaaagggagaggaaaatagttatctttttgtcttcactataaaatagtaaagaaggaaagaaattgcaaaatgtaatttgtaaccctaagttgcatggaagactgacaaaaatccacagttaaatacattttagcaattagctggagagacataaggatgaatattagtgccccaaaactaaacaatataggtttttattttgaggcatttctgaggatcttcttggagccccatggtgactataggcagcggtagcagaaagaatctctagatttcaaagtttaactcaaaattgacacctaatatattagatatacacaccaaaatacctttaaaagtagaatatcacctagaagagagtggtaaaaaaatttgctggtaacctcattggttgtaattaccataactaaagaagcaagcctcagagctttctgaatgttgggcgtccaaatactacacaaacatgcatcaatacatttactggttttcagttttccagaaaggagatcagatgaatgaagttgaacctcccagttacaagtggcttacatagcattgtgtgttgggggtacagttactattacttatcaatagtaaagcgagtgtcttctactgataacattgtgaaatatttcagttactactatttagattcccatttcagatatggcatttcacatccaaaactctgctccaacatacaaaatctaatgttgtaaaccagatacattcatggtgtgaatggtagaaatagcataggtgtggtcatgtaacaatttttcttttgattacagatgtgcaatcaaattgtgttttttattttatttattatgtgatttattatggtggatgtcttctgagcctcagtttctttatttctaatctggggctaatgacttgtcttgcagagtatggacatgaaaaccaagagcactgtaaatacattttctatagcaatgagtaaacatggacaaatgccaaaaaatagaagctccgtattgctcatttattcaaacagtatctgaatacctcacactgtgctatgctggcttttctgaaaataagtggaatattaagataaatagcacctactccttgctatgttacatagatggcaggataagtctttcttcccagtttccatcttctctatatttccaaccatggtggtgattaagtaaaaccttacttgatggaggattaagtagtaagaacatattttatctatattctgcatagttttaagatttcttcatcttttttatctgtctctgcagcttttccctttctatcagtttaccacagttgagtgttttctgtacttacctgttttaagcagtcacctaggatacttcttaaatagcataagtttctaggttcctcttctagagaaacactgccacagattagtactttagtccctcctacctcattacagctagaagatctctggaagcactaagcaaaggggagtggtaatagctttgctttgcccataatgggaaatctataatgtaggtttcataaacaccaggataacaccttgttcacttctgtatctctagcctccaggagaaactcttcctaaagtaggtacttgaggcagattgagtacattaggaacagggttttcatctcaaatttcattattcctgttgggcttgttcaccttcaagcctgcactcctgactcctccatgatccaccactctctctgacaatggggtatatttacagaatattcacagtgtggtaatgtccagtccgatcctcaaggaagacctatggcataagtatacattagcccccatttacagatatgaaatagtagactcaaagaggataaattacttgtcccatttatacagatagtgattagtgtagctactattaccatctccaggtgttttactattaattttagattataaaatatatatcagttttagaaaaccggaaaataatataaaaaaaagaaaaatccaactcttacaacctggttatctcttttattaacattttagtatcttttaagtatttatcttagttatttatatgaattctttaaatattattctaaaatactgttgttttcctgttgtcacacagccttaaaggggaaagggtttataacatccatgatcaggattgttcttttaaaaaaatgaatcagaaaagcaagagaaatacaggagaggtgagagagacagagagaaagagaggcaggattcaagttaatgggttaaagaatagtgctggtcaaataaaggagagagttttggtttttccctctccagtttatatggacatttcagcagtgtctcctttagtgacaattcttcatctgcaatgtttattcattttctaatcagttacttgcaattcagaaattcaggctaagagtgaagaagttcagcaccacggtcagctgctcaggatggcactggggacatacatagtgtactgttgttcttctctagtgatgctctttgatgagtatccaatttacattacatagttaccctaacccttactgtgtctggcttgggtagagacagttctatggcaaaattgaactatgtggttcctctttgcctactttcttaaagtagaacattgatatttttccagaactactagatgggaaagagatttcttctttcaatccataaggggttagatatgtttcctttctcactttttacacatctcattcaaattgcccatggcagtctgccctctgccgaattacaatagtctgaacccattcatgcaggtagagaatcaaagagcagagatattacgtgacaagagaactgttgtaagaataaagaagacaacaatagtacatgcaggtcaatcatccttataagagcccagtgccttttaactgaggcaggatgtttatgcaatccccaatacatacagctgtagcaaagtgagactcaagtgagactcctagaatagaacaaacatctgaggagcacctgggggccgagtacagggttcaggcgccaaagcatgtgattgcataatcaaccactgagatgccagagaaagttctttccattctccaaagagtcaaatgaacatttaatttagctcttttgaaactcaggcattttagtcagccaactcacacatatttatggaatgtttatcatgtttctcaaattgtactaaatactataaaagtttttttttagttgccattttttgagagcccacatttaggcattgcattaaacatttaaaatacatattttatttaaattacatgacaatcctacaatctgtatccaaacccatttacagatgaagaactgctggtcagtgattcccagtcagtggctcaaggtcacatagctgcaaagctgtagatatgggattataaccttattcaatcctaccccaattctctgacattaatcactaaaatgtaataaacttttataaaacaaataataaaaattataaaacaattcataaaaatgttaaatatcaggcaaacaatatgtatgtgttaagttctgagaatggagagatcaggaaggaacagagggatccaggatcaaccttgagtaatctggagattttattatggagaggggagaaaaacaggtatttcatacaaagaatcaatgggataaaatgcatcacatttttcataaattctgtcattatgcaataagaataggttaaacaagtacagtaaatcaggcactgaattctgcactgggggttaaaagttggatttatcagtctctattttcaagaggctgtcagcctggtaaaatagttatttctacttactttttagcttggttatattaattggaaataaaataactatgcatcatcaaaatcatataacaaatgtattaagataatgttttcgaagatagcaaagtcacagaagacggacacaagttagacaccagagtagagcaacaactcctaaatctggagagtgtttttagtcaatacaatctagaaatttcttaacagctaaggacatgtgtttcattgctttagagaaacatagagacttgctctggattgagagtcaagtccattgaatcacattgcttcctgtccgtttcttattttcttcagggctctcacttggatacttaggagaccattcaatagctttgcgtattgcccaacaaagttgaaagggggtacctttacaatactggctgggacagggaggtaaaacttttcttcttattctgtgtcatgtcctcccttcttagtgttgccccattttacttttctacagctccctgttttccaatccattaaattcctttgcaaaagaatgccctccattcctactaagctacataacttacatgcatatatgggagatacagatagtaagagcgtaagaaatgagggagaatgagagtatccatttttccactaagagtagtgaagacagttttagctttggagtcaaatagagttgggttgtaacccctattctttgagtccttaggtaaatcttgtggcttcttggagactcacctttctgcagggttattatagtcagaaataattataacaacatatgtgaagtgtttaacttgtgtgagaagcttaagaaatacaagtgaatatcggtgttgatagcctgacaaattaaaggtgggtgggaaagttgattctgatgatctgatagaggcagtcatgagggaattcacgtgactagccacctattttatcaagagtaaatcaaacccttttcaagaatgactttttttttgtcaaatacaatcttaaacatgagagttcccatcccctttttctcaggctgtctgaaattcacagattatgaaagttaaagtggcatccatgtttgaacagttaagataagacctagaaagaagatttaatcaaacaaggcatttggttgaaaatactgcaacatgcatgccctttaccagaaaatgtgagttctaagtaaggatgaaagaattggcatgcttatccacagcatcttggggtggagggaggagaataaactggtaaattaaacactttttgcaaacatttcaagcttcctataaaaattgttatatttcttagggccttgggtagtatatatcttattttgttttaactatattttaaaccccatgaaaacaagtttttatttcattagaaataattatttcccttatctatttctgtcccaaaagttagtttctgtatagttttattgtttttgtccttcacaattgcccatgaaaatttttatctttgtcttacgaaattagaaacaagttaaaactagtaattgaacctcaaatgccactgagataaaacttaaaatagatattctaagatcaagagtttgataatttcgtgagaattaagtgttttgtgatctctaataatggaaatttctagggaaaatgaaacatttctgaggaccaccatcctacacttctcataaatacaattctaaacatccttttttaatgaagagcagaaattttgttttcccaattttttaaccaaatcaagtttcactaaacttgttttgatataagatatctgagtgttggtatagcataactaatggaaaaagagtgatgaaatttatccatatgtgctcctttttggttaattaataagtaacttgtaattcccaagagactcaataattacacgtcagtgatatatagtcttcaacaaatatactatgcagcgtgaggattgtgtttttaatgaagtttatttttctcattatccaaaatagttatgctcaccctaaaacacacagaaaagaaaaaaaaaatgattatgataaatgcattcttcagttttatccgcacatagtgcttatttgtgccttttccagaattgtttttagtctagattttgtatttttgtcttctgctcatgtatattttaaatcagtatagtctaattattgagtattctatttattaaatattacttttaattttatcaaaaagggcagtcactactgagtatacttttgaaataatgtaagtattttataaatatcattttgatggctatttaatataatacttcatctggtgagtctacataaatgaactcagatttttttttctccttccaaattattggacattatatccaatttttaaatcactagccacttaaacacttttccacaacaaaaagttgtgaacataagtttaagtcccttgatactaactgaaatgtttctccatagaattggtgggactcaattttgcattatctttgggcatatatatatatatatatatgtactaagtaaatgaacaatgtaaacaaggagcaatgctaatccacttttgaggaaaggtcaacaaattgctttaagtattcataaaaatttcatgagctactttgcataaaatgataagtgtgttaattaagtttatggtttcattagatggagtaagtgaaaggtagtcactatttaagaagaagtacttttattttcctaaagtcttaaaattataaggagaagaattgttggatgcaatgagagtggcaaactttctgagccaaagttaagacccaggagagaaagggctgactttagaccttgaggagggtaaaggtaaagttactgatgctagctctgcttcccgcagtggagatgttcctgcccattgagatggtggtgatgatggtggcagtggatgcaagaagggtacagtgaacaacaaccgacataacctactactagaagctttaggatttgaaggtcccaatcatgtacttagagaaccttgatccagtcaacataacaaataccaccctatccaatttactagcgttctcctgccattttaaagttatacaatctatttcactaaataaggccactcaaggattttaaaatagtggaatttagacaattggtagccatctcaaaacataaaggtagaactgtgcctcataccatacatcagaataaatttcagttgaaagtacttagggaaaactagaagaattcttcaatgatctcagaataaggagaaccttttaaactattatacaaatccagaagctataaaaggaaaatgatagatttgttcccaatacacaaatacctgagtggtgaatttaaaaaaatcaatcaaacaaacaaaaacagaaaagcagcaacaaacacaaataaagaaaggcaaaaagatattttcaaaattcgtatcacaggcaaaatataggaagagagttcaaagaaaaggaaataaaaataaaaagattttcaaccttattcttattaaaagaaatgcatattaaaatttcagaaatgcacttttttaacctaccagacagccaaattttaaagctagaccgtatgttgttggcaagcctgtggtaaaggcactcctaggcatttaaatagtcatggtctttatataggacaatttggcagtatttgcaaaattgccaacatgaaagcctttgtcctccagttctttatctaagaatgaacgctacaaatacgcttgtgcccaagcgagataatatccacataataaagtatctcaacagttttaaagatctaaagtaaatagaaacatctaaatttatatcactaggaagctcattaaatgaaatgtgatatgccctatatatcatatatatgattatatattatttatatataattatgtatcatatgtatatacatcatatgttatatttatatatgtatatatattagagcatggaatactatgcagctataaaaaggatgggaaagctctttgtattctgataaagattttcaggatagatgaaataaaaatggaaagttggagataaatgcacattctattttaccatcagtgtaaaaaattaaatgagtagaaataaagaaaatctatctttgctgcttgcatacacctaatatttttctggaagcacaagcaagacattaatagcggtgattacctggggctatggaagatgagcagatggaggaagtgaggaagggaggcagggagggtgttttactatacccaaagttacataaaaaataaaatcagtttgactgattcataatatttataaaatttatcttttgaagcaggatagggtgattaaaatattttattttaatcattgttattattggctctattaaagaacttagtagttgattaaaggccacaaaaacagcacatagaacaaataagttggggaaagggtgtaattccttgccgtgtgtgtgtgtgtgtgtgtgtgtgtgtgtgtgtgtgtgatgtataatgactttaaattttcaaatgtttaatatttggacttattattaataaatttttgttcaatgcctttcttattttaagaaaaaagtgagatgcagctcaatttcaaagtgaaaactccaatattaaatctacctgccttgttacatctagaaatgacagtttataaagcatagtttccttcagccaatgttagctcctgagtcatttcattttatacataaaaactgtgtgtggggtggcggtggtggtgttctttgttctatctccgtcacctggaggccacctcctgccaacgcctcataattacttggataccattcttcctgtactcttcttgcctgaacccctttatgccccatctatccagattatggccggtcttatagccagtcttaccttctaatccaattcccacacagctgccaaaataacctttcttaaaagtaatctgctggccgggcgcagtggctcacacctgtaatcccagcactttgggaagtcggggcagcagatcacttgaggtcaggagttcaagaccagccgggtcaatgtggtgaaaacccgtttctaccaaaaatataaaaaattagcctcatgtggtggcctgcgcctgtaatcccagctattctagaggctgaggcaggagaatcgcttgaacccaggaggcaggggttgcagtgagcccagatcatgccactgtactcactccagcctgggtgacacaggtagactgcatctcaaaacaaacaaacaaacaaacaagcaaaaaaatacagtaatctgcattagtaacctctgcctactcaaagttccatttcttaaaaaaggtgtaaactgtgtgacctagcctacaaagtcctgcatagtgggatccaggccgacgagctcctggcactcagccgctggaagtcctgggccacgcttccctacatctctaaacctggctgctgcttctcctggccttgcaaccatgctcctccttccctcaggtttcagcctgtccctgctgcataaggagggtttcacagcaccgcactctgcatttccatggccctgtgcactgagtgctggaaacctgcatacattttatagatttatttgatgagcatctctacactaagaccacgaagaccttcagagaggacagtatacctttaaactctatgtctccttaatacattacttgtcactgtgaccagctcaggtggatcacacaaatatctttttttttttttttttttttagatgaagttttgctcttgtggcctggcccaggctggagtgcagtggcgcgatctcagctcactgcaacctccgcctcccaggttcaagcaattctcctgcctgagcctcccaagtagctgggattacaggcgcccatcaccttgcctggctaatttttttttttctgtatttttagtagagatggggtttcaccacactggccagcctggtctcaaactcctgacctcaggtgatccgcctgcctcggcctcccaaagtggtgggattacaggcgtgagccactgtacccggctcataatacctttctataggagaaagaaagggaggtaaggagaaaaaatgaaagtatcttttaattcattagcataatccatcaaacaatgaaaactcagaagttgtggaacaaaccaatgaaatcaagtcagctattaattcatcagctctacttttctaattataatgagtctgatgcttctaaccctatatgaagcaaccaagttactcagtgaaggaaataatgccttgggccataatggaggtgggagtgagcagccttcggggaagtggcagctaccgcctgctgaatgtcacacggttgaacaggctgctgcagctgtactggagaaaacacttcccaagagggaggagacagacatttagctttcagttactaaggaacctaatatataaaatgttacaaaaattgaaaatgtatatatacacaaacgttagttctatttaattgttcattttgctaaggttgacgcaagttcctcaggggaagatataagctgtaatctttttggtagaggggtatagccagggacttccataaaattgagagagaaggaggcggagggggaaccaggcaggttggattgcaaagcatgcctttccagctgcatctctcatgtcttctcaaaggggtcttccaaactcaacagaggctaaatcctcaacagtatgacccgagccatgatccatagctgtggtcaaagtaaaaaggatgaggcaaacctagattcaagttctgaccgtacctgaggcatgcatgtctcacctccctgagcctcagagttcttatttgtccaatggagatgataattttcccttagaggattaaagatgaaagttatttcttcctaagtgccgtgcatacagtaggtactcagccatgacatatgggatgattatttccttgccactgcttttgcccacaaacttactagctgtcttccctttacgtatcccagctttactcctcctcccaggcacggctcctaattggctttctccactcaagaaccattcaaactcaaagaatatgcattctttctaaaaacaaaatccccattttcaatcatatttatgtagccataaggacatagttcctttcattatttaatttttcaagtcttgaaaacatgccctattttgtctggaaggaggtatgcatattgaacttgattctggaatctgtgggccaagcctgttattccttcccaggtccagcacagttccaggcctgtagggagacatcattctttgcctttagaacagatatagctgcttttgcttgtggagcattctggtgtgcaaagctgcccttggacacagacatcatcttgcctctctcccctcttcacaggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgaggtgagttgatcctccttcctgcacctcctcggccccttgcttcaatgaacgcagcaagaaaatcagtgagcagaccaactgagagaagtggtggggcactgaggagtcttaccctgggacttacttcctccatctatgccagatagtcaacaaggaaaggagtgcagccagagaatctgagcagtgaaggagtgatgggctaaaccacaagatagcagctctgtgcattttaaaatccagcaggtttccttctcatttttttttttcctgcgtgtagactttctgtgctgctgcctagtctattggttatgtatcttcttaaaaaaaagacctcagttatctgtggtgatgaaagatatttacattataaacaaaacccatggaatctaaaacctgcagtcgagactaccctttgactttcattcttccgatgcaagcttttgactaataccgtggcgagctgtttcttccctgctctcttgtagaagaggtacagtgaaatgaaccagttcaatgcaaagaaggctgcacaaagctctgcaaactggcagccaagagtttgccagctttgttagtagttcagttcaaggaatgcatgttgtgcccctgctgtacaccaggctctgctgggccataaatgtccagtctctgagttggagaaactgagataagctcttgcagaacaaggaggttaaagctacagtggatgaagcccctgtcactggaagtttagaatagagaaattttatatttatataattatgtatttatataggaaacagggcacttaattcaaccttgaaaaatggcagaagttttctagcaggagatgctgctaagccttgaaagaatagggttagaagactggggaggcaagacagagcatggttcaaaaaatgtcaaacagtccagtatttatggaattcaaaagaataggccatcagtggtgtgtttgagtcagcttgttaccagttcatgagtttcaagtgttagattttcagaaattttgtgagcccttggttaacctaggcattattaaaaattaagttggctgggcatggtggctcacacctgtaatctcagcactttgggaaactgagaccagcagatcacgaggtcaggagatagagaccatcctggctaacatggtgaaaccccgtcactactaaaaacacaaaaaactagccgggcatggtggctcgcgcctgtagttcctgatactcaggaggctgaggcaggagaattgcttgaacctgggaggtggtgcttgcagtgagcctagattgtgccaatgcactccagcccgggagacagagtcagactccgtcttaaaataataataataataataataataataataaagttatgtaaacttgaaattagttttaaaagctaatacattcattgatttctaattatttcactatattatatcgatttgcctgtctcttttaactaaaggtgctctggaggtatttcatgactattctatctgtgttgtggggatactgtaggttgggctgctaccacacagctcttcccaattctatgttcagtgaaatcccgttgacagcttgaagtctaccatagtggaaatacttataccacagaggttgacatacattacaaatcagggactgctttattgttttgtgcattgtctagaccaggggtcagaaaactacctggcttgtctggcttgaggcctgtttttttatgatgtgtgagttaagactaatttttacatttttaaagggttgtaaaggcaataaagaaatttttcaaaaagaatatatgacagagactctaagtgctacagataaaattattcaacaaaggtcagcaaaagcattctataaaactcaactggtatacagaacttacaataatagattattgcatattttatcattattcataaattgtgtgctacaagttgttaatatcattaaaagaatcttacgtttggatacacagtcatggcacaccaacacgtacatacctgtgggtatgtgtgtgttcctgtgtcccaccttggacagcctgctagcagacaacttcaatcactagtgggatagataatagaacagtggagatggagatgaataattgagaaatcgggacttattttttcaatcactatcatgagaataagagagctcttttgatcttaaccttagtttagtatactgtggataaaatatgccattcattaacttcaaaaaggaatttgtcactctttgactcagaatacaagataacaggtggatatttttgagttgctgaaaactggaaatctgtgaatatcaattgctctcctttgtcaacttgtttaattgattgacaaaagaaagaacacactcaatattggaaccatctcaaagaaaagagatattttttataaactcaaagacaacaacaacagcaaaaaaaacaaaacaaacaaacaaaaaaacctataaaatcatctggaagtctcgtcattcccccgacatactttccctttaatgtcccagaagatggttctaaaattcactctgttgccagatttaatgtttatttacaagcccatgtctgcttatcttttgtctcttgtgtgtggaatctgtataaaatcatagctgagtgacattacagtgaaagtcagcatttagggaaatgaaatccgatgaagttggaactgatttcttcagggcgtgcacggatgtcttggtgctttataaaatgtgctccctaggaaagaggcaccttgaaacgtttctctgaagtaacctctgctttagggaattcaagtcttctccagattgttcagccagcttgctccaatgattataaaagaagatagattggctgtaatagcggcgtttgacattagctgtactggaagacaagagttacgtgtcaagagaaacctccagcctttgaagattcaccccaaagtctgtgtggagatgaaagaacactggtgcagaaaccctgtgttctactcaccacatgaccactaactggctgtgtaaacctgggaaataaaaagttctaacttcagtcatccagaagcaagatccagacccctgttggaaggaatggagctaaacaggatatgtaaatctaaggtctattttatcacaacgttgcatatcaattagaatctacattgatttgctttctgccatgcgtccatatgtgcacaaatgaggcctggacatcaccagctagaggacaacagtcgtgtctttgtgtgccaatgactaatttttggagcatgtactactctgatatatacttctgatatatatatatactctgatatatacttctgatatatatatatactctgatatatacttctgtatatatcagattttatatcaaagctaatataattatgcaaacctatgtttctttttactctttaccatgatgtggtaataatggcaagaaaaggtagtagctttcattcttcatcttagactaccttaggggatatcaatcaagtgacacaatgactttctataaagcaactagcatgaactttgctgcactaagatgtctgcagtggtctgtttcccttcctgcccagaaggcaaacagacaagagctcacagaatctgctgtcaaaaaaaaaaaaaaaaaaaaaaaagggcagaatgtagatcctttacttctcattaaaatgtcttctcagtttacatcacttaacccatgtgacttctccaaacgctgcgagaaggattgtagcagctcagtttacttccagcctggagcagaagggctttagaaaaaaagatatttttaggatctttagaaaaaatagttcttttctaacatttttgtaatccaagaaggcttttcttatcaaaagtgctcagtaatcttgttttacatagctattttgtaagctcttaaactgttgaaaacatatttgaaaaatatatatgattcaggagtcaggcgtggtgttttttctgtagtcccagctacttgggaggctgaggagggaggatggcttgagcccagtttgaggctgcagtgagctatgatagcaccactgcactccagcctgggtagcagaataggaccatgtctcttaaaaaaaaaaaaaaaaaaaaaaatatatatatatatatatatatatatacacacacacacacacacacataatgtatatatgtacacacacaaatatataatgtatatgtatatgcacatacatatttgatttacatattatcacttcatagatactgaaaaggcattttacaaagtacaaaatatattttcaatgaaaattcttagtcaaaaaaacaaacaaaaaattagattgaactaaacattttaaaatacatagatgtttaatctctgagaataagtttcacagaagttttaaatagagatcatattttttaaacgtaagagtgctggagttcttctaggaatggcataaaatccagaaacttggaactaagatatataaaaaatttcgtctatgtaaaattttttaaaaccatgtgactgttcaccaaaaaaatctatataattatgtcatcctcccaagaactttaaaaagtactacaaaaaaaatcacacttttgaggcagggctggattgcagttcccactcagacaggcaaaacagcgtgtggagactcgcatcgtgaactttggctccagaacgactgcagtaatacattaggaaagcccggaggacacacagaccctccaaaagaagcagattgcttctgcaggacccaggaggcaccccaaatactgcgagtgcccaaactgtggagggaaagggagatcatcccacaaaaggaggatcatctgcccctgaacacaaacccccactggggaacccgaaggtctagattacgggagaagattttgaccttacttggagctcattgaatttagaaagctgggcaaaatacccaaatgaggaaaaaggaggaaaatccctgtgggcttgctgagtcaatttctgccttgcttcacagtggaccttcaggagggctaccagaggcactgagaaaaggccatagggagaaggaaatctctaggtgaacttcgtaacaatttgaacccattgagaagtctcctggccggcactcaaggaagggcatgaatccagtgtccagaatccacaggtcggggaagcaggaaagccctacttatttttgcagctgtgaggtgggtagcctaggacaagttcacagccctgcttttccactgcttggaaacagacttggtgctattgagggtggggcacggtgagagtgagaccagccctttgtgttgcgtgggagctgggtgaggcctgtgactgcccgctttgcccacttccctgacaacctgcatgacacagcaaaggcacccataatccttctaggaacataacttcattgacctgggaacctcaccctaatcctccacagcagttgccacaagacctgcccaagtagagtctgagttcagacatgcctagcccttcccccacctaatggtccttctctacccaacctagtaaatgaagaaaaagggcatatactcttgggagatctggggccctggccaccacctgttcctctccatactactaaggctgatgctttcttgaaaatgccagctcctgggagaaggccaaccagaacaaaagtagtgcattaatcaaacaaagctgcagatcctcacagagtccacttcaggcccctgcaacctccactggagcaggtgcccatatccgtggctgagagacccacagttctgtgtagtcaacccgcagtaccagcacagagcctggtagacttgctgggtggccagatccagaagagagacaacaatcactacagcttggctctcaggaagccacatccctaggaaaagggggagagtactacatcaaggaaacacccagtgggacataaggaactgtacaacagccttgtgtcccagaccttctctttcacatagcctacccaaatgagaaggaaccagaaaaccaactctgattatatgacaaaacaatgttctttaacaccccccaaaaaaattacactagctttccagcaatggatccaaatcaagaagaaatccctgatttacctgaaaaataattcagaaggttagttattcagctaatcagtgagataccagagaaagtcaaagcccaacataaggaaataaaaaaaaaatcatgcaagaagtgaagggagaaatattcagtgaaataaatagcacaaataaaaaacaatcaaaactttaggaatcaacagatgcacttaaagaaatgcaaaatgctctcaaaattctcagcaatagaatcaaaccagtagaagaaagaacttcggagctcagagacaaggtttttgaataaacccaatccaacaaaggcaaagaaaatagaataagaaaatatgaacaaagcatccaggatgtctgggattatgttaaacaatcaaacctaagaataattggcattcctgaggaagaagagaaatctaaatgtttggaaaatatatttgggggaataatcaaggaaaacttccctgtctttgctagagaactagatatccaaatacaagaagcccaaagaacacctgggaaattcatcaccaaaagatcattgcctagacacattgtcagcacattatctaaagttaagatgaaggaaagaatcttaagagccatgaggcaaaaacaccaggtaacctacaaaggaaaacctatcagattaacagcagatttctcagcacaaatcctacaagctagaagggattggggccttatcttcaacttccacaaacaaaacaattatcagccaagaatttttacccagcaaaactaagcttcataaatgaaggaaagatacagtctttttcagacaaacaaatgctgagagaatttgccactaccaagccagcattacaagaactgttaaaaggagctctaaatcttgaaacaaatcctggaaacacataaaaaaaaagagcctctttaaagcataaatctcacaggacctacaaaacaaaaaatacaattgaaaaaacaaaaacaaaaaacagagtatacaggcaacaaatagcacgatgaatgaaattttacctcacatctcaaaactaacattgaatataaatggcctaaatgctccacttaaaagatacagaattgcagaatggataagagttcaccaaccaactatctgctgccttcaagagacacacctaatacataagaactcacataaacttaaggtaaagggatggaaaaagacattccatgaaaatggacagcaaaagtgagcaggtgtagctattcttatattagacaaaacagactttaaagcaacagcagttaaaagagataaagagagtcattatacaatgataaaaggccttgtccaacaggaaattatcacagtcataaatatatatgcacctaactctggagctcccaaatttgtaaaacaattactactagacctaacatacagacagcagctaaataatagtgggggactttaatactccactgacagcactagacaggtcatcaagacagaaagtcaacaaagaaatgatagatttaaactacaccctggaacaaatgaacttaacagatatttacataacattccacccaacaaccacaggtattctattcaacagtgcgtagaatgttctccaagatagaggatatggtaggccacaaaatgaacctcaataaattcaagaaaactgaaattatgtcaagcacttgctcagaacatgggggaataaatctgaaaatcaactccaaaaggaacattcaaaaccatgcaaatacatggaaattaaataacccactcctgaatgatcatttggccaaaaatgaaatcaagatgaaaattaaaaaattttttgaactgaatgacagtagtcattcacaacctatcaaaacctctgggatacagcgaaagcagggctaagaggaaagttcatagccctaaacaactacatcaaaaagtctcaaagagcacaagcagacaatctaaggtcacacctcaagaaactagagaaacaagaacaaactcaattcaaatccagcagaagaaaggaaataacaaagatcagagcagaaataaatgaaattgaaacacacatacgaaaaatacaaaagataaatgaaacaaaaatctggttctttgaaaagataaataaaatttatagaccattagcaagattaaccaaaaaaaagaagagaaaaaatccaaataagctctattagaaacgaaatgagagacattacaactgacaccacagagatacaaaagatcattaaagactattataaacaccttcatgtacataagctaaaaaacctagtggagatggataaattcctggaaagatacaaccttcctagcttacatcaggaagaattagatatgctgaacagaccaataacaagcagcgatattgaaatagtaatcaaaaaattaccaataaaaaaagtccaggaccagacagtttcacagcagaattctaccagacattcaaagaagaattggtaccaatcctattgacactaatccacaagatagagaaagagacatgatagagaaagagagaaccctccctaagtcattctatgaagccaatatcaccctaataccaaaaccaggaaaggacataaccaaaaagaaaactacataccaatatccctgatgaacatagatgcaaaaatccttagctaaacgctagctaaccaaatccaacaacatatcaaaacaataatccaccatgatcaagtgggattcataccagggatgcagggatggtttaacatactcaagtcaataaatattatacactacataaacagaataaaaaccaaaaccacatgatcctctcaaaagatgcagaaaaggcatttggcaaaatgcaggatccctttatgattaaaactctcggcaacattggcatgcaagggacatacttccatgtaataaaagccatctgtgacaagcccacatgcaacgtaatactgagtggggaaaagttgaaagcattccctctgagaactggaacaagacaaggatgcccgctctcaccactcctcttcaacatagcactggaagtcctagccagagcaataagacaagagaaagaaataaagtgcatccaaaacagtaaaaagaaagtcaaacttgtagctgtttgctgattatatgattggttacctagacaaccctaaagactcattcagaagctcctagaactgataaaagaattcagcaaagtttctggataaaaaaatcaatgtagctcttctgtacaccaacagcgacaacgctgagaatgaaatcaagaactcagccccttttacaataactgcaataaataaataaataaataaataaaatacttaggaagatacctaatcaagaaggtgaaagacctctacaagaaaaactacaaaacactgctgaaagaaatcatagatgacacaaataaatggaaacacgtcccatgctcatgaatgggtagaatcaatattgtgaaaatgaccataattgccaaagtgacatacaaattcaatacactcctcatcaaaataccaccatcattcttcacagcattagaaaaagcaattgtaaaattcatatggaactaaaaaggagcccacatagtcaaaacaagactaagcaaaaaacaaatctggaggcatcacattacctgatttcaaactatactataaggccatagtaaccaaaacagcatggtactggaagaaaaacaggcacatccaccaatggaacagaatagaaaacccagaaataaaccctaatacttatagccaactgatctttgacaaagcaaacaaaaacaaaagtggagaaaggtcaccctatttaacaaatggtgctggatatttggcaagctgcctgtaggagaatgaaactagatcctcatctcacaccacatagaaaagtcaactcaatgtgaattaaagacttaaatctaagacctgaaactacgaaagttctagaagatggcattagggaaacccttctagacattggcttgggcaaagatttcatgactaagaaccaaaaagtaaatgtaatttaaacaaagataaatagctggaacttaattaaactaaacagcttttgcacagcaaaaggaacagtcaacagagtaaacagacaacccacaaagtgggagaaaatgttcacaatctatacaatctttgtcacatccaatgactatacaaattctagaagataacattggaaaaatccttctagacattggcttaggcaaagacttcatgaccaagaacccaaaagaaaatgtaattaaaacaaagataaatagctaggacttaattaaactgaagagcttttgcacagcaaaaggaacagtcagcagaataaacagacaacccacagagtgggagaaaatcttcacaatcttcacaatctttgtgacatctgacaaaggactaatatccagaaactacaatgaactcaaattagcaagaaaaaaaagaaaacatcaaaaagtgtgctaaggacatgaatagacaattctcttttttttattaggaaaatgtctttttattaatcaacttttatgttaagttccagggtacatgtataggatgtgcagatttgttacataggtaaacgtgtgccatggtggtttgttgcacagataaacccatcacgaagatattaagcccagcacccattagctgatcttccttttattttttaaatatacatatatatttattatactttaagttctagggtacatgtgcacaatgtgcaggtttgtgacaattctcaaaagaagatatacaaatggccaacaaacatatgaaaaaatgctcaatatcactaatgatcaggaaaatgcaaatcaaaaccacaatgtgataccatcttactcctgcaagaatggccataatcaaaaaatcaaaaaatagtagatgttggcatggatatggtgagcagggaacacttctgtactgttagtggcaatgtaaactagtacaaccactatggaaaacagtgtgaagactccttaaagaactaaaagtagaactaccattggatccagcaatcccactactaggtatctacccagaggaaaagaagtcattatatgaaaaagatacttgcacacacatgtttatagcagcacaatttgcaattgcaaaaacatggaaccaactcaaatgcccatcaatcaattagtggataaagaaactaatatatatatatataatatatataataaatatatattatatataatataaaatatatattacatatacaatataatatatataatgtaatattttatatatatatatatatatatataaaatggaatactactcaaccgtaaaaaggaatgaattaatgtcattcacagtgacctggatcagactggaaactattattctaagtgaagtaactcaggaatggaaaaccaaacatcgtctgttcctactcgtatgtggttgctaagctatgaggatgcaaaggcatgggaaagacaccgtggactttaggggttcaaggggaaagcgtgggaagggagtgagagataaaagaccacaaattgggtgccttgtatactgcttaggttatgagtgcaccaaaatctcacaaatcaccaccaaagaactttctcatgtaaccaaacaccacctgttccccaataacctatggaaataaaataactaaataaataaataatgctaaacaatcatacttttattaataagttaaaagtgtctacaattttttaaaaaaacaggtaacaatgaaaaaatatgtaaagaaaatgaacacataaaaatacaaatgactttcatatgtatgagaagatgctcaacctcactaataaaaaaagaaatgctaatccatgctaaaatattttcaacttatattgtaaagaccaacacttataatataccatgttgacatggaagaaaacagaaatattttatacactgttgatggcactataattaataatatataaaagaaacagtgatgttattcaaaactggaaacaaatgctcttcaacccaataattctgtttccagtaatttgtcctacaattattagcaaatgtgtgcaatggaatatatgctaggtataatacaagatttgaaattacccactaacttatcaaaaagggatttgattaaaaattgcggtcagccctgcatgggaacagctttgctcacggtgctccttgcaggtacccagagtacactcagccacaggcttgcaccgcagctgatctgagtcttggcaggacacctcgaaatgtgagaaggtgaaggccagtgaacaggtgctctgaaaacttacatcatttgcctccctacccctgtgggaggccaccatgtttctcatcacctctcagattgtgataaagggtagagttctctgccctctcctctcagaatagagctgcataatacaaaattgtttagctcaatcaagaattgcgttcttggccaggtgtgttggctcatgctcctaatcccagcactttgggaggctgaggcaggtggatcacctgaggtcaggagttcgagaccagcctggccaacagcatgatgaaaccccatctctactaaaaacacaaaaattaactgggcatggtgcacacgcctgtaatttcagctactcgggaagctgagggctgaggcaggaaaatctcttgaacctgggagttggaggttgtagtgactcgagatcacaccactacactctagcctgggcaacaagagtgaaattcctctgtaaaaaaaaaaaaaaaaaaaaaaggaattgtgttcttagcaatgggaataatacagcccatgttgtggtcatctaacccattttgtttagatgtcatccttcttggtatctacagctacagtgaatggctattctttgcttagctgtttgtgcaaatacaaaactgtctgaatcgaaatgactcttttatctttcccagtctattggtcaggctttggtcttaggctcaccttatgtattggtgcctgacaaacctctatgaaagtgtaatgcactcattaaaaggaatgaggcaatcctatatgttctgatacagaaatcatctccaatataaattgttagaggaaaaataaaatcaaggtgcaatgcagtgtaaacagtttttttgtgtttaaaaaacagaagagaacatataaacattaaagcacatataggcatagaaatttctgaaaggatactaaagcaagaggtaagttagaatctcagagagtaggacaaaaaggaagaaagccttactttttactgcataccctctttaaactttctgaatattttactccatccagaaaagtactttaagaagaaactgaggcagtagaaagaatacattatttaaaagacagttcttatatttgttttaaagttgcatgcactgatttatttttattcctagttttctttaaaaacacgtattactttataatacataattaaatatacttattttttaaattgtctatctcatcatctctagtccagccatagaatttaagctcatcataaaggttgagattttcttctttactttcatttatatctatagcattttgcctgacatataaaatatactctgtaaaaagttgctgagtaattggatgaattttatttctgtgaattataaatgatattaatctgcattctacctttcttcccttaagaagttcctaataggttctccatgctcagaggccaccccttgctgccttccttacttttacttggcgttgcctaatggacatctctctaataacagacctgatttgaaaactggccagacataataaaactatttatttggtgatcatatgatagaatagttatagatcctttgtttcctttggaaattcagttgcagggttaaaagtgaaggcctccatcgaggaaaataaactgaaaaaaataaagaaaaaggaagcaagtagatgcaaagggaaaataacaaaaatctcacaccagttaaaatggcaatcattaaaaagtcaagaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaagactataaatcatgctgctataaagacacatgcagacgtatgtttattgcggcactattcacaatagcaaagacttggaaccaagccaaatgtccaacaatgatagactggattaagaaaatgtggcacatatacaccatggaatactatgtagccataaaaaatgatgagttcatgtcctttgtaaggacatggatgaaattggaaatcatcattctcagtaaactatcgcaagaacaaaaaaccaaacactgcatattctcactcataggtgggaattgaacaatgagaacacacgaacacaggaaggggaacatcacactcaggggactgttgtggggtggggggaggggggagggatagcattaggagatatacctaatgctagatgacgagttagtgggtgcagcacaccagcatggcacatgtatacatatataactaacctgcacattgtgcacatgtaccctaaaacttaaagtataataataaaaataaacaataaaaaatacaaaaattagccaggtgtggtgatgcatgcctgtaatcccaactactcgggaggctgaggcaggagaatcgctggaaaccacccaggaggtggaggttgcagtgagccaagattgcaccattgcactccagcctgggtgacagggtgagattccacctcaaaaaaaaaaaagaaaaaaaaagtcgttttttatcattatatccttcaagttttaaaaactgaagattaaaatatttgtctcaggtcaggaaataaagttcactaagaaaaaaaataaaataaaaataaaataaagagttattattatgtatggcattttaaaattttgtttaaccacccaaaacagccctgtgagaaaggctattatctcctatatcacaaatataaaaggaggacacagagaagttgaagaagtctccaatccctattcctcaatagccaccaagaaaaacgaacaggatttgagcccaggtctgtgtgaccatttgaccagaggtttatctggggagtaggttttccctctgaggagagaaaatcaatgtctggagatacaagcacagactctggggcttggcctgggctctgcctgtgtataagacatgaaatcacattacttggtgccattttccttctagttttaaatttaagattattgtgatttgtggacttgctaactttatatttcttcaagttttatgtgagtgaaataagatacaaagacttctcttaaatttgttaaaagcaaattaattgttttacatatgatgaagggaatattttaatacaagtattatacaaaaatgcattgttttcattaacatgaactaaaggagcaaatggtaacatatcttgttttctattagctgctattagggggatgctagtaggttttaattagtgtgctacttctagtggaagtggccaataagacatttggagactggccaaatttgggctaaattactgtaatccttaataaactcatgtaaagctagccaagcccctctagggtgtttgtaagcctgaggcaagagtacagatagagaaccacatatcatgaatctaaatttgtaaagagttacaaaccaagctaagaaacgaatgaatcaaatatgctctactcccctcccttgacagatagacatccattcacgcccataccccacaggtcaaagttctgcccacactgcaaacagctgcctgttggccacccctcaggaaggcagatgagggacgagaacggtgaagacccttgaaggactatcagagctgttgaggcaggaaactgggtgttgtgtgcagagatcatgttctggaaggcggtggcaacctcctatgtcatctcccctgggctcataaggccctgcccttgtgacacaggatatgaccgaggaagaccacagtgagaccctttaggaacccagttcagggcaggaaggcccactggcctgggtataagggggatgtgaatggaggatttctattgaactctttgcttgaatactaaaatgtacataatttacctcattggccaaagaatctaatgtaaaaatatagtaaattcattcagacaaaaaattataaaatatatgttaggcctgttgggctgtgtcagcagctgacgtctgtcagtctgtgaaaaaatacctatttagagaaaggaactgtaggcctggcattgatcaggtttaagccaggagcaataaggacaaccaaaacaataagaaaaatggtctgaatataccccgttgcaaaacctgatggtagtttgagaatatagggctgccctgtcagcagaaaatacgaggagctgatttatgctgttaagaaaacatgcgtggcgtctgctgctatcactgtgccccacttctgcttttcatctcctccagggctgcaaaagactcaccaaataacatgggccagtgtgctcactttgcctgagacaagggggcaaattttgccaggtttcccagaatggagagagccgtaaggatgtggaacatttagttttaaaaatggcaatgtttcaggcaaatgaggacaagttggtcaccttagcctgggacttttcattgagaaggctgctcagtggaaccaggtgtagaagaagctagggggacactgtgtgtgtggcacttagagttggggctctagattgaaggatgtggaattccagctctttaccttgtggctccaaggtctcagtcaagctgctaaacctctgtatgctgtcattttttttcagctgttaaatggagcaaatcagagtacccaactcaaaggttagagaaaaaacagtgaaggtcagctctaagcatggtgcccgatatataaacatgatcaataagtcctactattgctattactaaaacaatactttgagagagtgcccagggttgaacaagagagacaaaatccaggtgaaatttaagggcaattattggggttgggtcagaagccataggcagaatgtagtaggagggatgtgagcctggagcactggggcaggatgtcaggacatggatgaagcaagggagcgcaggcactttctaaatgaggagcactatcaagaacagtgctttctcttactcaatgctgggctgtgtctgggtaagaaatcacccactctctatcactggcaaaaaagaaataggataaattttttgcagaaaaaagaaggacactggaaacttgtgaaataatagattgtaaaaccaataaggaagaggtaattgttggtaaaaatgtaaacaattgcctcgactcattatttggctccaaagtcgaagcaaaaataaggcatgatatgtactacgagcatattaaagtgacagacatcagaagttccaaacatgggacagactgagtcattcatcctgtcaaacagtaaaacataagttacaaaacgatgaccctgggcaagatttggaaagccatcgtccaattttgcctatatgctgttttactttcttttttaaatactcaactttcaggctaatttttaaaaatcaggagatttaaccagaaaattggaatttttgtcctcatttgtaatggcagaaattcatccacccttgactagtatcccaaaggctgatgatggtgtgtttctccttttgaagggccatgagctttgcatgtacctcagcaaacacccagccagtgtaagtcttaaaagatgaaaaagaagacagcagtttggatcctttttttatacctgtttctttaagaagtggactgtcagaacaaaagtgagacaaacatttacaaatgagaaacttcaaaagtatcagatattcaagtcagatacaaagtgggatctttagaacaggaagactccaaatttaaacaggaccagagaaaaagccaacaagggaggaatgaattccttgctgtggaagtaacatcaaagattgaaaaagagacaagcaaataccaaaccaaaaaaaataaataaataaaataagatcaaagaaaaagagagtggtagattctgggacctcatgcatttaacatcaatgcaggctttctccggggatttatcctgttggagctcacctgtgacaacagtaaatccagcaagttaccagatggactatgttgtccaagacattgagactgtgagtgaaactttgcaatctaatacctggcatttttgaccactaagatcaatgaaaggcacaccattcaatgaccactaagatcaatgaaaggcactcattcaatatgccaagaccaagcaagcaagaaaagtaagaaaagaaagagaccgaattgccaaaaaagacaatgaggcaaaagcagatttagaagcaaattgtcagtgctctttttaaaatccaatttaacaaatatctgttgaatctattaatggtttaatcatacctcttggaattacatattcaaaaatgaatcagatattatctgtgcctctgagaaaattttaaggaggtattccacaaacattcaacaaatgtttctttcagcatctactgtgtttcacgtacccctttaagtaggtgaaatatctcaatgcaaaagacaaaagattcctcccctcatagtgcttgcattctagcaggagaggcaaactataaagaataaacacaagtaagtgaattatatagtaagtaagaagataataaatgctatgagaagaacaaaaatagatcaaggtaatggatctaggagttcttggatggagggaacgagattgcaattttagatatgtcagtcagggtaggcatcattgagatggtgccatttgagaagagacaaaaaaaagtcagttttccaggatgctgtctgagagtgcttgctcagcgtattgatctcttttacctaccacaactagactccatttttcatgcttccaccacctctcacctgaggccaaaataagcctctttgatctaatatttgccctctttgtttatttatttatttatttttccatttttacttcaagaaaataattttctttaaaggtggttattatttttctccaaaaatccttcagcagaatagtgtaactattctctgaaaatccttcagagaatacaataactctattcttttcagcctagccttcaaatatcctatcctatggcaccaactgatcttgctttctttacttatgacttaaaatttgatggtttcctgtagattttggtcactagtatgcttgcattgtttctatcatactttgtcttccatcagtctgttggagcatgaatttgtctttagtgactggccctacacttttagatagaggcagcatgtgatttatccttaattccaccacagggctttgaatcatgcttcacaaaaagtaagggttcagcaactattaagtgaatcgaatttgtaccaaacaattggaattaactttatcaagtgtttctaagagttggtaacagaataataagaataaaagagtttttgatcagtattcactgaaaattactggtcagatgagacagattttgttcggaaagtctgtgacaactgtaagttgccaacgaatggatgagcacattacctaatggaagcaggatttccagctcagtcttccatatactgaaggccctgggccatttcatacagactatgtactcagaaatacaatctccattcagtatcatccacatctgccaaataatgaaatattctagagtatgaatagaaaggcataatcagatcttcagcatcctcggaaatgaaatctgtgaaggaaaattaaaaatgattaaaaacaggtttgaaatgcggacaaaggtacaccaattaaatgtagacagaaagaaagcagaagtggaaaaactagtacctttgaaagtaaatattaagatcaaaacaggccgttgtaaaataatcattatagtctctaattaaaaacacatactaaccccatgtgtatagcacataaaatatcaataaatgcaaaagtaaaagacttctaattgttcctatgcagatattggtcaatagtgcccttatgtgagtacctgtgttgcagttccaacatgcagaggccctagagcctggttgaggaagatggttgttggtttaaccagctatgctgccagatgaatgaactaatggacagagttcaagaggaaaagccaaggttgggaatgttggagggagccaatcagaagccagcagaactaagcaggagactagcttgaggatgatcagtattcaatttttgcaaagagtaggtacaataactcggccagcccaaatcttccatagtggtaattcttatatggagggcttgatggagagaaacagcttagaggaagattttaatttttattttcaaagttttggtaaatcagacaaaaatatgaaaacaaatgatctgagggatatatttattaatatagaattaagaggtgtgtagcctataagtgtttataaaatattcagaaaagaaaaacatcattatatgaagcaaatttctccagtctaatttaatctgataatggactaaatctatagttcaatagtcaaattataacttccaattctcaactacgtaaaacatctaaaaatctaaatcagggtgcaaattcacactcatattcaaatgcacataaaaacggttttgcttcttttccctaactggattcaatatgctcatcagcctctgttgcttctaatggtagaaaaatctaaccttgatgatgaataataattacttaatgattatttaaaaagtagtacattattgggtatatattgggttatgttgtgacgttctctctgtacttttttcctcttcccttggcagatcactaatggggtggtttgtgtatcgtgctgcgtcaagggagtcatgccattcacgagtcccacctgtttggaggcaaaagacttgcatcacagctttcattgctgttgtctgtaggacctgccttagtgtactaaccagggttctctagagggacagaactaataggatacatgtatatattaaaggggtttattaaggagaattgactcacacaatcacaaggtgaagccccatggtaggttgtctgaaagttgaagatcaaggaaggtagtggctcagtccaagtctcaaaacctcaaaatagggaagccaacagtgcagtcttcagcctgtggcagaaggcccaagagtccctggcaaaccactggtgtaagttcaagggtccaaagccaaagtcctcagagtctgatattcaagagcatgaagaatccaacacagcagaaagaagcaagtcagcttcttccatcttcttctgtctggtttttctagcagttccggcagttgactagatggggcccacccacactgtgggtggaccttcctgagggtgagtcctctcctagtccactgactcaaatgttaatctcttctggcaacagccagaaacacccagatacacccagaagcaatactttgcatccttctatcaagttggcacttaatactaaccatcgcacttggcctaagggagtgagatgtagtcacttggactctcccagacctccaaatccagctaccagcccttaacacatttactgataacttcagcccatttgtaccctcaacctgctcttctggtcctggggaccctcagttgcctgcctcacactgtgctagagtgaccaggtcactgtggaacccctctagcctttctgcgttgcctcttcctcagcctttgctaacctgtcttctcctccccagctgatttgctctgggatcatgctgaacttgagacagctctaacaggcttgcagccatcactgctatgggtacttctggaggcagtacctttctgtgttttccaagatctgtcttgtgacctctatccatatccacccaactcacatccagtttcaatccctcagggagaaccagagagcaggcctcaagctaccacctaactgtgctcttgtctcaaccaactgcctctgaaaatcttccacccagagtagaggagagattgctcccctcagtgtaataggaaactacaattttttagtatatggtaccctctatactacctgactggaaaaaactctccaccctgaatattttcaatagcactgtgttttgctatttaaaagacagcagctttttttcattctgtttttttactaacattttcctgcaaacaatattttcttaaaccataactgagcgaagtagagcattaatttttttgaaattgaggaaagtagccaacacaaaatacaaatgtcattaaatatttaaaataataaaaataagtaaaagtaacatatatccaaataacatatatttttacattataaatttgatgtatgtgaaaaatttgcaaatccaaaatagatcttttctttttttttacatttttaaattttatgttaagttcaggggtaaatgtgcaggatgtgcaggtttgtcacataggtaaacatgtgtcatagtgattagctgcacagagcatccaatttcctaggtattaagcccagcatccattagctattcttcctgatgctctccctcctcccaaccttccacaggccccactgtgagtggttcacctccctgtgcccatgtgttctcatcattcagctcccaattataagtgagaacatacagtgtttggttttctgttcctgcattagtttgatgaggataatggcctcctgctgcatccatgttcctgcaaaggacatgatctcatttctttttatggctgcatggtattccatggcgtatatgtaccacattttctttatccggtctatcattgatggacatttatgtagattccatgtgtttgctattgtgaatagtgctgcaatgaacatatatgtgcatgtatctttataatagaatgatttatattcctttgggtatatacccagtaattaaattgctgattcaaagacccatctgcctctaggtctttgaggaatcaccacactgtcttccacaatggttgcaataatttgctctcccatcaatagcgtaaaagtgtttctttttgtccacaaccatgtcagtatctgttgttgactttttaatgatagccattctgactggtgtgagatggtatctcattgtggttttcctttggatttctctaatgatcagtgatattgaactttttttcatatgcttgttagctgcatgtatgtcttcttttgagaactgcctgttcatgtcttttgccccactttttatggggttgtttttttctagtaaatttatttaagtttcttgtagatgctgcatattaggcctttgtcagatgaataggttgcaaaattattctcccattttgtaggctgtctgcttgctctgaaaatagtttcttttgctgtgcagatgctctttagtttaattaggtcccatttgccaatttttgctttagttgtaattgcttttggcatcttcgttatgaaatctttgcctgtgcctatgtcctgaatgctattgcctaggttttcttctggagtttttagagttttgggttttacatttaagtctttaatccatcttgagttgatttttgtatgtggtataaggagggggtccaatttcaattttctgcatatggctagcctgttatcccagcaccatttattaaatagggaatctttttcccattgcttatttttgtcagttttgtcgaagatcagatgattgtaggtgtgtggtcttacttctggactctctattctatggttccattggtctgtgtgtctgttcttatgccagtaccatgctgttttggttagtgtagccttgtagtatagtttgaagaagggtagcatgatgcctccagctttgttctttttgcttaggattgtcttggctattcaaactcttttttcgtttcatataaattttaaaagagtttcttctaatttcattaagaatgtcagtggtagtttaacaggaataacattgaatctatacattgctttgggcagtatggccattttcacaatattgattctccgtatccatgaacatggaatgtttttccatttgtgctctcttcgatctatttgagcaggggtttgtagttctccttgaagaggtccttcactttccttgttagctatatttctatgtattttattctttttgtagcaattgtgaaaggtagttcattatgatttggctcttggcttgcctgttgttggtgtataggaatgctagtgatttgtgtacataattttgtattatgagactttgctgaagttgcttatcagctaataagcttttgggctgagacaatggagttttctagatatcggattatgtcatctgcaaacaaagataatttgacttcctttcttcctacctgattaccttttatctttttctcttgcctaattgcctggccagaacttccaatactatgttgaataggagtggtgagagagggcatctgtgtcttgtgccagttttcaaggggaatgcttctggtttttgcccattcagtatgctattggctgtgggcttttcatatgtgggtcttattattttgaggtatgttccttccatatctagttttttgacagtttttaacatgaagggatgttgaattttaccaaaggcctttcctgcatctactgagataatcatatggtttttgtctttagttctgtttatccacatttatgtatttggaccttttcttaatgtaaatgactcaaatttaaaatgtttgaaaacagcaataaatcaacaaaggagattttgtaatacttttacaaaatatttgtggaatttacaagttcattggtaatttaaaattttccagaatgttttatgagatttaggagccattcatatgataaaatataaaactcagagacaaatttagacttgatctaaatgcttgacaaaagaaaactagagctcaaactaatttattacttaaaatatgagcacaaatggaacacaagagtggttcaataagagagaatttgttaactcacaatgtagtaatataattcagctcatcagtagatcaaacaaaatactctcttgtctgtcacatggatttttgaaataatcgtgaataaaactaagcattcattcttatttaaaataaataaataatttgtgtgtaaaagagcagaaggatattctcttcatgtggagtcagaactagtgttatgtatagctgagaaataaaatttttgttttgtttcgtgatggtattgttgttgatgttacaagtttgtataccattattattgttcaatattgcttcaaaaattttggctaggagttaggaagttttgatggagacagtaaaataggaaataaatgtataagaaattgatttcatattaattatattgaataaggtgttttatatatatatataaatacatatatatcatatgattaccatcataccttgcaggtattgtggattccgttccagacgaatgcaataaagtgaatattgaaataatcaagtcgcacaaagtttttggttttgtagtacatataaaagatatgtttatactatattatagtctattaagtgtgcaataatcacattatatttgaaatatatatgcctcaatttaaagatattttattgcaaaaaaaataaagctaacacagagacacaaagtgagcacccactgttggaaaaatagtgctgagagacctacttgccacagggctgacgcaaatcttccattcatgaaaaccacaaaatctgtgaagtacaacaaagcgaagtacaataaaacaaggtattgcctgtatctccctcacaaattaaaaggaaataactaaagagtatatgatttaatataaaagtatatacaagtatctggttaaagaaaatataccagcagcaataagatgagcacagcatttacatgataaaatgtttaatgaattaaaacaattcatatacaatggaatttttgaaatcatgaaattcatagaaattaatttaatgatgggtatgaaaactagagaaagaaaataataaccttagttggaggactttattagaaatattctgaaaatagaaaacaacggtgggttcttggaaagaaaaatcaaatatttaaaaaatatccattcttctctaactaaatgttttaatgtaaataataaattatcaataaaaattctaacaaactagttaaataaaattattctgtaattaaactttaaaatgaaatagataaaatatcaaaaaattctctttaaaaattaaagtagttgtaagtaaaagtgggcaacaggattaataatactcttcacctattacactgcattaagaaacacttttttactagtgtgaagcttgtaaaaaaatctaaaaatagccttaagtgtatcagtagttattcatataagaagacattctgattgggagaccacatcctcctgaaacattaagacagagacagctaaaaagagacagtgaactagagaaagatggagaagtatccaaatatagatatagttgaagtacatgctgacagtgatatttcaaagcagtggaaaaaactgcatttctcattaaatggtattgggataaacctgataatataaattatcttgattctttttcatagtagaaaaaatactcataacaggccgccttgcttttaaaataatatatctattaaaaaggcaatttgtgttaatactaattagaaataaaagttgtaaaagaagaaaaccgctagtatctcataacctttccaaagtgaaccactattaaattaggttggtgcaaatgtaattgcggtttttgccattacttttagtgacaaaaaccgcagttgcttttgcctcaacctaataataacaattcagtgtatttcctcccagactatgctttatgctcaacttcttattgttgacatcatactttatacccaattgtaactcttgcattttaaaatcaacattatatttacttcccattatattacaaatgtttaataagcaccattattgacaagtgaaatttcatcacattgattcttaattacttgctttacaaaactatatagaacatttggaatatttcctgtttttcatcattatagatgacaattgtggacaatcttatgcataaggctttttgcatacaatataggcttttaaactaggttcttctgtagctgaatagaggtatgttttgtttgtctcttggctttagtatggccatatcttttaagatgcttggataagagataattataaagacattgattttctttttctttttccctccttctgtaaattattgttttatttagtattaaaaaggttcagaaaggaagtgaaaatggttgtgtaaaatagtcccttaagaagcaagcaattacagttatttttacataggctaatcagtatccttttaaatgtgtaatcaagtagcatctataattatttgagccatttggctcaagcatacaattgaatctaccaaaaacgcacgtgtttactttcctttcctaatctttctgagcttaaaactaagagtttgtttctattttcaccccaaaagcttagttttggaggaattccagtaccaggaaaacctgggacctttttaaagaaaaacttccatggatgcatcgaaaacctttactacaatggagtaaacataattgacctggctaagagacgaaagcatcagatctatactgtggtaagtcagcccatctgttttgtcttgatggtttctaccactttggggtaagtcttgctttcaccagcccattcctgaacccattcgtaatgtgtttatcttatgctctgagttcccatcagcgtctgacgtgacactggagagaaagagaatggcagatattgaatctgtgttaattgcactagtggaagaaacaaagacattagggccatccagagaattcattttttttttttgactgtgggtcatatttcaactgtgggtagtatttgcagtctatattgggacaacatgaattttttattatctctggaatatgaaacaagaaaaccacatattccattaaattctatggcttgggagttacatatatgtctacttattgttaatattaaaaatagttccttttaaatgagggagattaaacttttagtgtgtttgagattctcatttatcatattgacaaattaaatgattttctaattaagtaacatttgtcttccctaataatgagtttcatgagggtcaggactgtgttttctttttactactgcattcacaatgcctaacagagtgccttaaacgttgtaggtgctcaataaacgtgttgatgtttccaacaataattttggatttgtctgtttctctctccagttctatccatttttggtttatatattttgtagctctgttgtttggtacatacacatttagtatgctatgtattctggtggattcactcttttatcattatataatattattatttgtctctgataactctctttgctctgaagtgtgtctgatgttaatatagccactcttgcttttcctctataaaggtctttgtcatgtaacttttcccatccttttgctcttaacctgcctatgtaatcatttttgaagtaagtttcttgtaaacaacaaatagttgggtcatgttttttaattcatgctttcaatttctgtcttttaattggtctatttagcaaatttacatttaatgtaatgaatgttctgggcttaagtgcctgtttattttgtttcctgggtttttaaaaattctctattttctctaacgtcctgtgtttcctggatagtttttaaaattctatttttcttatctagtgttagagtatatctgtgtatagcttttgttagtggtttctgtagacattatattatatatgcataacttattgtggtttactggtttaatcattttaccaatttagctgatatgtagaaacctaatttccattgacatccctttatcttcccttatttattttacaattgtcttaattaggcaattatatttttagaaccatttctatatatttagaaccatttcaagtggtattattttgctacaatgtcaaacatcatttaaagaattcaaaaggagaaggatagtttgttgcatttactcatatttttgcccaatattgacaaaatgtaaagaaaaactcttgaaaccacaagggatatgtttggcttggattagtattaaagactcatgactgctgcccatgtgatctgcagtgacatcacagtgtttgtgggtgggtgggagagggatgcccttcatatcactggaatgtgatgaaagtcctgactcaccactaaaccatctctgagactgctcctgcaggggatgaagggggttcctcatgatagctcagtagcggcagaagtctaggctttccttgtgatcgcagttgataccatagggagagacttggttctatctgacaatgattaaattcacagatcttcagaattggccttgtaagccagagagtcccagattgatcttcccatataccaccctggccagaaacttgggcacctcactacagcatggctcagtggaaatggggccatagtcttttctatggcatttggcttagggagagaagtcgttgtctaacagcatctctctttctatgctatcctttcctcatcctttggctatagacagcagtcttttaatggcaattttaaacaaaattttatctgcaccagttggtctctctgggttgtctttcagcagcatacttaaaacagatcaggttaagagaaaatccagagaattctccactgtgtttttcttttggtcccgagatttttatatatcctttatttcttttccccaccattcagagatattttaggtaagttttatacataattcctatagtcttttagttgtacttagcagaataaatagggaaaactatgttacttcatattcctggaattggaaatctcttcaactgacattttttctttaatccatggcaagagtaggtcaccctgtcattgacagcaaaaatatgattctctttgcaatcttattgtagaattatttgaacaaactatggcttaaatgactttgtgtttgttttattctttgataaatataatctataagaatttttttgtgttttgaggtatcatattaacacattttcttgaaaattgccattggattcaagggtatgaggcagaggatgctcatggggaatcacacttggattaaagattgtcagcattttaaaaggtttgtgtcaagtccctgactccttcggtttggaaaagttaggatgatgctagggagggattaattacctcactggctctagaaaagccatgacattacttgtccatctctggctaatgcccaaggctcctgacaattctgcaacttatccacatgagcttaggtcaaccatctcctaattaacataaacactggcttgctcatgacatttttttttttttttttttgattctaggtttggagtcttgggctatggaaagcacactcattcctatccctttcccaataatgtttcaagaaatatttcataatatatcagtttccttgagtccaatctgctgacacagattgtgattggagcaggggcactacattgaaatcatgcactaccagaagtttagattagcctaatgtcagaaatattaaagggcatcactacctaccattttgctaagatgtggcagagcaaagtgaaacaacagtaagcttataaaaacattgcacactcattgttcataaactggggcttaaaagtataaaagcctgagctttagatataaataactaagatccctatagtaatattaaaaaagaatatctttatacatattatgtgttaaaaaatatctttaacgataagatagattggagttactgaataagcagagcaaaaaaaaggaagataaaaaggaacaagagaaaaaaaaaacttcagtttctgaatatcagtagctttcaccgtttcgttttctgagagaatcattatctaaaactttgctaagtgttgtggtgacttttaaactactatagcacttatcaagttgcctacaactttgctagcatatgttactccttggggtttaattggcagtattgttaatatgaggcataaagaatccatttagcactaacgtatttggaaaaaaatcccaagaaaattgttttattgtgcaggtaggcaaccttagttttaaccttcacaatttagaagaaaaaatgtacattatttttcttccaaattgcttccaacaccctgcttaagtgagaattcgtatcactatacacttgcacatgtacacacacacccacacacatatttatatacctagtctatctcctttaggaatttcttacgagaagcaatggtttgcactgttaaataccgaagtacaaactctttcctttctgtagtcaagcttaaagtttcccccaaagacaccatatctgctacaaaatcagctttgctccatcactaagtcactgtggtactaagtaagggcttttggaaggaatgatatttttgtccttttctagtgttcgcagactctcttacagttattaggccttgggaagttcagattcaagggatcaacaaatcaggcagcaagagtacggtactactcataaattataaaatgtgtttcaaggcccacggaagctccagcctttgcctaacctaacgtatgcctctttagcaggctgcattcagcaggcatcctcattgcaatctgtcatctctttcttgtgggaccttcccactccctggagacttaacagctgttccatagggataattcaatttagtctttatagctcgatttgactacaagacaattctccacatcccgaaatgcagtaaaactaacagcttaaagtagacataaaaaatacctcactattcttcctcaaatcctttattatatgctaatacagcactatataataaacaatcagaaagcaaatggcccattgaagtgtgtgtacagtacctgtaatatggattattatatatgtagtataagaaatatattgctctgatagtttcctgaaaatgattaatttcataccttgcactccatcagaaatgatgctttttttgagctgtcctttctgagtcttctatctcttctcccagaggcaaggagcataacatgattccctgggagctggctgaagtttcactcccattattgtaggtctcaaaatattttcctttttatttaaaagatcatagtggaaatgcatgtgttactttactttgtcttcaatagaagggaagaaaatgcaaataactaataggaagactctacttacagagttggctttggagctaattgactatgtcaattcatttctgtacctttgtttccaaatgggaattggaatcagggaattggatgggcgatggccaatactaagccaatataataatactcccaaccccatggttgaaattgctaaataatcacaaaatgccttttcttttgtcctagagggaaacccaaaggtctcacttcagtgttcctggaagcatcctcaataaaatcataattgaaacattgacttcctaggttgttcatccccactccatggcttattcagctatgggatcttgagaaagttacgaaacttcagtaccctcatacataaaatgagggcaaatatagtatctacttcaaagtgttagtgtgaagattaaatctgcaatacccttagggcagtgcatggtacacactaagcacccagtagattggagctattaataaaaacatctataaatccattcaactgaagttgacatataagccaatatttatttgccattttagatagctaattaatgcagtcacatacagttccaaataataaaagttgattggagatagctcctgttctttcctgaatctgagtttctgtttactcccaaactatgagtcatgaagtgggtttgcagtaaatatattacaaacttaatcatctcatttatttgagaaaatttgatgaaaatcattacttcagatttgatcaaatggtagactcctttaaaataaggaacttaaaaaagtgttgcctgataggcttgggtataacagatgtattgaagagtaacaacagtgagttttcttgaagtatgttgcccttcgtttgcatctctgctgtcatgcaacttattggagcatggttgattatttcttatggctctaaagccaagcaaacactcactgtcagagttatgtgtaagagataagggtggacatgagagcacacacacatttacatctgcaggtgcacacatataacatacacacacacgtagtgacaggcacctttatcttacctccctgtgacccaaaacctcatgaaaattgctcagagaaaactccctactgtctagtaaagcctataatctctttagcttgtttccgggatcatgtttcatctctgtgagtatgctctgtgataaatgatactttctcttgatcgaaggaatcatttgaaaaagcaactaacatattgtgtcttttctcttctcattcctgctctcttctacttccatttgaccagtcggacatccacatcacctgcatctatgctgtatgctcctcatacccagcaaaaatcatttccaagttattcactcactgaacagttgcttccttcctttcttcaggaaaattggaattaaatagtttcaaggtcatatgaagaataatgtgccttaaagaaaaaaggaaaaactaacagtgtaatggttaatatcttagtccatcaaggcagctataacaaaatgtcataaactgggtagcttatgaataagggaaatttatttctcacagctctggaggctggaaagtctgagatcagagtgccaggacgatcgggttcgggtgagggctcccttccaggttttagacctcacagttctccctgtgtcttcctccttcctcacgtggtagaaaaacaaacaagtcccttggggctattttgcagccattaatcccaagacctcatgacctaatcacctcctgaaaggccttacctcctaataccaacatactggggatgaaatttcaatatatgaatttcaggaaggggaggataaaaacattcaaactatagcagtcagcctgtctgaaaattgttttacctgaaattagtgttatgacttttcctttctatcagataagcaaatgtaaccagtttcttttgctcatctgataaaattattatgtaaagtattaaagaaaatttctttagaatgttttaaaaatatttctatataaaatgaaaatttgcaaaatacagaatagggtatgcaaccagccagagaggaaaacactgttctcatctattataggtatttcattttcacactttaaatgtatatttatatatcatagaccacagtttattgacaattttatattttacctttttaaagtattttcaatgtttttaaaacttttattaaaagttgtttcttctctatttacaaatactatttcagcactaaatcaatttaccatagttcatttaagaatctactgtgttaaaatttgagttgtttgaatttttttctgccaaaaataatattgagattacaaccatggtgcaaaaataattttcttaaatttaaaacagataactagaaatgaatataattgggtcaaagattgtgaacttttgactcaacccacattgcataaagccacaccacattccacgcccactggccgtgtatacaggagacggcttatcctgctagtttcacctgatacttttcaagtcatttcaatcttcaagtgctttttaaaaaaacgggctatgtaaaagttgaaacgacctcagatgtgcttcctgatgcaaaacatccaactaatgagctgagcatattctttttatgctctcgcacctgcagtaataaacgcaatgaccactcccccattcgaagatcctgtatttcagagagcttatagacaaggccacagatcacggtgctagcactggaggggcggtcagtggagggttgactgatgacctgtggttctattagagatcctctgtctcctgtgtgtagcaggcaggaggcagacattattatccacgttttataccaaaaaatatactcaggattagggaaagtcaatgatatatattagtggctgtgcctttcacagtcttcttcctcctcttatggaaagcaatccaccatcaggttttattcatttttattaggcatttattttttttagggtcctgaatgactttcatgtcaaagtgaagaaaaaaataatacaaggctgggcagatccgtgaacagcactgatctctgagtattgaagaccaatgaggtgtttcagaaatggcccctgtgtgctttgttatttgccgaagaaatctctcctgggtgtctcttgcaatgtaagagcttgagggcggaatccttgtctttggtgtgaaaaaggaaggagggcagcgaagggcagagtgtggaatcccactgctccctggctcccagcggctcctgtctctgcatctggctggcaggctctccctctgggttgaaggagaaggaggcgaatgctgcaaagggtcaaagcgcttccccagaaactcagccctttgtttccagtgactcttgtactccttcaaggtgaatagaaacttttatgtgagtgtttcaaaactgttataatcagtttgtcctacatataaaagtttgcttcccagtttgtcactggtgtggcctcttttctaaccagacccggattactcgctgtttctggaattcactccttgcacatccttctctcagcctttgcatgttgtgtttctcccatgccagctgagctgtcttttttctcctttacctcttccctgacccagccccaaactaaccattcttcttcaaactcactggtagggttcacattctgaaccagagtaatgctcaaaatattcaccaggttctcagaggtaaagcagggtcctggagcccccaggctatgctaacccagaaacctggagttgctacattgtagggaggcctagagagcactggaagacaggcaggcaagcccaggtttcagggagccactaggagcttgggaccagtggctacatatcaagtaatatggaaggctgaaattgttaaaaatggaatcaccattagcgcaggccggtatgaacctgctgcataccctccatgccttatcaactccaggcattgtggagcacagtgctgagaaaaactgtagggctgtattcagagtgggtagagaaggctactgtaatctgtaagcagtgtctaccacagggtagggcagtggggagtgttgaatgtgctgtctgcccaccctgtccaggtgcactccttgtcccaccttctcctcagagcccctttcagactctcagtttcataatacctttcttgctgtgaatttcatatgtatacaacatggcataacttagcatttgagtcattattgtcattaaaatgcagttattgaacatctactgtgtttacagcaaatgatccttcttttcaaagagaagcatcctctctgctctcagaaattacacacctggcatggtcttatctttgtagaactcagagttcacagcagatgccctggccttggccatctcctccgaactttctgctctcctggccaccgtttgacagccacccttcccctttttatctcatttgcccttatggtttgacccttactttttgtttgtttctccatcttgatcactcatcacaattctggtttcccatttggcttttccacttcctttctttcaccacaactccagcctgtggatcccgacactacttccaactaccacagccacagccactgcaccaggtggcaagactcaaacacagcttataagagctagaaaggagaaatcacagggatagtaagttcaggaaagactttatgtaagtgcaggaacttggcttggatatggtagatgcaaaagctcaaggtgggactgtgggaaacaacaaactttattctagtctatttctttgcaagagttattcctgtttccctaagtatataaaagaaacacccttttatgtcactcatggtgttaaatatgtgatatacggtcaggaaatatatatggatgaaggcactaggtgttgaggaagagaataatctttgaaggaagtaagattaaatcccagccttaccacgtaatggatacaaaatttagataaagttttttaagctgtctctgcttcagtgtccttcatctacatggtagagataataatgcctactttacatatataaagtgactcctaggatattataggcattgaatcactaagagctgataatattatcataattatttttatagcctcactctgctcaccatttcttctcacatgttccccatgaagaccatagtcctgtgagtaatctctagcctgctcgacaaatggccttttagaagtacaacactaaaggttatagatcagtgattattagtattttatagggcacacacacccctttaagaatgtaatgaaaactatgaacacattttacttcacataacatttttgaggcttcattgatgcctgtgaagctcatccacagacagcagcccaagaactccaggttaaattttagacaaggaaacatttatatgtaaaataaaactgtgtttttataaattcctaataaccttctataagtgttccttgttgaatcaccaggacgcctagtaagtagggaccggacactggatttgttccatataagccagttgggcgggcttcttagaaacgcttcaccttttgtcacaagattcagaagacatctctatgtgtcaagttctgagttattagaaaatgcaaaaaaaaaattatataaaagtggctttctagtagaaggtgggtaactaataaaacaggtaaataggactccaagttgtccagaaatagcatgtgcaaaaaatcaggtactttctctagcttgagatagggtggactgtgaaggaataaggactagaaatgttctctctgcccacctcccaggctgagattcagacctcttcaagtaggtgcagttaccggccgggcacggtggctcacgcctgtaatcccagcactttgggaggcccaggcgggtggatcacgaggtcaggaaattgagaccatcctggctaacacggtgaaaccccgtatctactaaaaatacaaaaaattaaccaggcgtggtggcgggcacctgtagtcccagttactcaggaggctgaggcaggagaatagcatgaacccgggaggcggagcttgcagtgagccgagatcacgccactgcactccagcctgggcgacacagaaagactctgtctcaaaaaaaaaaaaaaaaaaaaaagaagaaggtgcatttaccggggaacacatagcatacagatagcaaagaagcttgccggaaaacttaggtcccagcttcctgcagaagctgacggctgtggggagactgaagctggggtcaaccatgcagattccctgggactcccactgaagaacagtaatggaggacaggaacctggaagcatcttccagcctctgtcaccctgcagcggccctctagtgccccttatggacaaagcataacattcagccagtagacaaaagagaaatgtttgcagggtccaactccgctaccgtttgattgagcaatttcactactaggtgtctacccagaggaaaataagtccctataagagaaagacacttggacttgcatgtttatagcagcacaatgcacaattgaaaaaatatagaaccagcctaaatgcccatccaccaaatggaaaaggaaaatgtggtatatatgaaccatggaatactactcagccataaaaaggaacaaaataatggcatgtggagaaacctggatggaattagagactattattctacgtgaagtaactcagtaatggaaaatcaaacatcagaagttctcacttataagtgggagctaagctatgaggatgcaaaggtataatcataataaaacggactttggggacttgtggggagggtggctggagggtgagggataaaagactacaaactgtgtgcagtgtacactgcttgggtgacaggtccatcaatatctcagaaatcaccactaaagaacttaccgatgtaaccaaacaccaccaatttacacaaaactattgaaataacacttttttaaatgtaaaaacaaaatgcagggcaaagaagagtggctttggaactgaacttcagaataaataattagcacaactgccaatctcttttcttcttttaaaaatttgggttaaaaactagagaccttggacatctggaaaagagagttgggaagaaacaaggagacatacacatattcacggtttcatatgtcacctgatcacagttttatgcaataccagcatgtctcacaaatgtatgaagtccaaaaccacaagtataggcctaggctcttgtaattagtaaaatgtcaatttatttaactttgtcattatgtatatgctccataaaaaaatagtgaaactactacttttattataggcccatgtaatttattacattaaaatgcatttctcagactcaaaaagtttagaacactgtataggtggacatgaattagaagtactctaataatttacctgtctacatgaagatttactgtaattctcacaaaaacttattcatatttaacctaaaaattgttttacatagcttattcttttccgctgaaattgttttatttccctgccacttctttctacgtttgtctaataccttagttcagctcatcactctaacagtacatccacccatggggttatccagtatcccccatggtggctagtgattacttcagtattttccctgatgctgtaacaaggtccaagatatgccctgtgtcagcctaggaagcaagctctctgaagcatattcaaattcatccccaaggcatcagggaaattcagtagctaaataaatatcttctctttaaaaatattaatgatcatttaagtataaaaaataacagattgactaggtcttcaagaatgtgactctgagatgaagaacaaagctaaatgaacatacgtagccttcataagccgcatttgatgtgtctgacagaaatttcgtatccaaacacattttagggtgaaggtatgctctgaaacccaccatttacttcatttatatgtgccacatggtggatgcctgtaaggacagtatgtttgtgcagctgaaaatctgatctttgttacagaaacttcaatgctagcttcccaaggtaaatggaagatccagcagccccagaagatgactttggtagaggattatatgtgcccatacacacggaatgagcttgcctagaagctcatttcatgtgcatgggcacatataatcctccatattgcaatcataatgaatgctttctctataggcttctagtaaactggagtgcattttatcaaacttttaattccttatgatgactggcaaagaccaagaaaatctaggcttttttttcccccatgtttttacccacaaaatcgaatgcttatactaggatttgacaatccacgacatttgggtaaaacttccagcttgtgacccaaagatttttgcaaccctcatgcacactacaggaagcagtcagtctccatgattcataagagtccagagatcattaggtctaagactgctctggaaaagtacaagaatcacagtcttctcaacaatgtaactcaacaaccaaactataagctaataaatatcttgtaaatcacattgcattaccattattcatgaaaaaataatacttatagattataggaaattgtgtaaacaccgaaaatcagaaagaaaagaagtcacccgcaattttatcaaagcaatcataaatactatacaggtatagattttttagtcttcatttcaaaaggactactttggtgtaattttgtgtaattccttttcttgttatcagtattctgccatgaaaataacgtgttgatcatttattacatgccaaatattgtgtcaattgatttttatatttatctattttaatcctcagaataaccttataaagtggatagctctttgtggtttcagtttgggaaaaatgaggttcggtaacattaaagtaacttccccaagatacgtaactagcatgtgatagaatctgctttccattagtggcctttctaatgccaaatctgtgcttagctgctgtgatgtgcttaacacacgttttatattttgctctaatcactgagtttctaaatgttaactaaaatgaaattacattataaaaatggtgatcgataaatgttgaataagtgaatgcatttttaataagaagagaaatgagtaattttaatttcctgtaaagaagtgagcacactacaaattggaggtgcatagtaaatattcattgaagcttatgttgtgatgattataccaagatgaacttgaaggatctgatgaaaggtgaagaagaatgtcttcctaagggagcatcttctcatagaaggctgagcctctctgtacctaaagatctccatatacacttaagagatctgttgcacagtctgactcttagctgcctggagatagagtgtttgaagattgtcttcacgtgtctccctccactaaatgttttctccttccctgattcagcagaggtggcaggacctaattaaaaagagccctgtgtgtggcagaagatgtggcttctccagtcaattgggccactacgtagctagtggaatccattgtttaaagttcacaatgaactcgttctttctggtgctttccatgattgagaattatgtcctctggataatgtctaaaatacttttcaactcagcggtttcattaagaaaaactattaaaactccttctatcactgtattagtctgctctcactgccaaaacaaaataccacagactgtttgactaacacaacagaaattattttcccacagttctggaagctggaagtccaacatgaaaatgtcagcagggttgattctgagggcatctcccttggtctgtagatggccctcttctccctgtcttcacatagtctcctcattgggcatgtctgtgtcctaatatcattttcttataaggacaccagtcctgttagattagagtctatcctaacagtctcattttaatttattcacttcatgaagtgtactgtttccaaatacagtcgcattctgaggtactgggggctgggccttcaacacatgaatttagaggaaacacagttcagtccacaacaattagactctgcaaaccatctaaagagcttgtgtgagcagtctttaagacctctcctccaactccacttcctaaaacaaaactaaaatataggattttcagctccatgaagtagtcaggtatccagatccttctgaccctctgcttggccattccaaccctccatcttccattctgagagtcccaataggctgctggagcttgaggtattctatctgcatgccaggctgcagaagaaaggaagaagtgaaggcaaaggggatattcctcccagctgagtcagctcccttcaaggagccttccagtaagtcccatccaatgctccttccatgccatgccttataggtctgacttagtcacctgaaaatacatgtctgcaagggaagtggggaaatgtagtcatccagttgagcacattcttgcctcaaacaaatcattatttcactaccaagaaatggaggaacaggcagagtgcagtggcttaattattattaattattacacctgtaatcccagcattttggaaggccaaggcaggcagatcacctgagatcaggagttcaaggacagcctggccaacatggtgaaaccccatctctactaaaaatccaaaaattagccaggcatggtggtgtacacctatagtcccagctacttgggaggctgaggcaggagaattgcttgaaccagggaggtggagtttgcaggggaccaagaaggcaccactgcactctagcctggacaacagagcattgttgtccatttcagaaaaaaaaaagaagaaagaaagagagagagagaaagaaagagagggagggagggagggagggagaaaggaaggaaggaaggaaagaaagaaagaaagaaagggaaagagaaagaaagagcaggaataataattaatttttgttatataactagggatctttccacaatctctttgaacaataaagatcagtatataagagttcttatgtaagaagtaaaacaatttctaccttagtgtcaaaattggcaaaactatcattactattataatgatgcactagatttgtgtcatccaatatggtagccactagtcatgtgtaactattgaacatttgaagtaagtatgtctggtgcaaactgtgatgtgttttaaggcatcccagatttttaagacttcatataaaagtaaaataattttatataattattatgtaatgtttttaataccgattgtatatttaaataatatttgcatctactgagttaaataaccctgtattaaaatataaattaagttactctgttttaaaaaaaattttttttaaatactgctactagaaaattttaaattacttatgtggtatgcattatatttctattagacagcattgacctgggatatcaccccaaatgtcagtatttcagtagcagatttccttttacttttttattttaaaacatttaattgaaaaataaagatagtatatatgttcaaggtgtacaatgtgataatttgatgtatgtatacattgtgtaataattaccacaatcaagttaatcaacacaaccatcatcgtctatgctgtaaattagatcccaggaacttgtttgaacatcttataattgaaagtttgtaccctttgattaacatctctccatttctcttaccctctaaccctgacaagtactgttctattctctgctcctgtgagcttgacctcttgagataccacatatttgcctttctatgtctggtttatttaactcagcataatgacctcctgatttattcatgttgccacaaatagcatggttttcctctttcttatatatgtatgtgtgtatatatatattcttatttatgtatgtgtgtttatatatatacacacacatatggagagagagagagagagatgtcacaatttctttattatctgttgagggacactaaggtagtctcatgttttggctattgtagataatgctgcaatgaacatgagagtgcgcatatctctttgagatactgatttcatttctttcagatgtatactcagaagtggaattgctaatatggcagatctaccttttggtttctagggaacctccatgttgttttgcataatgcctgtaccaatttacattactaccaattgtgtacaagccttccctttctctacattctcaccaatacttgtacctttttttttttcttttggatagcagccaccctaacaggtatgagatggtacctattgtggtttcaacttgcattgtggtttggatttgcatttccctaaacgattaacaatatgaatacctgttggccacttcaatgtcctctttggaaaaatctctagtgaaggtctttgctctttttattatattatttgggttttttgtttgtttgttttgttttttgctattgagttatattatgagtttcttgcatattttgtatagtaccctcttatcagatagctagcttgtaaatgttttctcccattctgtaggttgccttttcattctgttgcttcctttgctgtgcagaaatttgttagtttgatgtaatcccacatgtctatttttgcttttgttgcttgtatttttagtgtaatatccaaaatcattgcctagaccaatgtcaaggatatattcatctatattttcttctcagagtgttatggtttcaggtattatatttaagtctgtaatacatttcaagttaatttttgtgagtgttgtaagacaaggacttaatttcattcttttgcaggaggatatccacttttctcaacaccactggttgaagagactattctttcaccactgtgcaataagtttatttctgagttctgagttctttgttctgttgatctctgtgtctgtttgtatgccagcatcatactgttctgagtcctatggctttgtggtataccttgaaattaggaaatgtggtgctttcagctttattttttcctcaggattactttggctatttgaagtctttttcggtttcatacaaatgtaaggatttttttattctacttctatgaagactgccattggaaatttgatagggattatattaaatatacagatgactttgggtagtatgaacattgtaacaatatttattcttattactcgaacatgggatatctttccatttttgatgctattgtaaatgggattgtttattttattttcatatagtttgttgttagtgtatagaaattcaacttatttttgtatgttgattttgtatcttgcaactttaggaatttatttattagttctagcaaatttttggtggagtccttatgattttttaatatataatatcatgtcatctacaaacatagataatttacttctttctgatttggattttttaataattttactttttcttgcttaacttcttaggctaggacttccagtaccctgttgaatagaggcagcagaagtggtttgtcttgtttctgatgttagatgaaaagctgtcaacctttaatgttaagtatgatgttagctataggtttgtcttatatggtcttatatagcctttactatgttgagatacattccttctacacctaaatcgttaagagttttttcatgaagggatgttgacttttgtcaaatattcttttctgcgtctatcaagatgatcgtaagatttttatccttaattcctttaattgatttgcatatgttgagctatgcttgcattgcagcctctccttatttaatttttaattaaaaatatttaattattattatcattattattattattttgagacagaatctcgctttgtcacttagactgaggtacagtggtgtgatctcagctcactgcaacttcctccttccaggttcaagcgattctcctgcctcagcctccctagtagctgggactacaggcgtttgcctccatgtctggctaattttttatatttttagtagagacggggtttcaccatgttggccaggatggtctcaatctcctgacctcgtgatccgcctgcctctgcctcccaagttctgggattccaggggtgagccaccgcatcctgccttaattaattttttaacttaaaagtacttcattgaagataattacacacattccttcctatgttataaatattactgattaaattgagaagttgacttctataacatactcattatttgttgatggtactttcccttcacacacacttgctatttgttctatttttactcaagaacaaaggtactcatattttcagagctaagaatattttttcctgattaaagtgaatttagtctagaaaagcagcatatacttgtatgtgaagtggaaagttgttttgtttgtgggctaaaaaaagtagtttggagacaaaagaaaaccataaatacacacacacacacacacacacacacacacacacacactccacttccttcagccttatgtgttagtaagggttccctagagagaatcaataggagactgtgtgtgtgtgtgtgtgtctgtgtgtgtgtgtgcctgtgtgtgtgggtgggggggtaggggaaatgattcacatggctgttaaggctgagaggactcacaacatgccatttgcaaggtggagacactgggatgtttatagcgtgactaactccaagtttgaaggctggagaaccagggaagccaatagtgtaactctcaggctgaggccaaaggcctgagaacccaagggggtggggtgcaccagtgtaagacctagaggccaaaggctgaggcgcctggagttgttgttcaaggacaggagaggaagagtacatcccagctcctgcagatagatgaacatgttcattttttctgtttttgttctctctaggcccctagcaggttggatggtgcctgccaaacctgaggacagatcttcccctcctagtgcactcagactcacatgtctcctctggaaacaccttcagacacacccacaaataatgctttaccaggtttttaggtattccttaatttagtgaagttgacacctacatttaaccatcacaccttactgttataatgacttgttgcttttgccttatgtgagtagactggacgcatgactaaagattgcagtagaggagacaagcaattctgaaattatgcaaaagtagaaatcatttgaaaagtagtagtcattgggtttcaaacctagatgcttctattcctacctggattacctgctattatttctttcagcaatctacactaatttcctaatagcaattactgatcctgaatatttttgtcatgaaagccttcaaataaattcacatacagaaaactgtttaactgaaactcctagtataaagctatacctctttattttaaatacattggaaatacaaaagattttaagtatggaaataaaaattgccataattccaccacccagaaagagtcactatttagtatattagtcatggtcctatgcctacatatttatatgggtatatttcacctgattcatatgtgtaaatttgtattctatttgttcaatttaatgttataagcaattttcttgcttgccataaacatcgctactagtggtggcaaaatagtttttcatatacatataccataatttacttaaatatttatataatttcagacccagttttttattattataaataatggttctcagtgtgtaaatcttagtccaatttcaaattatttcctgaagacttctagaagtgaaagtagagtgtcaaaaggagtattaatatttttgagcttcttgattcatagttccaaatagctttgtgcaatatttgctaacggatattaaaaagtagatttgggagggcaaaaaaagaagcaaagacaagagaccatctctgaggccaaaggcagcatgtggctctagtagttccctgtttactggtgcctgtgcataggcagctgctgagaggccagaggagaggtcatgcagggcaccatcttctagcctgtccatgcaccatggccattagcagggccttccttccatttctaaaaatgtgtctctcgtggatgtctctcaaatgaaaccctaatgtgcacgatctttatccttgaaggcctcctttggcagaagcagaatgttgcctgtccatagtaatgccacttgtttagtttcacttaaattcctaacatgtattatggacttcttttcagtacttgtcctttccggttttctcttcctccacccaagtcctattcccagcttcactctcttccctgttttctcttcctccacccaagtcctattcccagcttcactccttcttacttgtcctacaaagctcaaatccaaaggcacctcataaagccctgtaacaatgctttgttacatgctctcccagcagaatacgtgtctccctcatggcacttggtcatagctgtgatgacatgttccatgacccttatcctactgccatgtaagctctaggtgggcgggtctgagtctgtctcactccttcactgtatccgtagtcatgagaatcaaggtggcccatatgaactgcttaatagagaactgctaaatagagaactgctaaataagtcaataaaaaaatgaaggagcctgtctttcccaaaaatgaaaaagagccttgatttgattcccgagtcaccctgagtttgtgaataggaaggtagcttgagctcacagggcagtcttttccctacatttgctgacagcgtgccagtcagtgctggtagttctcagacaaatcaaattagaaatggttgtactcatttggaaaatcaagaactggctttgaaatctttccccgcaaattagattggatgaagatcattttctccagcttataaatgcttgattggctttgtttgatgcctcatgactgaagctcagctttgcactgctagctttattttttactcaccagggtgttgtggcgtctagatgatgattaaaaacaaaacaaacacccacaatgaaaaagttttgtaaataacagctcagcacagtaatgtaacccttggaagcgtcacacataagaaacttgaaaaatagccaagctaagcagaacttcaagctgggcctgctgtattctcttcaggtcttaaaaattagtttcctggagtggcgggacagccacacctgacttactatttcctctcaggaataatgaaggacgtgccaggatctcactgtccctacggtagaggagtctcaatgggagcagactgtctgtcttccttccatcttcttcaccaacccatgcatcccctttctctggcttctgccttagtcacctgattggattcagatgcattctcctttcagtcgtagcctatccatagctacctggatgtataacctcaggtcttttttcaacaaagagtagtcccttattcttgttttattcttcccaggtgactcaaggtcagaccagagctttactgttgagctggtaagcagtgtttgaagcagtggtgacagcctggttgagaatccgctagagaccatggatcttgcatggtcctcacacgctttttatttatagctttttttattttcaggttttcatttaaagcagagcagccaacaactttctggagtcttccacaaaatagctaaatggcttgagtcactaatagtaaacagtaataggtgtctttgggtagtgaaaggagtccaaaaggaatgtgcttgaatatccaaaataactgaccaatgtttgactagaggtataatgcccactaatagaaacacctctgagccatttaacagtgatggttcactttagcataacctattgtctatgcagccaacatagggttggcaagtaattcagtaaaagtcttgaaagaggatggactcctagcagaaatataaggcaaagccagcatccaaatggaaaattcaagcagaattgtcttttcttgctaagttctaaagtttttcatgtacatcaatgacctcaagtgaaataaccaaaggattatgtttaatcataaagccaggaaatgagtacaaatgaagccatttgttaagaatgtctctcttctcatttctgataggtacttgttctagcttagtaaattatggtttctatgccacgtgctgagacctggcaaaaatacccagtgaccaatgaacatacgagagtccaggtttaggaatgtttgactaacatggaggcctgagctccctgttcaatacatttcagtctattctttctattatacaatcacattcagaccactgcagtggttccatccttgtgtctatcagcagagcagcatcttctgaagttcttcgtctgtgtaacagataagtgtaaattcattcgattggttctgtagtcacatgacaaagacttaactactactgtgttctctgtgtcaaaagtcttgaggaagtaaaccttctgccatgacactcctgtccatcagtcatgagatgatcatggtaattacactattactgcaatatctccttttggatgagtttctctgcgacagaggaaagcttttaggtggatgggttttattggatttccatcagcatatggcacacttctggtttagtggcagaatggcctgaatacgtcttcaaggaaggcgctgcttagaaacttcattctctctcacggtttgcttctggttttcattgcatagtccctgaactggcacctgtctaagtggctgcatataatttctcccattttatcttctgcaagaaagttgcaaccattgtagttcctcatacagctcagcattaatctagctttctctttgtaaaatattttaggctacagtttctggggagggggagggaaggggaaagcataatcagtcaattggttattatactcttgtaagtgtgttttaaaatatcaggcttcttatttactttttaaatagagattgggtctcatcatgttgccgaggcagatctcaaattcctggattgaagtgatcctcccacctcagccgttctaagtgctgggattacagatgtgagctaccacgcttggccttcttatttctttaacacgtaaaaatatatcatcttttgctcacttactttttattttaatatacttatcatggattgtgattcttggcctctttcctgcatcaagacaggaattattagggaagaggcctaagtttccctctttagagcctgcatcattcaaagaaaaagtcttctaaaatgtaaatacttggttacacttctcatgccaacaacagaatgattcagatgatccccaaatcctctccaaagacaagacagatgttaaagatgtgggtcttcagtctcagatacccaaggttagagaaacaagtgggaatattagggccctccagctcaatagcctcaggttacaaaaaagaaacctaagcctctagaattgacttacctctggccacccagaaaagcatcagatctgggaaaagggagaaacaataagccaggagcaatgctagatacattgcacgtggtctcatgtggtcttaaatcatcccactactattattccccagatcatgaaggaaacaatgaggaccagagaaaggcatgtttttttttccctaaatatttgtaacaagaatctagttctgcctaaatttaacaccctcacttccttcagaattcagagcaagatgatctataccaaattgtaaacctattgtgtaaggcatgggcagttatcaaaaagtagctaattattacaaggcagtataagaaacataatagatttccacaggtagcacacacgactgtaagcccatggagaaggcagccactgtgggatggatgtcaggaaaggtctgggcatgggcaagcccagaaggcttgctgggccctgcagggcaaaagtggggatggagggtgcagaggaatgaagaggtcatgcctggtggaggaaggaaggcacaacgtatgtctagaggacagctttgcttttagtgtgtctcttcactctagtgagggtagtgccgatgacgagggacacaatccaagggaggtgatggtctatcagtagtcagcaaccatctgtgctttcctgtttgaaatccattgtactctcagagaagaatgggaaccacacttgcccctccagcaccttcctcagtcaacactttctatcaattgtactggcaaatttctcatagatctgttttcttttctcactctcccacattgttattggtattaatcagtgttctccagaaaagtagggccaggatctctatatatgtggaatacatatatgaaagagaaatagatttgaaagagagattgagatttataatgaaaaattggctcactggactacagagtctgggaagtctcatgatctgcagacccaggaaagtcagtgctggtctgtatttgaaggcctgagtaccagaagttgtaaatcccagcctgaacgctggagaagacgagatgaaatttcttgatggagccaagaggaaggaaaaaaaaaagtacaaattcctccttcctgtgcattttactctatgccctcaacggagtggatgatacccacccacattggggagggcactgtactttgccaagtccaccaattttaatactaatctcatccggaaacacacagcgccacacccagaaataatgtttaatccgggcacctcatggcacagtcgagctgaccaaggaaagactgtagtgggtctctagagaagtgttgaaaaaacagtattctttacaattgttagagaagataacgggggctactaaatggggttttatagtagcaggaaagattgggctcagctctgaatgcaataaagaaaagtggggatttatagccaaggagtagggtgggggtcagggaatggaaaattacttagaggtagggtacttctttgctaaactagcccaacaggagctttgttgaaggcagacaagtgtgataatatatccaaggaggtcagaccaaggtgggaggttttggtatactgaactctgcagaattcttgctaaaactggaaaaaacgggacatggacagagcccaacatcacacctagtacaagggaggactcagaggagcctggctagagttagatcaaggaaagagtcttttgccagaaaaaacagacattgtctggggatccctaggggcaaatgtctactccatctttggcccagcacttctgaacatcttggctgttcgagaaggggcatgtatgacagtgaaaatatagggcactaagaactaccatcttaggaacaataggagacctacacttggcgggaccagtgacttgtggcagttgctgccctgggtggtctcattatcatctggaacagcagtcacagtcagacagaggagcccacggttcaactggagctttgggggtgtggtaaggaaaagcactcagaccccaaggatttccttccttccttgaagactgacttcctttttggacaatgaaagaccctggagttcttataagatatagggaggaaaaaaaggacccatggcagctcactgacttcctttcaatctcacttatgaggtcaaggccagtggttttaccttgaaggtttgatcaatgcatccttccttgccaggcatactttgtaccaattacagtaaattagagtaagtacataaagtgaatttaattactacagcatgcaaaggatcaggtcacatttatgtgtacaattaactaatccctgtgcttagcacaattttataatgcttgaaaaatcttgaatgaatgttgaaatcttgaatggaattaaacatacagagggacaaatgggctttggggaatgaaacttccttctcgggaataggaggaatgatatttgagaaagagattaaaagatatatagggtagaatataggccactgaccatttgccatgtctcctttgacacaattctaaagtaatgtcttctcacatggcttttctaaatggccggtgggaacttcctcaaatgccgtcttgagacagattctggagacacaaatggcactactgaaaatggtcagtccatgttgatttcaaaagtagcatttttacatgcagttcatttttcttttttctcctccctttggtgaataggggtgacactgatggccctcaacactgtacgtcatttctgtcagcagtaagcacagctgagacaggactgtcagaatagtggcacacagcagctatgtgacaggaaactgagctgccaacactcacgtgagcccagagagctgggtcagattctgtgtagaaggaatttcccatccacccacatattttctctcctacttgcctttggatttgcccttagagaatacagtagaggcatgcgctaaagacaaagaagttttagatagctggagtggcttcacaggggcaagaatgatagagggaagtgtgaagggaatcgggggaagggagagagaagctggcctaaggtgagcgagggagctgtccaaggaccgaaagcatatcccagtgcatttcaaagttttcctgctttctgttgagctaggtgtgcatccccactcacaaccttatcttaatagtgacaatctctgaaggcatttatttaaagcccttgctctggagaaccaatccaggaactccttagattctgagcaaccctgtattgtgctcaagaagttgggcccattaaacaatgaaatgaagggagactgaggaaagagagccaggcctctggtcagatgtgagcaaactgatcaaataaggaaagaatctcaggtcctctactcctccactgtcctgaagccgccttccatggctgtgatccagagaacactcagaagagggcttgggtgaagctaaactgggttttagataactcctggaaaggggatacttttgcaacctcctatgcctttgccttcttcatctttgtgaacattcccactctacacaacctcagactttgaatgcagctgtgttctggcagatttgtttttacaaaaatgatactgacctcaggaaaggaaaagataaataaaagttattactacttcctagcttctctgcagagcatttgtgatttggcttcttccaaaagacagccctaccacaatgagttggccatcattggtgatgtttttattcttgaaagggaatttaccagagatccaaaaatgcaaattaaaacaactgtgagataccaagagcaagttggtggatttttttttaaatggtagcactcagtgcagaggatggaggtatcagagatggtggctaaaagcaaaagcctccaagttagacaaacatgggtttgtctcccatgtttcctgctaactaggcacatggcttttgctaagttatttattctaagtctggcttgtgcaccctttaaatgaagaaaataatacattacggcattgttgtgcagaattcacaagatatgtatgtaagtgcctatcctattgcctagcacggtggggatgatatatactgtgggtgattgcttgacggatatcaaggtccttaccctttgacacattaattaacttgtgaggatctagcctgaagggaagaaaacatctaaacaactacaacaaatgattcatgcaataatatgctcatagcagtgtgactgatggatgaatcattagaaatgtgctactggtagaagtttggggactgctattcattttcaagaatacaagactgtcataaacaaacatggttggcacctacggatgttcttccaggtagaggcttttggaatcaaaccactacgctgctctggaactgagaactgtactgcgtatctaactctgccacctggccacttctgtggaaagttaaattcaggtagccattcaggttagggcattccccttgtgggatccttaccttttttttgctatgcaaagaataatcttcttactcttcttttgggttcgatgcacacttaatattccccatgaccagtcctttcatctactcctcatctatgttattgaaaatacttttactaagttaaatatatggcccatgtcactgcactgtttctaagtttgaatgaaaaccattcaggaagcatcagagggctttcaagctctgcctctcttcacctttccagacttacctcctttatgctacccggaccttcctgtcccacgaactacttagaaatggcagtttccctggaatttcatagggatgctgttttgctaatttcttcaagcctttgctgaaaatgctagtcaagttacccccactccacccctttcctaattccttcctttgttttgttttccttcgcataacctttgcttgtccagttatttctcctgtccggctcccgctggagctagtatctatcccttttttagcacgttccacattgtgagcttggcacatagttgacttgccataggtatttatataatgagtaaatgtaattatttttacgccccttagaaagtgtggatacttccatcccccttccttctgggactctcagatggccctctttgcagatagcattgtgatccttaacaaatgagcggaaaacgatcttgtgagtgtgtctgagcaaagccgacatttttttcttctttaagatcttgccgctgaatgtggaatgatcctgaaattaaggtcagctccaggtggttgtttatatcagctgtcagattgcggaataaaaaatggcttttatatgtttgacttttattgttttccagggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggtactgtctgctgacactctggatcagcttcttgtttatccaagtcgacaaaggttgaggtcctgacaaaaacatacagaatccaaatctcagggatatgggttagcccagtattcacaaatgtactccaagtctgaagaggcagcatttttttttttttttttttttttgaagatggagtcttgctgtccccaggctggagtgcagtggctcgatctcagctcactgcaacctccgactcctgggttcaagtgattctcctgcctcagcttcctgagtagctgggactacagatgcacaccaccacatccagctaattttttttatttttagtagagatggggtttcaccatgttggccaggatggtctgcatctcttgaccttgtgatctgcccgccttgggctctcacagtgctgggattacaggcctgagccactgtgcctggccagcatttttttttcttagtaggaagcaaaacaaaaagtgaatttataattagctatgtcaactttggttaagtgcttaaatttcttagtctcttagcagtctcattggaaagatgggaataagaattcttacctgggagtatttagcataatctagaccatttatagaactctctgctaggttctctataaacatggcatgtttcatatggaatcttcaccatgcttacggaaggaagttactattttacacttaataaatgaggaaatcagaagtcatggcaatcacttcaaaattccacgttcctaagtgatggagctgggaatttatcctgaatttgcctgacttccaagtctatattctcctcttaaaccacattaccatggaagtttgtataacccctaaattctatttcaagtaaaaatcagtaaatttaaaaccatttaaaaaatatatatgtatacatatatattttaaatgtattgagtaaatgctagtacatatgacaccagggaatgggaaaacttttaaatggtcctcaaatggccaaaatttgggaaacactgattcattgccatgtactacagatcttactgcctagcaatacacagcaggtcggtgaacaaattgtatttctggataccctggctcctccagctgctgtttcttcaacatgaaacagtggaagtctctctctcattctctgttatgttaccaatctctgatgtccttcaagcagcggtgtatttactaagttgacaaatactcattgaggtcaaatctcacatgccaaggattgggcagggattggtctgcagcatgctgatcgatgaagaagttctttcagaagtctccctgaataaacaatctgaataaaaacctccctctgcttttcaccgcaggtcaacatccatcatggattatactacaatttaatttagatgcctttttctcaactggactgcatggttcttttatccaagtagattagcaaaaattaagttaaattgtaaaggatatgacttaatagttgtcgacctaaaaggaagaagccaaggcaatattaatataagtagatagtttatttgggccaagcttgagtattgcaacctgggaatatagattcaggttgccctgaatgtatattctgctctgattagctgcagttagaagcagacttttaaagaaaaaaaaaaaaaaaaagaggcagtttctatgttgtttatcagaaatttacattaaaatcataccagctaaagattgcctgtgcattgttctttgtatcgcagattccaggagcaagaagataatgggtgaggcaggtagtcaggaaaaaaaaatgactttaaacaattgcctggagcatgggtgccttgagctcaggggaagggtgtgtgactgaagtttcatactcatgcctctctgggcccaatatactttgcatcactcacatagttcagactgctctgagctgtttttcttttctcatagttatggtcatgtcagaccgtgggagacattcaaatgtccatagtgaacaaaatggcccactgaacccctgagcatagcagaaaggcctgagtctggaagtcaggcagtcaagtttaaaagtattaatatgttttctccttcctttcctgtggccctggataaactttgtctcatatgcaaactgaattgtattagttatctatagttgcatatcaagtgacagcaatatttaatggttgaaaacattttttattatgtctcagtttctgtggatcagaaatccagggacaacttggctgggtgactggctcagagtctcccataaggtcacaattgaattgccaatggggactgaagccatggcaaggttcaatggaggaagatctgcttccgcactcactcatgtgctcaggaaggccttagaaaatccacttccacatgtagggaagtttacatttttaccctcaagttatttgagaataacttgagtctataaaagaaatgaattacagacaaattaacaggaaaaaatgcacacacattttattacatgcacacaggagtcacaacgacatacaaaatgtaaaagcccaaagaaatggcagatggttgatgcttttatatcaccttgagattatagaaagaactggcgtttagagcatggccaaaatcacgttatgggccaggcacggtggctcacacctgtaatcctaccactttgagaggccaaggagggcagatctcatgagcccagaagttcaaaatcagcctgagtaacatggcaaaaccccatctttacaaaaaactgaaaattagccgggcatgtgggtgcatgcctgtagtaccagctactcgtcaggctcaggtaggaggatcagctgagcccagggaggccgaggctgcagtgaggcataatcacgccgctgcactccagcttgggtggcaaaatgagatcccatctcaaaaaaacaaaacaacaacaacaacaaaacaggtatggtagtaaatcaggttatgatggcaagacaggtaattgaggggagagaaaaggaggttctgtttaccaaggtggtcttaaaatgtaggtgaagccatacaggtatcagcccttagagagaataaatgacaaatgtttttttcagacttttaaatgtttggactctcagtcctcgatccatacaagggagagccttacagaaagccttgttgtagcaatgcaggttttctctacagatgcaagtcccccacaaaagacagctttgcagggctacttcttttggaacagccctctcaaaatatgtcaaagaagtacattttgaggtgaaatattttagtttctttcacaagcttcctcatgagcctctccagaaggctgccaagggtgagtgagaaaaagcacccaaatagaagccgcagtctttttataatctaatattgaaaatggcatctcgtcacttctgtcatattctattccttagaagcaggtaaatatgcccagcttgtgtccaaatggaggggatgacatcaggacttggatattagcaggcacagattatccaggatcatcttagatattgcctatcacaagagataaaaaaaaaattatgttggtgctggcaattaaatgaggtagtatatctcaaatactgaacaaagtgttgagtagctatttaacacatttttcttccttccgtgctgactcaagagatacagctagaaggggcctctttctagagagtcataaaagttaagaatgaatttgtgcagtcagacgatttttataaaatttattagatttccagtaatggaggtgagttaatcacttagaattgtaatattttttcatgttccaaattataaaaattaagcctcaatcctccttatttgaaaaagaaaaacgtgagctggcattgagctgtttctctatcggtgagatgtttttgagtacagagacttgtaggcctcaggtcaaaaatgaagttttaatacaaggaaggccctggcagcacattgctcttaaaaatccaggtgctgtctgtattgttaagcgcacgtcagtccattaaaatgcatttatgactgaaagagagcctggtaagagctgccaccttacccagctgcagaaagggaacaaatcatcagttatttcagacccacctctcagaaactgaaataagcaaaaagaagtttttaaaatgtgcaaccagagttccaaaaactcttgtataattctctcctaaggagaatttctatgtttttggaaaatttgaacttaatgttttttagaaaaggatcaaggttttgtgtattcttcgattttcccatctgggaggaggaagaactaacaaataatcaaacaaaaacagttttctctttccttacatttctgaggaaacttgttttcaaagtacttgagcttatattggctttaaaagaagatgaaaatctcatatgaacaatgaaaaaataatgacaattgttccaataatttttgagagtcaacggggctatacttgatgcttggtatgtcccaaatgggtcagagaatgcagataatcaaaggtttatttgagactagttctaacatcctggatctaaaagagaaggtaattcctttggaaagggcagtacaatgatgcctcacaccttcaaccctgttccccgagctttgtacagtgtgcttggctttttaggaaggaagtagttcttatttagggatttttgcattgaagatcaaggagagacttgcaaagtaaatgcatcctcaaaatagaaggcatctgaatttagttattctagggatgaagtttcaggaagatgaaggacaacagtggaatctctttcttgtatttttctttgttttctatttttgtcatctcctttttttttgcaagccttatgtatgtatgtatgaggaaaggtagaagacctcatttcactgtaagggatgtgaaagtagaaccagcagccattgtagatcttctgccagttaggcattgtgctaggggcttgtcatacaaaactgtaaaaaaactcataaaactttatcaggcggttagtataccaacatacatagaaagaaactgagaatatgaatttaagttaaagtagccaaagtgatgttcaacctcagctttttccttagaattctcaagttcatggtctttacacagtatcctgctgctctccatattcattgtgcatactgtccattgcttaaataactcaaatgtaaagaacctctgcttttacatctatagataatctacagaagactcttaaggaaagtggctatttaggtctaaagctgtgtctttcaaaaacagtttcatggtggtcttatacaagaataagacttggataagaccttgggattcacactagattggaagtctgttgtctttataaacttctgtgtactttagctaaaattaactgtataatattattaagtaaataatacaggaggctgaggcgggtggattgcttgaggtcaggagttcaagaccagcctcaccaacatggtgaaacccatctgtactaaaaatacaaaagttagttgagtgtggtggcgcatgcctgtaatcccagctacttgctactcgggaggctgaggcaggagaatcacttgaacccaggaggcagagactgcagtgagccaagatcctgccactgcactccagcctaggtgacagagtgagactccatctaagaaacaaacaaaaaagtaaattatatatctatatatctatatctatatctatatatctatatatctatatctatatctatatatctatatatctatatatatatctatatatctatctatatatatatctccatatgtcaacacacacacacacacacacacacacacacacacacacacaaatattcattggccactgcactccagcctaggtgacagagcaagactccatcaaaaaaacaaacaaaaaagtaaattttatgtatgtgtatatatatatatatatatatatatatatatatatatatatacatatatctccatatatcaacacacacacaccaacattcattgagaaaataggtcatactttcttcagactctttttttggtgctcagtactgattccttaaaaggattatcatctaaggatgaaggctgccaagtgacatgaggtctacttcagtaagggcctgtctacttctaagaacattgccctgctttctgcaggctttcccattctaattttccccgtgccccatgaaacaagattagatctctcagaattcaaactgaaagatctgatccatgtggaaagccatgagtttcactagagcagagaacaccttctaggagtcttgctggactgtgaaccttatctgaaaatccatttaggcaattctccaatgaatgagcaactaccttgataacctaatttatatattttaagctcccagttctttcttacttttcataaggtaccaagtgccatggggacctctcacatggtcatgtggtcatgaggctctctcaaactccataccctttcattgagcaatagatatcatgttctatttttaatgatggatgtggttgccgttttaaaggcttttatggagatgcttagaatggagtttagtatttttcaaaacaacctgaattactaagaaaacaggacatttcataaaggtaaaggagaccacctggtttgttttcttaggaggaatagggcagactgttttgaatgtcatatgaaatcataagcaatcttaagagataaccggcaccactctaattatctgaaagggatctgacatttcaatgttatttttatttttccgatgggaaaatacaaggcaaggagaatcaaaagaaacaggcatggagttttagcttaagtttttgtttgtttgtttgtttttgttttttgtagtgcttctcaaaatgtcagccagtctggccaaagagcttgaactcaggcttcagtggttgtgcgtcagcctacctgtgctctaatcagatgtaggacatgagtaagtcttgttccgttagcctcactgtcctcatttgctgaaggagaggatcagtctagaatcatggatgctccctccagcactattcatgatttcttgagagaaaacaataggccaacccaccccttattatcttcaaagaaatcatcaacccaaggctcttcttttgaaactggcataaatggtcctgaatgattgggagtacccagggccaagccccttgccagaggtcatgctacccaactcccaaaactctggtgcactttgtggagtcagaaaagtaaacttagcctatttgataccatgaattttgtggatgagttgcttgcatggtcttaaaaaggttatgctatgactcttcacaacctgtagagaattaggagacaaatatctaaacctgaatagggttttttttttttttgcaaccttccttaaatgtgtatatgtgtgtgtgtgcgcacatctatgttggtaggagggttaacaaaatatattaggtcttcaacctatgttagtagaggaacaatattggttgtaggtactgaagctatttcctgcagagagaaatccaggcagagacacagcaagggtctttggctgtgggaccggctttcttatagctaacggttggtatatgtgaacatctctttagaaggcaaagcaagcagcagtgaggcaggcagagagcccactttggattccattaaagcatcttctccccagagcttcctagatgcacagtgtactgccctgatgtcaccagaggcatcaaactcagcctgggattttcagtattaaagagtaagtctacattttaaatacatggttttggcacaataaaatgaaatccagaagggtgggtggggggagaatccaaactaagagatctgaccctggcgctggcaccacttgctcattattagctgaaaaggcaaaaggtgaagctaatcacctgggacagacaaaatctctggacaaaaggtgacatggacagcaaagagccagaaaccaagaaaataccatgaaaaagtgtctatagtcaaggcaaatggcttatcggaggtgccatctcagcgcatcccatttaattcctaggagcaagcaatagtgtttatcatatttcctcaaccaccgtataacatttcactctttcgataattccttgaacagtattagttagagataaggtattccaaaacaaacaaacaaacaaaaatgtaaaaaacatttaagccatcctttttatcagttaattttctatagccagtagacttctgtgactggcttgttctttctctagcttgaaatatggtgagattctcagatcaacagccataatgaatgttttttctgatgattattgagcattgactacatttacattaaataaaatatgtcatcctgtagctatggtcaacatgacacccttagctttcagaatttaatctcaattgatattttctcaagaaacctttccaaggcaggccaggtgccttgtttctttggttttcttctttttaacgtttgttactaagtatgtatatgtatgtattcatctgctcaggctgctataagaaaatatcacagtctaagtgtcttaaacaacagacatattttctcagttttggaggctacaaatccaggatccagatgttggcaggattgatttcttctgagggcttctctctttgcttgcagatggttgtctttttctgtcttcacatggtcttttctctgtgcatgtctgtgttcaaatagcttctgctcataaggacaccaaacatatggaaacttattttaccataattacctttttaaagatcctgtctccaaatacaattgtgtttttaggtattaggtgttgggactttaacatacgcattttgcagggacacgattcagctcatgcaatgtatattaatatgtctatttcattgttgaccaatgcccttctcatcactagaatgtaagcaaccatggaaacaagtacattatttgcccaagccttggtccaacaccttgcttaccacacgtcttccataactatttgccacacgcatgaatacactagtggagttgacctctaaaacatttctgaaagatagaattttaacagggaaagaagagttagtagtgatttttaacaaacagtcctgttacaacaattatatgccgcataatgtgtcaaacccaggaatgagttatactcaggggggagtactaattaggtaaagggcaggggagctcccagaggtagggagatggcctggagagctgcatcgtgcaggatggaagtgctcactctgtggaatgctggcagccaggtggttataggctacggccctgcagttaacagagctgatccccaaatattgccctttctcatagaagccatttgtagctagccaccatctgcacatcaagtaaacatgacgaggccgcaagcttcatcctctgcttcaattaagttgtcattaatgcctcggtatttgagctaagataatgttaatgagaaaatcccattagcaagggcaaaaaagtggatagccacagggctgtgactgtcacaacaagctgtctggtttgagtttcagaagatagtaacatgatatcacaacaagcacagagttcgagtttcagaagatagtaacatgatgaagcatttcgtgttatggaaaactgagaaatgcaattgcctgaactttaagataccaagcaaaggttggaaatgtttaccaaagtagtgatttcttgggcgtcttcagctttttaagtttggataatgacaatggagacattgtatttcttaactcactgttattttctctgtctctcactcaaaagaggaattgcaggagatagaatttttttttatcatagattaatcttcttgtcaaacctgctatcacttccctttttcttttgtattttttactttgacaattttctcatgtaacttgaagttcctctcattggctttaggaaacttttggagtatctactctgcactgggtactgtggttgaacctgggaaggaggcactgccttccaggagctcataggcatggttggaagagacagtaaagaggcattaatgaataatagaacatgtgcctgggacactggggaagcactgggaagaggcagctggataggtgagaaagggaagactttctagaggtggggatatcacagcttggttcttaagaatgaatagaatttggccaaatatggagggaaggaaaggatgctctaataagagaagagaaatagaacgagaaccagaggtgtaagactatggaagcttagctgcctggggcccagatggcaaaagatgaagcagagttttggtcagggaccccagagtttgtgctgtatcttggagagaatagggaaataactctcttgagtttagcttaatggttagcgtgtggatgtttgatctcagcattcaagtctaccaaggaaaccacactttcaccatcaaccacaaatgcatcgtgagttcctaacagaccctagcggatggcaaagccagatgttttccctttatgcactgatcaaggcttttcaggatccaggttaccttgaaatatgagccaggcattaaacgactaggaaaggtttaacctgtgatttatggctaatgctcacatgagggcctgcttctgacacttggcagtggagattcagttggtctgatgctcaatccatcaatgaaccttggagagcgcagaatgctgccctgctgatactggggcagagcggggggtgtcccaaaacgtgactcaaactctgacccccaggtacctgttatcccactgggaagaggagactaacatggacggattgttaattaataccacaaggcagtaaatattatgagctaaacaaatagatcagacagtggatgctataggaatttagaaagagaaatcaccctgcactattctagtcaaggaaaacctgcttcattcgtttcctgatttattaacttactaatttattcaatcaatcaatcattcatcacgttttatatgccctgcactgtgctagctggctgtgatagaaagtaataaaacatatgttctctgtctgtacagtttaggaaagaatttgctgacacgaaaacttggccttggaagattgggggatggattttgatagcaggaaatggtaagggtagcgtataggtggagcagaggctgggtatggaagccccaattcactaagtatatttacttggagcataatgaacacatggtccagctggagcagggaattcttgtaaggattttggaaaatagcctgaaaagacagagggagacttgattagagaaagagtagattgtccaactaagcagtgtgattttcattctctgggctccatgacccagtggaggggtatttgctgtgaggtccatgataaccttgctctttaggtagttggatctagcaaggtgtcctctatcagaaagagacaggaggctgggaaaagagggggaccactaaagaaatttccagcttcagggataaggaatagaacaaaaataagagagggaatttgaaggcatatgtgaactcaatctaccataagtagggaaaagttaatcgaatttgatagctgatggataaacagtgtgccaggaaaacataactcaggctctaaattgtagcataatggtactagtaatcgtaatatactcttctactatgtaactgacattttcagacttccttattcaattattcatatattgcctactttattctcacaaaagttgactgtgagacagtcaacaaaagttgacagctaccttcgaattgttaaataagagcatgtatgagaggacatagaaaggccattgaattgagttttctggggaagataaagcctagaaactttcaagtcaagccaatctattttgtttccattttacagatgatgtaataggtttagagatattaagaaatctgtctaaatttccggaaatttttaagtgtcacgcacttgagcaaggaataacaggtgaataaagccatcaaggaaatctgtaacaagttatctccagggttggaaacagtctttagggactatgatctggtttgggctgtctttttgctcttgtgtgtggctgtcatggcctagggtagtcacagctgacacttaagggccctgaacagccacttggttacaaaggttcattgacaccttgcaacattgattatgatcttgctttttattttgtcttcaaaacataaaaaaagatgtcaaaatatggtgacaattgaagtgcaaagatctgttagaaattttatggaggaattggtggggttagagagaaagagagaaagaggtacaattgagagccagagtacaagagtgtgtcaaggctctgcaacctcaaaattatttctttaactcaatggttctgagccaagggaagatttccattcccaccaaactcaccttttagcccacccatcctccacatggtgaaaaaatgtgctgttggtgatggggatttgtagtgttggtgatagggttgtgctgttggtaatggaaggttgtggcattgatgatggaaggttgtggtattggtgatggagtgctgtggtgttggtgatggagcattgtggtattggtgatggagtgttgtggtgttggtggtggagggttgtggtgttggtggtggagggttgtggtattagtgatgggagattgtaatgttggtgatgaggtgtggtggtggtgatgagggttgtggtgttggtgatggagggttgtgatggtgatggagggttgtggtgttgatgatggagggttatagtgttggtgatggagggttatggtgttggtaaagaggggttgtgttgttggtgacggagggttgtggtgttggtgatgggagcttgtggtgttggtaatggaaggttgtgttgttgctcatgggaggttgtggtgttggtaatggagagttgtggttttgatgatcgttctttgtggtgttggtgatggagggttgtagtgttggtgatggagggttgtggtgttggtgatggaagattgtggtgttggtgatggagggttgtagtgttggtgaagaggggttgtggtgttgatgatggagggttgtagtgttggtgatggagggttgtggtgtttgtgatggagggttgtggtggtgatgggggttgtggtgttggtgatggagggttttggtgttggtgatgggggcttgtggtgttagtgatggaaggttgtgttgttgcttatggggggttgtggtgttggtaatggagtattgtggttttgatgattgttcctaatggtgttgatgatggagggttgtagtgttggtgatggagggttgtggtattggtgaagaggggttgtggtgttggtgatggagggtgatgatgtttataatggaaggttgtgttgtgatgatggagggttgtgatggtgatgggggattgttattaccatctagtgagcaggcgtgctgctacacatctgacacaggaggtataccacaagacacctactcctaacaaataataagccagtccagaatacccagggccagtgttgaggaaccccactttaagcccaaaccctactcttgtaaaacaaatttaggaccttagaatatctcttaactgttctgagtctcagtttcatcaagtgtgagctataaagggctgtggagatctcattatcaaaagcattttaaaagacatattatatgctctgtaactattttttgttttatctagaaagatatatcaaagtaataacaattgactagaattctaatttctgacataagtagacatcctgagaaacaaaagttgaattttcatttaattattttcagaagctaggtgattcacaaaataacagaactaaagtttgaagttggtattgttaaaagcgaagtcatttggtgggaatgtaaagtagtgtagccactttggaaaaattctggaagttcctcaaagggttaaatatggaattgccctatgactgagcaattccaattctatatgcacacctaagagtattgaaaacatgttcatacagaaatgtgtacacaaatgttcatagcagcattattcttaatggtgccccaagtggaaacaattcacatatccatcaaccataaaaacatacttaattgaccaggtgtggtagctcatgcctgtaatcctatcgctttgggaggctgaggtgggtggatcacttgaggtcaggagttcaagaccagcctggccaacgttatgaaaccccatctctactaaaaatacaaaaaaattaccctggcgtggtggcgggtgcctgtgatcccagctactcaggaggctgagccaggagaatcgcttgaacccaggaggcggaggttgcagtgagccaagatcatgccactgtactttagcctgggccgcaaagtgtactttagcctgggccgcaaaaaaaaaaaaaaaaaaaaaaaagtactgattcatgctacgtggatgaatcttaaaaacattatgctaaggaaaaaatgccagtcagaaaatagagcataatgtatgattttatttatataaagtgcccagaataggcaaatccatagaggcacaaaggtaggttagcggtggttggccagggctggaggtgcagggataaggggattgggagacagtatatcaaggttacagagtatatttaggggatgatgacatgttttaaaaattgattgtagtgattgtataactctgaatctattaaaaaccattgggtttcacactttagatgacatatatggtatgtgaattttatctcaataaatctgttaccaaaaaataataaaaataaaagcaaagtagaattcagtagcagaacataaaacttttcagagctttttggtcatcaaagagatggcaggagcagggcagggctggctggagttgccagcatgatgagcaaaaggagctcagctccagtacccacacttccctttgaacgctggctctgcctctgagcagccatggggccctgtgcagcctctccacttttctctgttacatctattacatgagggcaatcaacttgacctccaggactattgtaagaattaggaattacattatttaaagtgcctggcacattataggcatttgttactggtagtgtgatatattattagctatttttacaactggggtatttcaaaggttcatttgcaagttcagttggaaggatgaaaactgtcattctttttttctctatggagaaaattttccaagtctttatttgattcctaggaaagcgcagggcagcctatttaactctctctctgtaaggaaccctttatactgatgccctaggctgaattccagcacctgagagaagccatgagaacaaaagtgaaaaggacaaaaaagttttctgtcttttatttcagcttaaacagtttatcaggtttttttaagattataaaaaatgtacattaaaaaacactgaaaattccagtataatataaaagaatctgtgattctgtcattctacattattgcagtgttttttgtggtgttagtttttaacaagatgggaatcatgcagcacgtcctatttatttagagcttttctcttatcaagatatcagtagcattcttggacattatgatgtttaatgactacattatataccatattaggaataaaccatatttgctttagctagcctgctactatgggaaatatgggtagcagtgaatttttgctattgtaaataatggtgtcaagaactaccttcaccataaatcttggctacagctctgttactattttagaaataattcttcagaataaaattcacaggaaatgaggtatgacattcttgggatttttgatacttactggtgtattgccttccagaaagaatgtgcaaatttaggctgccacgaacaacatataaaattgactgtttccctctattctcattgagattgagcataatcagtttttatcctttattagtctgggagatggcaaataatacccaacatgtctttaaagttcagaaattgtatgtttgtcctcatctgtttctggaacccaaatcccatcttttaggcctcagcccctatatcatgggggtgcttagtgccccatattggccctcaatatcctgctcgtctctcctaagataatttttttcccccatcaagacattctcggcctaaaaggtgttgctttcctgttctcctcattggacacgtctattctttcaaagccatttatctcaaggaagtttgggaaaaaagcaatctcataaggtgatttctccctaacttgtgaataattaatagcacttccacttttacctttaagagagtatttttaataacaatacctcagagagtctctagggatgttattttggatctgttaacagaatgaagtgaaaacgaggaccaggtgaaagtggagatttttagctggggatgtaccacttcacttgccttgaaacccatgcctgggcagctctcctgggcgggtcccaatttcccagcttctttcctttctcttctgacacctccaatgacatggctcctgaccctggctgcaaacagaatccaagggacctttgaaccttccaagtcctgggataatccccagaaatctgacttaattaacctggagtgagccccaggttctgtattttcaaaagctccccaggcaatacctgcattgagaactattgttctaataattttcctccacagagctaaacttttcacccaggctcccactgcaggcattggggaacatgtaggaaaagaccaaattaaagaaagggcagaccaaaaaataaaaagaaaaaaagaaaaccaccaaccaagcaaaccctcattatgtgaaaacttgaaagagagacatagatggcgatgtggggagaggacaggacccacaatcacaacagatgatcctacagactcccattgagcagacctctcccctcaggccagtgccatctgtaacatgaatacatgatagatacctaattcgaggggacactcactgtggcctctataaatacattcttctctactgtatcactgatgcctagcagggtgcttggcctttagggagtatttagaacttttattctgaactagttactaactcccttccagtctagagtttacctgcaaatgcagtcccatatgttatgcagatgtattcaaatgagtatgcaagtgaaagtttttaaaaaggacttacaattgactgtgctccccaaatacccctgaaagaagtcaaatgttcaccaagacacacctgacagattctctgtctcattagcagaatccctgtggccaggacacaaaccctggtcttgtctgaggacaactgcctttgggaggaagtggggccaccaggctgagaagcctctgggttctcttcttcaccccaagcagatgttcaggattgcagtgatctggcttgagagatctggctgaaaacacatcaggtgtcctacatctgggatgctctgagcagatgggtcacagctgcccaggtgcaaatacagctgggctccaagcctggtgcttgtttctcccagggcagcctctccagccaactgggagctcaggggtaccggctcttcacttgccactctgacggtctggcacacctctgtggtgatcctcagtgttttcttcccagctggctgctttggggctgctctggtaggctctaccaaggcaggtctattttacctgcagaaatagctctgaatccatcacttactttgcattttcactgctgctacttttggtgagatcctctcattccgcctcctggggactctgcaagcagtaggacctgtgagttctgcctctagccttgaccccttccagctgctatcattggctcttgtgctggctgattctttgaataaacacctcccaccctgatattaccatcctagagagccctcatggagtcccatgttctaaagctgtaattttcatctctggctgcacattagaaccacccaaggagcttttgaaaaaatgcggatgcctggggcccatgcccagagatgctgatggaattggtttgggaaaagtgctcttcagaataatttgtcaaaggatattgtttaaagtcctcctggtatgtgagacctctgggtgattggatcctctttctagctgccttcatattgtcatctcctgcttctcagtccagacctttgtttctttatacaggctctctgtctcctggaacccttgctccaagaattacaaactcttgctcactttccacgactccccttaactgtcatccacttcaatgaaacattcttgggatcctcacatggagttagttaggctttctttcttctctgctcacatattgctgttccacccagaattgcaagaggtggtgttgtttgcttacttctctgtctaccccactagcctgaactcaaaagacgttattttaatcctccttgcatatgtctctgccttttaacaatggactaccctagggtagagatcatgtgatgttaatatccataccctctaatgacaaagaccatctcgtatttgcagctctgttcattttttaagctaatatgactgcccacatatgattgaaatgaactattctgcatacactgctggactaactggcgtaattctcacaatggcctgttaagtacaaacattgtcctctttgcaagcgaggaaactgacacaatgagaggaaagacaactcaacatgtaacagggcacaataaatgactatttacaatttagaattgtgtggctgtgtgctcttgccacagaaagtctttgtgaccaatcagttaatatgactttattttctcagcaagcactttacaccaccaggacacagtcttaatagatgataaactctttaaaggaaatagttgaaacctcatgactagttcccaaaacagttttttcagtaaggtaggtcagcagcacagggtacagcaaagacagctggagcaatggaataggagagaaaagaaccttacaaaagcacccacctttctcccagtgcctttagagagtgtcgtgcctcatttcatttgatccctttaacaataataaggaataggaatcataatatttacagatgataaaatcagagcttaatgaaagtgagtaactttgacaatgtctcctaattagtatgaaaaacgctgcaattggattatatgttacctctctccaacaggaggctgcctctgcctggcacatcattggaatctagctttcctcatctactttaaaaatagcttactttttcctaaaattgtaggaaagtatgagaaaaccaaaattgctcttaactctaccactcagttaaaattgctggtaatattttgagttcgtttatttttgttttttttttttcctctgcgtttatacaacaatagatcagaatacgtgacataactttggttgtggtgtgtacaacattttgtatttttcccttttgttttaaaacaaaacatatcagaagtagttcagccgtcttttttaaaaaagagattagaatgaagtggcaagaagaggaagaacaatgctttttatgaatcttccaagggcttgtatccagccgagtgaggagtgggtttgctctgagaatggcatggacggcagcaggctgggaaatgagccccctctctctaagtcttctggacccatcatctctatgcttactctcttgtttctcttgcaggcagcaacttgaatgatggcctgtggcactcggttagcatcaacgccaggaggaaccgcatcacgctcactctggatgatgaagcagcacccccggctccagacagcacttgggtgcagatttattctggaaatagctactattttggaggtaaattctccagtctttaagagggaaaattaagaagggagggaaatttaagtgggcaattatttcactatgatggttctggtttggtcaattagacaattctcccaacacacaaacacacacacacatgcacatacacacacaccctcaatctcaaaatagtgagaagcaaaatctctcacagctgtgtgcaaatataaattatctaggtcagtgctgaggaagaaaagaactttagctacaagagctggtgttatataacacatccaaaggagatttttgtagccatgccaagccctgtaatcacatgggaaaggagaaactcagctgaaaacttggagaaagtgtatcaagagtcagcagtacctgcaagaggcaaaattcaggtggaaaggcacaatcagcatgcttagcacccaggcccttcctctgccactttcctctcttagtctcctgtcccctccttccccacatccctagaggccatgctcgcagaaatccaggaatgaggaggaattaggaggcccatgaatttgtaactccaggtgtagaagccagttcagattattcacattctgccttctctgatgttaagtgagtcctgggaacctttccaatgacaaaaacacaagggcaagctgatggtgaagaaaaacataattaggcatctactgattttttataaatgcatatctatatatatgtatttagtctttcaaaagtatttttcattaaaaattaatatctaatttcatagttgtttgtattatagaaacagtctctgaaaaggatttaacctcaatagctgtctgaccttgagaaagatacttatagtccctaaacttcctaatctgaaacacggggaaataagctcacctccagaatttctggaaaagttaagtacgaccaaggtgtaagcatatggcagagtgtgccacatggcaggggatggggaaactggctccagctcctatagatataagtcagggtctggtctacagtttccttatttttttcctattagtaaattgaagagaagtattgtataaaattatgcatagtctcttaaatagaatttacagatcacttctctcataccaatggaatgtggttaaagctttaaaatgcaaaagggattttgcacatgtgcagtgtacatatcgaggtctcctaggagggaagcaatatctctgtggcttgattttagggtgaggaagggcctgtgacctttacctcaaatgtcctccacctgtgcatggataacaaattcctttagggagggaatacacgtccagtctctgcaaaagtttttatgacttaacctcatttaattcatgcagaaaccttgtgcagtaggtaatatccccacttaatagataataagactggtgtttgctgagatgaaagaatttgtgcaaggccatagagctcatgaattcaattccagatctgtgttcccacagcccaccagtgaaaacagagattggaacaaatgtattataatgatcgtagaacaagggtgttggggtccgaaaagataacctcacagaccgaataattttgcatcttatgcaatatttcagcatcagaggaaaaaacgctatcttgcatttattcttgagggaaatgtttgtaaataattctgatacaataagcatccaacatgcctcagagacaaaatggctctcctccctcagttgaagaagcgttcttagaggcaagttttaagggaccctgggtttagaaggtgaagatgtatcagtgatttgaacagtgtttaaacaaatgccccacgcgtagactgtaaacttaaggaaggtgaaaaatgagtttcagtaataatagtcaacttacataaattctctctacagcttcaattagaagttgtagcatctctcttcattttacagtgtgcctgtgagctgttaaccagctgctgggcttcagcccagcagtgactgtctattagagacggctgaaataattcccagttatttatgggttattaccatggtttcaagcttgcattcccatatgctctgaacctattaaagccattgggatggagttcgtatggagcacaagcactcatatacctgcaaggctctatacctgtcttaatgagaagtagatatgccctggttgcaagctacactaaatcagtgtaattttttaagaacactctttaaaaaggtatagtattaacctttcccatatgctattacagccctaaaatgacatgcatttaaacccttagttccttctaaaaccagcaaaacatctgattttgctttgcacatcacgtcaaaattccagttacgctcctgtgtgtacctttctcaggaactaagcctgttaatgctaacaattaaccagacaattactctgctgccatccttacccagagcgtaattttctttgaaagtgtaattcagaattgaatcgtgcatttagatatgtgtttcaagacagaaccaaaattctgaagcagctataatacatttcttccttgggatgagtgaaggatgccatataaaagaatagcaaatagtttaccaatggaaaaacaaagtaagaaggagacacatgttacagtattggtattccctttgccacgctttttattttctctacagtgatggagtataccctattttgtaccaattctgtcccctccctgagaatgctaggatttataatgaaaagggtgtgcactgctgtgaatgagaaagcaccaaactaattagacctcaaggtcttccatcaataggtcgccaaagcaatgacggatcatttcagcattcttcttcatcttttttctctgtcccacagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtaattattgtctcttctcctctgttctgccacccccttcccattcttactgttctaaatatgagtttctttaagcaaaattctaatccaccgacattagccacattagacataattgagttgcctaatggaaaatatttctgaaaggatttcaggcccagagaaaaaatggtttaaattagttgagtctctcttcatgttgacttgcagtaaatgggatatgcaaattaaatcaaaatacaaatttgtgaaaggattaaaattttatgcataaacaacatttgattactttgaagttaaagcaaaaaggaggaaggaattacttctctcctaaaccatttcatttttcactgctgtgggtgtcctttctaacacaggcagatgagcattggaccatctgggaagtctgcagcagaggttcccgaaatgcccaataacacacaactactcctgggtttggctggtttttgctcttactgcccctaccactgcttctctggcccagagatcagaaaaactcactttatctctcaatttcccctgggatctggctcttcttatattagaagtttctaaatgcaaagacacactgcagaaaaccaaagaggatggattctgaatttgcatcaaggtttaccatgttcttcttctttcctctccagagcctacctccttcattcttccagttctgctcacccttgtcaaaatatcgtttatagaatgggtgaataatatctgttcagtgcttgcctatgtgttgatgataaagggtctctgcttatgtttcatctgggaataaattagcaataaagttacaataaagttagataaatgaccaagaaatgcacccttatttgtcagacacatggcagcagcaacttagtctgaccctgagaatgagtcgaagaaggtttcagaaggtgatgctgagttgaatcttaaagcagaagacactggcaggctaggccaatgttgagaggggaagggagattggcatagaagcaggagaaagcatggattgcaagtatttcatcaattcaaaatacttttttggcatttgaaggcatttgaaatctctaatagttgaattggcaatatctatttttcatagtggcatataaaataattgtatatcttacaattaatggtgtcttagattcaataatatatagctcagtagggatggtaggccactgtggattgtgaacctggtgtgaataagtccagagatgtggggcaggaccagtcatgaaggactttgtgtaccagtgggatttggtttcatgctcttggtgagaaccacagaggaaggtggctagcttttcctgttagaaagagtactcaagaagaagtgagaaaggtggattggaagagagctggcccacaactaggcaggtgactgccccagttcaggagaggaataatgagtagtagcaggtgcctctactgaggggcacagaaatcagccatgcagtgcatagtctctgctaacgctagaatgagctgcgtaacttggtgaaaatttacacacatttctccattaatatcactatgcatgggatcatcaacaaatcatgcagattttctggctcttctgctttgttttttttttttttctatttgaccagctgaaaaagtagtaataaaatatgtgcttcattaaaatgtgctagtttagagctcggagaataaaagttattgcaggcgatggttggcaactattggctagaccaatagtctttagtaatggcgagggagaagcatcctacttcatcagccagtgcagcctcttccaaagtgttgatcaatacagggaacatttatcaacaggggtctcttatgctaccttaatttttaatcaagcaagctctcattatttttgattgcatgaaagtcattgccatgtactctgcatcattagttttgtgtaattgtagtcttgtataattgtattacatacaattgtgctttcattaattgtataataagggattgtgtttagtttcgtgagtaagtggtaagtttttcttgatttaccaggcactgtgtctaacagaagggaaagctggggcaagggactgtgtttgagtcactatttcttaaactcataattaatgttatctgaagagaggcaggagttagaagggcaggtgttttctgaatttggtgtttcatttttaatgtgttaatcaacgtgagctggatttcaggttaattgcaaactctttgccttcaaggagcttgctacttgctgggagaaaggaagggaataggctggcagtggttttccttacctggactgctgtctggaaagcccacagaggacaatctgagaatctcttcttactctgagaccccttgccagtccgttgttgcaggctgtagagaaccaggcctccatttgcctctttgtggttgtcctaccccttctttttctctctcaaagtgaagtgggatcccgccctgccagcttttgttttttgctggccccaaccgggcatcttacatacttaaacggtattagtgctagtcacgtgggaaaatcagatataagacatctaaagtagaattctggccgggcacggttgctcacgtctgcaattccagtactttaggaggccaaggaaggcagattaactgaagccagaagttcgagatcagcctggccaatatggtaatatcctgtctttactaaaaataaaaactagccaggtgtggtgacacatgtctgtaatctcagctacttgggaggctgagacagaagaatcccttgaacccaggagatggaggttgcaatgagccgagatggcacctctacactccagcctgggcgacagagcaagactccgtctaaaaataaataaatacataaataaataataaagtaataaagtagcattcctacctgaggcacaaatgttccaaaatctcaagagctccctccggtggaggtcctttaagcaacttccttttgaggtggtgcctaagaccctgacacctgcttcccagtttgcactatttacaaaccacctttgatacttcatcctgagcaaaagctaaaagggtctcttctcagggattaagaaactttaaccaatgtgcatctcagggatgggcaaattaccaaatcttctggctcctgggaggaaaggacttggaagaactggccttgcgcacggctctggaagcaggaaggtgttggtactgggcagctccagtgcctggcagtccatgggcaggatgggagaaggaagcagtaggaattagaataaggcattcctgacacacactgtgccctgttcacggtccttctaaacctctaggacacagtgtgcagctgctgcccctcttctgcaggccaaaccaccagcctcataatctctacaccctaagcccctgtccttcataataaccatctttccagcctctttgacttgaagtaggcaaaacacaatagtctaagccagcggtccccaacctttttggcattcagggactgggggcttggggagatggtttcaggatgattcaagcacacatttattgtgcacttgatttctattattattacattgtaatatataataattatgtgactcaccataatgcaaagtcagtgggagccgtgagcttgttttcctgcaactagatggtctcatctgagggtgatcgaagacagtgacagatcatcaggcattagattctcataaggagtgtgcaacctggatccctcacatgcacagttcacaatagggtttatatgcctgtgagaatctaatgctgaagttgatctgataagaggaggagcttaggcagtaatgtgagtgacgaggagtgtctgtaagtacagacgaagctttgcttgctcacctgacactcacctcctgctgttggtcccagttcctaagaagccacggaccagcactggttctggtttgtggcccagggtttgaggacccctggtctaagctatcacaaagaaaagtcactttcaataaggctttattcagtgaacagctgttgatacaccctctgtagttctgactcataggtaggcactgagagagtgagactgacttacatctatccctgagtaggatatgatgctgtaaaagctctagaagctctaggagtccagaggcactaatatccccaccttctaaaaggggaaagctaagacctggagacgtatgtcagtgttctcaaggtcccatagggctgaagttatgatcaagagtcaagcactgtgtgtattctctccttggtactatctagcaaggaggcactgatctggaaaaggcagtcactctgtgtcagtggctctaaatgtgtaaccccattttccaattgtcgacctaaaaggaaaaagctgatgcaaaattaatataagtagagagttcatttgggccgagcttgcttgaggcaatccaggagcacagattcaagttgccctgaacagacactcagtttagcagccattgcaactgggtttctaaaggcaaatgggaggacaaggagtgaactgatataaagttctgccaggaattctcaatggtttacagtttacagatttgattagtgattggctatgtattgttaagctgtagggtgtgggttctagtgtgtccagtgtagcattattaggttaataacaagcagttccaagaggtgagtacacagctcaaagtgggggagtagagtatgactggggtgtcattttaatgttttattggcctgataagtaaaaggacttgcattcctcacataaaagtttttttcttttctcatgctcaaccagattgaatttttaagaatatgcaatatgtcagattctttgtaacatttatgtgcctgatgtaattccatctatgaggggacattcagagtggcatgcaatgtctagcagggtctgagtggagtaaggtgagccaggttcaaagagtctctgccccgcatccatgtagatgattcccagtcaattccaggagccatgtccagtcctgtgaggttcaagatccaggacaggagagacagattagcaaatgctgtccaagagtatcaacaggagacaggctccaaggtgtgaagccaaaccaggagggaaaaacagggatgctgatgaggaaggtgtctgaggtggggagaagcagaggccatacctgggaaaaatccagaatcccagtgcaagtggcagcagctttcagaagcagcaggacacatttaaatccaccccgcccacagtctgagatgtgacacacattatttaaacttttgtccatgttttcccttttgcaaaatcaggatcacaaaacctacctttgtgctaagagttgaatgagagagtgcgagaaaaatgagagtgtgcgagaagtcaggtgttcaattgcatgactggaatgcggtagatgctcagtaaatgttcactgtgttaattcctctggccaaaggtttgccggttctctagtttccatggggagagaagaggcttaagtgccccgccaccctttccccaacccccactgttgcaagtgatccttagtagtttctggggtgattcccatgtgaatatttcacatttgtcccccctcccaaatcagtctgctttgtgaccccccttggactttggtcccactttttcagaagacctgccatggcccattaggaaagcactcataaatttaggtgccaaggttatggtcttcagattttcctaaagcattagtctcaagatcaggactagaatgagcctagagagtaaaatttaaggagacccctacttctagggccatgcatgcatggagatcctgcatttgcagaaacctgagagtgagggtctctttaaatcttataggcaaattggagcattttaacatcagaatcaccagaagtgcttgttaaaacacaaattactgggggtggagcctggaaatttgcatttctaagaaattcgtgtgtgatgctgctgctactgggctggcctggtggccgtactctgagaacaatgctgtaaagcttctgctcctggaggacgtggaattgtgtggaatctgcaaagctgatgtgggtgtggaggagagggatggttcctgcccccacctagggcctcaagcagctactcttctggccagagtctctctgaaaagtttttgcagctccctcaaagtcccaaagtccctttctccaaagaggtgttgaaatcagcccaaggggtgctgcaggaggccactgagtttcttctgcctctgagctttcctgatcttcctctctcagctcctcccctgcttcccactacaaacaaagccttcatgaataacaaggaaaatgatcagatcctctggcacgcctcagtgaggagtatttcggctggaggaaagtgtggttctagaacagctacagctgctgacaagcataactgtttgttgtgaggtacccctgaacgtcacagcttgatctttccttctaaaatacttcacagcctgcgggtggtggtggtgcctatataataggagtgactccacctctccccagtattgcttaaaaaactttataaagattgatggacacttttgcagcaacatgaatggtacttaagtgaaacaagtgagatacaaggagataaatattgaatgttttcacttataagtgggagctagataacatggacatacagacttagagagtgtggaatgataggccatggaaaagtgagggagttggactggggtggataatgagaaattacttaatgggtttgttttggataggggtcctgatccaaacctccagagagagttcttggatctcgcgcaataaaaaatttggagtgactccatggagtaaagtgaaagcaagtttattaagaaagtaaaggaatagaaaaatggctactccacaggcagagcagtgacatgggctgctttactgagtatgctcatagttatttcttgattatatgctaaacaagaggtagattattcatgagtttttcaggaaagggacagacaattccaagaactgagggttcttgccctttttagaccatataaggtaacttccagatgttgccatggcatttataaactgccatgtaaactctatcaccactgtattttctcccacacacattcatttaagaaattcgggtgtggtggctcacgcctgtagtcccagcattttgggaggccaaggcaggtggatcacgaggtcaggacatggagaccatcttggtcaacatggcgaaaccccgtctctactgaaatacaaaaaaaacaaaaaatgtaatgaacaatgaggatgagcagagatcactttcatcttgacttggtgggttttggtcggcttctttactggatcctgttttatcagcagggtctttatgacttgtatcttgtgacaccagtcctgttgacttcctatctcatcctgtgactaagaatgcctaatctcttgggaatgcagttcaatatgtctcagccttattttacctagcccctattcaagacagtcactctggttcaaaagcctctgacaggttcagtgtacgttgttctggtgatggatatcctaaaagacttaacttgaccactaagcaatctatgcatatagcaaaattacaattgaacctcacaatctatacatataaaaaaatgattagacagacactgatttcatatggccttctggtgaccaccgggcccattccttcatcatttcctcatacagtgatgctaccggggaagatccgaggagatcccccagctctggttgtgcacaggaggaaatggaggccacacagagggaggcaaagtcagatatggaagcagggtgctgttcctgcggtctttgcctttgcatcctatggagacttttcgctgtaatcctttctacaattaaaccatttactttttccaaagaggagatcccatgtggagcaccacattacatttcttgtggcaaacaagttatgaaatgtagcttctccctccatcaccactgtattttctcccacacacattcatttaagaaagccaggtgtggtggctcacgcctgtaatcccagcactttgggaggccaagaagggcggatcacaaggtcaggacatcgagaccatcctggccaacatggtgaaaccccgtctctactgaaatacaaaaaaaaaaaaaaaaaaaaattagctgggtgtggttctgcaggcctgtaatcccagctactctggaggctgaggcatgagaatcgcttgaacccaggaagcagaggttgcagtgagccgagatcgcgccactgcactccagagtgcagacagagcaagactccttctcaaaaacaaaaaaaataagaaagaaaagaaaaaagaaaaagaaagtgtctactgaactctctggtcaaaattcttaccttgttggttcagggtttggagtacagtaaacactgaaagttggcaagcattatgttggattacctcccataaacagactcttgctaaaaacccaccctgtgtgtgggagcttgttaaaaacagtgggtaatataaaaagattacattgcgcggtaatacatatgttttagttcttctctaaaattgaaagcctttacattgggcgccagaaaagccattggaagggcagtgcccacacaatctgagcttctaactctgaagtgagaaatgttacaatatgctgttctcccttaactcatgggatggggccaaaatcaaaacaagatcatttctgctttactatttatcatttgtggtctatttcacagaggggaaaaaaagttatattttatgtaacacttactgagcaaacattcctaaatgttatttcgttttattctctccatagtctgcaaggcctaccaagtgggttctcaaagtatggcccccaggactgcagcatcggtgtcacctggcaacttgttagaaatgcaagtctcagacagcaacccaattctactagatcagaaatgtgggttgggggccggggcatctgtgttttaatcatcctccaggtgactaggatgcacactcaaatttgagaaccaccacgttgttcggtgatcgccgttttctacataagacaaccaattcttagagaggttcagtgactgccaaggtcatatcttagtatttggaaaagccgggattcgaattcaggtttttctgattcctcagtatatataaataaggaaagcctgttaccaaaaggccagagaaagaggagacatgggcttgggtagccagagcgggccagggagggggctacagaggaagcagcacttcctgaggaacttgaagagcaggttggatttacgggggtcaaggaggggtgctccaagggctctcatgtggagagtgtaaagctggggttgggaagggctgcagtgctgaatgtttgcccatattggaagggctgtcttggcagcagtggatgcaagagaactgaaatcagaaccggagtaaacttgccagtgcacaaaacagtttaaaacttgagagaccagacacattaatagtgaatctttaaataatggttactgtgggccagggcagtgtgacaatgtgtggtgtgtgtgtgtgtgtgagagagagagagagaaagagagagagagacagagagactaatcttcaccacaatgttgtgaggttaatattattaactccattttacacacaataaattggaggcacagaggtactaagtaatttgcccaaggtcacacagcctatatgtggtagagcctggctgcaactcatggagtctattgggagagattaggcctgtcctggcactgtggtacttctaaccctgctgtgggaaggtgccccacattcttcggcaggattgtgaagtggaaaatgatgcatttttgtcttgcattaaaatcacaaaggtggttgtattaaagcaggaagagaagggctgtggaacacctcggtgcctcacgggttatcatccctatcctcgcagctcactgtcactatctcctaaagaacacactgagatagacgcagaacgagctcagggctcccatgagacactgggcttgatctaattctttgagctgactggggaatagaagaaactgggaacttgccaggaatgactgtcttgagaagacaggcttcaagctgactttgtaaaggtgttccatctggaactgcccagaaaaaggactgattcatttctctacttctttaatgagggtttccttcccccatctatctcacacctgcttgaatctcagaaaagaagaaggttttggagaaagggggaacctggatttgattagaaataagcgaccttgaacaagtgcatctgtgtcctcttacaaacctcatctctatcatcacttgtttttacaagaaaagtggatcattatcttgatgaaatggtccttctccacctgtgcatatggacgggcacaaaagagcctttattcatggaaaacacggagggctgagcaagccaggttggcacttcattttggcccaccagacggtggtgagaatccttccccaccaactggtaatctgacatattgatgctgaaaacgaagccagaaccatgagccaggtgaattatcacaagcacttccaaagacgaggagttcatttcaagtgctgtatttttgcgattgaggtacgacatgcatgtcaacgtatcaggaagaaaatgtctacaaagtccccagggctctggatcatatctgtcctgagatatactggcttagaaattcagatgttttaggccaggcgcagtggctcatgcctgtaatcccagcactttgggaaacccagtttggtggagaccaggagtttgagaccagcctgtccaacacagcaaaactccatctctactaaaatacaaaaattatccaggcatggtggcgcacgcctataatcccagctgatggggaggctgaggcatgagaatcgtttgaacccaggatgtagaggatgcagtgagcaaagatcatgccactgcactccagcctgggtgacacagtgtgtgagactctgtcagaaagaaagagagagagaaagagagactctgtcagaaaagaaagaaagaaggaaagaaagaaagaaagagagaaagaaagaaaagaaagaaagaaagaaggaaggaaagaaagaaaggaaggaagaaagaaaggaagaaaggaaaaatgaaagaataagaaagaaaggaaaaagaaggaaggaaagaaagaaaggaaggaagaaaggaagaaagaaagaaagaaatttagatgttttagatggcagagtagcagaggagactttttatctagatagaaatgtgagaaaaaggtttagattctcaagccacttatgtgaagcagagaacattcataaattaatgaaaagaataaagagattccttggtattgattcctttacatgatcgatatctcaataagccttcatccaacatcccgataagagccttccatctgtttctcatgttctctaaagagcactgccttctgcacagccaatgtcacattaattttttcctcatttacattgatgtccactcatggggcccttgaggcgaagcacctgaagcctttgaatgctgtttttccctggtccaaaagcattcatcgatggcccattataagcaccatttatagacacagttggaagagagaaggagtataatatgttttcagttgggaaaaaggcaggtctgacctgcagtaaaaggttctcacctgtgtctgcagtgaaatgtaaatttaaaattagctctatgctacttacattttgaattaagatatttcataggaagttcatagaattccaattaggccttgtgggtttgattgtgacatggatttctgaaggctgaactgatacttctgcatctgtatcataggcatgggcagcgtcatagatgccatccactttaacacttaaaatgcccaaaggaagcatcagtctccctggttgtcaactgagaaaatcgatattcacataaatttattaacttgcctcaaattggaatcagactcagaattttaaggtgggaaagcctgtgctgttcatattttagcccaatcttggacacaatgaatatgtcacttctttgtatcttagctcccctagttgtcaaatgtagataacatgttataactgcaaggtgttaaacaaaagcaaggcgatattattcccgcctgcctcttggaattttggcaaggattgactgagatcggaaagaaaagttcttaaagttaaaagcgagagagacagaaatggatggggttctgtgtatatcagcaggccaggttttagaaaacccatacataggcagaaaacgatgacatttctctgaataatttacctacatatataacctattttattttttagacaagtgattaatgttttcacttgattcaagttacaaatatgaaatcttccctctaggtttagcttcatcttaaaaatatctcttggacatgatttactaagcccactgcagggctcttctctcctaatcctgggagtactgtagacatagcagtagatatctcaacacctgagaaatgcaaagggaacacacagagctaaaacagagagttaattgggagaatgcagattaagttggattttatgtcttgccaaattttagtctctaaactcgtgtgaggtctagtacatccagaacaccgttaactttattatgacaaaatgttagaatcaccttgctacctgcttttacctatgctgaaaagtataactgtgactgtaataattaggtagggggctatccctgctttggatatggaaatcttctcagatgtggttcccaagtaactctaggtttataggtttgatcaaatcattgtattgagaattgtaaaaccctatactctgaaatgagaatcatttgtatcaacattagcatttgtgtatgtacatagctgtgtatgtgttcacatgcaatatgatattagcctgtgaattctgatgcacacttctaggtcctactaactgagagactgcctgtgctctgctaatattcctctgtgacctagtcattcatttatgaacatttccttgcatgcttactctgtaccaggcacatttctttgcctgaacatccaaaagtgagcaagacagagagtttttgatcttagagtcatgtcattgattttccctgctctgatcttccttggatcaggaatctgcttttttttagtattatgaatcattcattcattcattcattcattctttcatctcttgtgtttggaacctttctgctgtgccaggtgctgggtagaagctgaggatatacttgagtgccgaccacagtagacaatctctaacttcagaaagctccatggaaggacacacatttgaaccaaataatcatggaaataaacatatatgctcccaaataccatgagtgtcctcatgcacataaatagagcaccaggagagaacctgagaggaaggccactttatactgcagagggggcagtgtgccaggaaaggggatgtggacattgttatcttcaggctctacaaaagcatccgtacagaggtcgctgcaaacttttctcagtcagtttcttagagctttgtcctctccatggctttctaagaacctctggctgatgactgtgatctccatgttctgtgtgtgtcctctgctgaaatccctgtttggtgtggagacttagaggataagaagtacaaaattccgatttttttttttttttttggtgagaagaaattttttcactggtgttttagctgaaaacaaattccccacattttcccaaaacatgtatgtgctgggaattcctgtctgccattaataccactttcttactctcctcccaccacctcccatcccttccctggctgccatggttaaagggtcaggcttctagtaattcaattctaatagtatataggctacacccctacacttagaaaaatatgagaaaaagtcagcctactcaaaataaacaccagtgtaaaggtgggactgatatttcagctagcaatttggtaaatcccaagaatctgaaagtgacaaaaggaatatgcattttaaaggtcattccaattaccatgcttactcatgttgagctgaaactctggagtttatgtgagaagacccacgcactagggggataaatgagaacatgtggttgggagaaactcgaacaaataataaggaagggaatacaaatcactgttgttttctgtgatattaaataattcttcaacctcagaggcatctgagaagtagaggaaagccaactatcgataaatagctgggcaaatcctcacaactctaagagcccaggattccatgatggatttacttctgatctacattttgcacacttatatgaggatccagaagaagaggtctcaagggtgaactcttgtctgcattaaaatgtctatttgcaaccactgcattctccatgtcatagtggattcccaactcaatttttctcaatagaattatcctaaatgtagatatacctttcctgcttttgaaataggaaaacaaaatagccaagaattattcctttagacagggtttgcctcatatatctctcccacctccccaaatgcatacgttattgcaactgtagctattctaaccatcagattctgtatgtgcatttcacatgacctccagcacatgatggagcctgaggcattaaacacacgaatccaagtcctcctgcttgacttttgcagtcttctggcctcacctgttcctccctatctatttttacctcctactatatgatgaataattcatcattccatctgtgtgcatttactgagcatctagtatgttccaggacatatatacatagtttctgccttaaagaagctcaagagcaagagagctagataagaaacctgaaagcagacatcttacaaagggaagttaatggcactgagggccatgaagttatgtcccagctgcattttaacaggagagaagtaaggaaaatgggagtgtgatgggattccagaagtgcaccactgcctgccacaaagcagccagctgccttccagcctccaggcacttgctgctatttctcttgtctggagctcccttcccagtttcttttgcccaaatccagcccatctgtcaaagtctagttcaaatcctacctactctacgaagtcttcttgactgctcacactcttctttgcttatttgggtgtctctggcactttcttcttatattttgtttagctcccaaccatagtcatgactggttttctatttgtatcttgcccatccaaagttcatcacgtctactgatgcattcagctgagacacgtgccctgtgattatttacttaatgatttgaaccttttgagctttaacagcatctgctctcagtagctgggggataaactgcatatgaagctaacaaaactcaacacgactcttggttttgggcaagtattgcctcaagatatggaatgaacttgataatctttaatgtcattgtatacccaaaactctggaggttgctatccgagatttaggagttaaagcctttcacttcttttctcatcttgaaaacttcccaatgtggttcacgccaaatactgctctatttgaatagcaagagtgcctaataaaagcaacgccagagccagctgtcatcattcacgtggtgttaagtgctccttctgtaagcactagctagcaagagtatttttgtttagcaaggccatcacaaaattagacaagcaaaccatagcaatgtatttgagcaatgtagtctataaataacacagtggaaggaagcataggagcacattatccatattacaatcttgtgccttaaaaaaaaaaataggttagctctgtaatagaaggcagctccagagaaatagacaaaatgtctttggtgattgttaaaggatgtaagcagcctcctggtaataagatctgctgagtgtaccctgtggattctgtgcgcccctaagcaactcctacaggctgagtagtgaacgcttgtaaagttggcgttgtttacctagcaggaatggaacaaaaaattttcgtggaaggatgctgatgtgtctgtaaccatgtcggctgtttatctgaaagtgaagttattgaagaagaaaggtttcacattagcccagaaagcagcattcgaatcagatacggtccatacactgccactgttttttagatttatttatttttttctttctttttcagaagtgcctggcagaaacttaaacaacattgttattcatttggctttgtcaaactctgtagcatcgtcaaatgtagagagttgcttccaacttttgccaaatgccatctaaagcctcttcatttaataaaaaggaatatagaagatatatattttttctcctttgatgttttaccgtacttgtttctacagtggattctaactagaatcacctaggtttactaaaatgcaacaattggaccagatgctagctagtttttttttcctgctaattttcttgttcaaatccatagagaactataataaaatatcttaaaatgaactatgctcattttaccaagaaggacactgaggttcacaggtatgaaattactttcccaagattacagagttggcaagtatcttccacccccaaaaaacttagaagttaaaaaaaagtgccctttgaaagttaaactaaccatctaacaggtcttaagggatcatcttggagatacaagagagtatccatgcaaggctagttagtgcttggactaaggctaatgtttctaaagaaaaaaaatgtgtcaaataaaagtaggttggtaagaagatgagttataaataaggaaaatcaaatagataaagctaattttagctaaagaactaaattaagacttcctaacatcagatatgtaaagaaagaagcccattctgtgttgcaacatcaatggggaataatagaaataacaattgtacactcccatagttcttaatcctcttctcagactgagttggaatatccccccttataactgataaagcttacaggaatgtaatataattattgcttcagtgaatcaaatattacttgtctagaccagcactgtgcaatggaacactgtgtggtgatagaaatgatcttctctatgctgtcttaacatcttgttactattggtaatagagaactcaaaatgtgtgatacatttagatttaagtaccacatgtggctagtgactaccatattggatagggcagggttagacactctgctagggccagtacttgtggattttacatttttcttatccataagttcagcagcggactgcaccagaggttaagtataaagattgggtttgggccttcaaattcagatctggtgtggtagatttaatgtcagccttagcagcccaggctggatatggtcatggtcactatctgtcatggagccccttctcccaaagacaattacatcaggagacaagggcttatcactatttgacttaatttctcccaacatccttgcaaagaagtgatttaacgattactagatcaaaatgtcaaaaactttatattacttaagaagacaagtttactatatcaagtgttcttttgctatttctgttacccagttcaaagttcctttctaaattagaattcatgttaaaaaaacacacattgtaatctaaacataatccatttagtaaggtttggtttctaatttttttctaaaataagagagtcttcacttttaaaatctccaatagcatactatatgttgaagttattgacagaactcccaaaaccacctgctcaaatctgagtaattcagagtaagaggtactctgcttggtcaacaaaacatgtgagttcgttttctagggtgggtttagattaatgcctatcgcaaagtagaggcatgaaacccccaagttctgtgactattcttgtcctgatttcaagcttaattcacagccctcaaacatttggaaaacctaagaagctaacctaaaggaagaaaagatattgatcagtctggtggaaatattggtccctttgaaaatcataacatttaacatatatttattaattgggattctagtatcacatactagtctcttgtcagtttgcttgcatgagtcattatcgtggtgactgtggtcctgggaatctgtcaagagtgaatttcaggccttatcatgtggaaaacccagttggctttgatttcatctgagtctccgtactagcacaaatggcgtcacataaagacctataccagactacagatgttaacccaggacactcttcaaagctaaggatgggttacaaataattttaaaattcagcctcaagccaagtacagtagcacagccctccagtcctaattactgggcaggctgaggtggcaggatggcttcagctcaggagttcaagattaggctgggatacatagtaagatttcatctctaaaatataaataaataaaacattgaaagttagacctcagccctaccaactgatagcttcaaactttggaattcataaaaatccattaaaagctcttttaatgcagttgtttggaccctacaatcccagagattctgattaagtccatctggaatagaggttggaatctgcattttatccaacaccccagttggataaaagactgaccctgtggatcagtcctttagaagtactgtgtcagaagattaaataaagacatttctttattgaattcatcataatacaggctcatctaaattttttcctgcacagtggggagctatacttccagttctgcctaatgttaatggtagtctgtggaaaatgttttctttgttcaaattagcttgagaaatgctggagtaagaaaagtgtgtttctttactgcaggatttctcaatgtgtgtgtgtgtgtgtgtgcaagtgtgcatcctcatgcttataaactgtgcaaggggggaagtcactgaaagctatgcacaagtttacaaacgtatatgactatgaagcccttgtttccacaaaactactcattcacataaggagcttttggaaatgcggccctagagtgaataaatcacagtaaacaccaggaaccccttgggctgctcattgtgggcagtggggcagcaactctgggaggtagttggtagtgtagacaatgtggcttcaaaagctaccattaaagagaactcaggagtcataagcagacattagccttcactttctgcttttctctacaaaacaaacacccttaaaggtaacttcttctgcctctttttccttctagtatggaggacttgtgcttttgatttgtacaaacaaattttcagcctgcatttttagtgtctgtgattttaactgaccacttgacttgtgagcctccctttcctagagatagtgatacttgtcttacaagattgttttattgattcattgaagtaattattgtgataagctagcaccaagtccagcacgctgagtccagagtttgacacctggtagagaagttaactttattttatatgtgtaaatatttagggagaattaagcaagaaaagggagggagcagaatctctctgtctttcccctgtcaaacccactacctcccccacccccgaccaaaaccctagagatagcaaatagactgcaagttttataccagcctcaatgctagcaatggtggcatcagacagtatgcagattccctggcaggctttgggctcaatagagaaacggtgcattgaatgacagatgagtgaggtgacatcagccacaggagtagcaggagagagtaagccccgcaaggaaaaattaaaaacaaaatgaggagtgacctgagccatctaagaactgactatctgtatggcatttaattctaacttaataaaaatacagttgatgggcagttaaagactgaattttgtggtgtggattgttcattttgggaattctttcccgggatagaacttaaattgagcttagaataacaaagaggattttcatgcaaaagcgagagccagtaaaggcaggggacatgtgtattcctgtgtgaggccctttagaacccatctatgatttgatcaaggggctcctgttgtgtcagtatctggggtggctgctcgtattcatctcccatggtgtggtcctccaagagttctgtattcttgcgtaagtgcttgccttggccagggtggctggtccagccaggccaaagagagccccttgcaggggttctcatatttaagattaaagagtaaggttcttttctcatagcagaagccttaggctgcaggattcagcaattggccgccacaattcctgccacgggaggaagtggggatgagggagggtgagtgaaatcaactcacagagaaaagagatggccagggaggagccagcaacctggttgtattcaagccctgaggttcagcatttcctgaagctatgctgtgtctcttcctgctgtttagagacattcagctcttacttgcatcttcgagcccatgtctctttcatttcctaaaatggcttaaactgtgttttcaccatttccatctgaggttttcattagtataagtctttttagaccacatcttttacaatcttaagttagatgatgaagaatctaaacaagttgaaagagggggaaaaaacattaattgtggaaggaaggatttagtgttttcctctttgtttgtgttctccataatctccatgtgtaagggtcgtgacattttagctcaaattggatgcagaatctatttctagaacaggcacgatgtcaggggccaattaagttgttggccagctgtagtttgaatcattaacaacaacctgtggccaccagcagttttatggcgaggctgtgctataccactgagcgtggcttaggatctctctgccttaactgctcaagccccagatgcagatcagaactgaagtggagaggcagctgcccagttcactccatgaaaccaggtttgctgttcacaaggacaggacactgatgaaatttaaatgaacaaagatgaagtgtaacctttgttttcagctcctgtggttggcaacagagaatggaaatcccagatctgcataggcaggctgagtagtatactgagcttagcaatgtgcaaaccaaatctctctctccacgaactggaaaaaaaaacaaaacagttaaaaaaaggaaagagtgcaggaaagaaaaaaacacagtctatgactgtgtcacaaaaccatctgcaagtataagtgacaaaaataacaagagttcacagttacttacattttacaagaccttatttagcgcccacaaggattaagatattgtgctttgtcttgattttagaaacagggacactaaatctctgaaagggatcaataattgcaaatgtcacagagctagaaactggaggaactggaattaaaacttgggtctctaatctgacgcctgggctatatgactgaatcttgtcacctctgaaggaggtcacactatgcctcagctggggcacaaggggatggtctcagaccagcctttactccatcacaacagcctccatgctcagacatggtagcctctgggcacagtccctaatcctctgcttctcaaacaccagctcaattttaatttcattgcatgacctttaaagcaaaaattaaagaatcttgcaacatgtcaaaatcgatgagcatcctgggtaatccaggcactgctggtatctgttcacttcatccatgggttctagagaccacggcagccactatagcagtaagcgccaagcttggacagtggtagtctccattggaaaatgaaacctagaggagccgggataataagatccagagggagattagtggacccaattataacctgtgtcctttttggcttgcactatatgagtagttttcatttttactttaatgtggtgaaatctttttattccatcaaataaaattttagttctatccataacaaataaatacaatatttgaagattaaattagataattctagacctggtctatgaaaataattctttgatccagggggaggagtgtcaaaatttgcagtcatacattagcctcagtattcattttgtttggctgttctggtttggttgctaaatattaagaaaatcttgattcacacaaataagctgcccactgatagaagttctagataccctgttttgcaatagtagatgtttttcaataagactgatctagaagcgttcaaaagtaggtataattgctttttttcttcaaatttgagaatcgtttgcatttcttaaaaaagtaaaagccagataaatatatagtcagtgctaacacttgctatgatacgttattattttaatgtcatgttcatccattcacttgttcttgcttcattattatgcagtggaaagagcttgtagcatgcaggtgttcctgagcatggctgggtttaaggggatggggctgtggagcagcggtgccctctctgtatccacgctacctgcgtgggcctgagcagacctgataatacatgacagtgcagtgtaacatcattcccaattaaagttcacaggaatcccaggggaggtggggaaagatttccattaaagtccccagagttagcctggagctaaagactaacattgctagtgcagtgtgttaaaacctgattcatgacacatttgaaaacgataccattttaacataaaacttacaaaataattagaaatacttcacaagagagcccaaaacaaggaaaggaaagggaaaaaataaaaccccacaatttgcaacccctctgaaccatctctacagaatgactctctactgaagtgcagaactttgctattcagtgaggtctgggagccagcagttttctcattcccataagcttattataaatgcggaacctctgtatcagggtcttcattttaaccaaagtttgagaagcactgagtcaagtaatagaattatttctattcatagtggaatctgagtgatgtcctaaaattaagaagacccttacagtaatccagagagctctactgtctgtgcgtttcctgatagctccaatattccaaccgaggtatcataatcatgatgctgaacaaaagcctgtgagtgcagggaacacaaaacctgcttcctagtagatgtgaggtggactaacccaaccagatttctctcccattaaatctacagcccctctgtcaattgcgtggtggacttccattctgatggatcacttctaggtcactgagataaatgggttgattaaagaaatttaattatattctattttgtgaaaatgacccctaccaagctaatagggggttctcttcctttgtgaattttttgatatatattattttatagtttggtggtaggggacttgtttctaaagttcccaggtagcaatgtcttgctactattttcataggctcaggtggtttgtcatactaacaatattagtatgcatgatgctgatacattcttcttgattctgaatgtcctctgctttgaagaactggcctttgaagaactgagcacttcagggtcatacatttttcagtgtgcggtagagtagagagaggacctttcccttttctgttcagtggccttcactggcccgtgcagggagaggcatgtgtgccctttgtgcccggcttcttcttgaaccccagcattgttgctgggatcactgacgtgcattgcaaactcattcgatcatctttgcttgtccattatctggggatcatcgcaacaatctgcgattgactccctgctgtgaactagaccctggaaaatttaggaaactgacttttgacacttttctttttattcccttaatttcttaatgtctgcatctgctgtaattacaacaaatttaaattataatggagatccaactgtgggggtaaaatgggattatgataattgttagaatggaaagacatagaaataggtttcaaaagctttcagaaaagctatctgaccaaaacgagatcaatgcggttggctgctaattaaagcaaacagacaaaggaacgcaacctagctgatttttaatgtatgcgcttcataacacagcttacattagtcagcttgcattttgaggactattgaaatgttttgttcttttgtctccaaggaaagcatatagaaattgaaactgaccttcaattttataaagaaggaatgagaattctttaaaagggaggttactccatggagcataaatacattcagattcatgtatagagaatcatttatctgaacatttgggaatttcaaaggcctgtcatttggtgtcctattcatttcagtctgttatgggaaatggagaagagggaaatttaacagggaagaaaaattatttccgtaggtttttatttaagtacactgagtatattttttaatgctcttatcttttaagcgatgattttctcaagatgtgttcaggttgaagatttttttaagaggggtaggcatgtgtctaaacagttcatatgtctaaataactgcaataaaaaatgggcacttgggcacacacagttaactactgtgcttattttcttagacaaaggaccattttcttttaatttttacaagagacttagaatgtacatgaatcaatagggggcaataatgaatggtgatcatgaggagtgtgttatcagatgagcttaatccaaaggagcaaaggccctccccatttaatttgatttctagagtttgatgagggaagtagagggcagtcggctagacttgggtttaaatgttcactctgccctcactggaaatctggaactcgctgagtctcaggagcttcacatgaaaaggtgaccccactacacccctcgtgagtactatgacagctgcatccaggcagtgacaccaggacaggcctggcatctcatggggcccttgaacatattggcaatgatacatgtccagtgcccacctttccaggtggattgcccacgctcagatatctgaacatcttcttttgtccagctggtctcattcctgggcttataatgtgccttaggacagcttgactctctttttagagaccatttcctccatcagctgcatgaatgtccctttaccattgtctgatagcaagcatatacacacatgcacacacatgcacacatatatgtatgtgtgagtatatctataaatttgtgtgtgtatatatgtgtgtgtatttatgtatgcacacatgcatatatacaaactaaaataaaatatctctacatttctttccagactcattgcaaaagccatgagcagaaatatacaaaaagtgagatggtacttatattcccaccggtaaccactgttaacagttttccagtccattgaaggactttccaatctctttacgtacagacgtactattcgttttaatgtctcatggcattctacagtatgggtgtaccatcatttatttaaccattccctaaatggtagattatctattaattatgtttttaactgttatcaatgataataattttacattgtttttgtgcatgtaaaaatgcatttctgggacattatattctatttctgggaaagaaatagaattctaggtcaaagcagatatataagttaagtttttaaaatgccactgtgtccatggcattgtggcaatgttcttcatatgctgcatgagcagaaagtattataacacaaaacactggcaaaggctgtaaagggacaatgtgttccaagaagaaatagttgggcctggcagggtggctcacacctgcaatcccagtactttgggaggccgaggcaggcagatctcctgaggtcaggagttcaagaccagcctggccaacatggcaaaacacagtctctactaaaaatacaaatattagctgggcacactggcgcgtgcctgtaatcccagctacttgggaggctgaggcaggaaaatcgcttgaacctaagaggtggaggttgtagtgagccgaaatcatgccactgcactccagccttggtagcagaccaagactctgtctcaaaaaaaaaaaaaaaaagttagaatgcataaggaaaataaaaggattgattatgcagtctcaaaaaaaagaatgcaaataaaatgacgcaaaatgtttttctgtaatatttgcaaattaagaaaaataaaatccagagttttccaattttgagtaaacagatttatcaaaatactacttaaggagtttagggaatttgggtgaacaacttggccaatagattaaatctaaaacctgttattttcaccaaaaggcaaccattgtggagacaaagagacagacagaggaagggaaactagaggtagaattcagtgctccagactgaacaaatggaagtggctcccagggtcagctcccgggcatttgtgcagagcctgatggagaagctgaagttctcctcagggatatgagggccaaaggtgggatttaagaacagaattgtgagccaaggcaggtgccgatgggagtgttctggtgcctgcaaaggatgatttttgaatgtagaacagactttagcaagatttatttttggttttaaaaaagtgatgtcgaatttcttaaaattttaaaatccttgttctttaagtttttttttctttttttaaaattcaacttacaatgtctttttctatttataaatctagcaggtcttagctatcaagtctaagggacctttggaaatgtttaatcctggatttagttatttaagtaccttcaaatactttaaactacatatgtgatatattttattaactttccaagttcattgatttgttagtgaacaaacagaatgtgacaaacacttgtcaaacttgaacattcagaaaataaacatttaacttaaatgaacttctttcttaggttttttactaaggaagatttcaattaaggatctaaatcagttgtctcatacttttttcttttttttttttttttgagacagggtcttacattgtcacccagactggagtgtagtggtgaggtcatagcccactgcagccataaattcctgggctcaagcaatcctcccacttcagcttctcaagtagctaggactataggcgtgcacctccatacccagctaatatttgaatttttttgtagagacagggtttccatgtgttgtccagacttatcttgaacacctgacctcaagcaatcctcctgcctcggcctcctaaagggctgagatcacaagggtgagccactgagctcagccttacacattttaaagtgaagtttacaagaattatactcgaataggccaaattctcttaaaaactacaaacacaaaaggactattaaaatatcttcaaagttttattataatcttcctacaagagacacaaactagagctggccaattcaaaaattcactcttggcaggggatcttcataagagaaaagaaaaatgagatattcattgttagacttaatgtttttagaaaaatttaaaaattaaaaactcaatgaatgattattagacttcatgacttgatgtaagacattaagattctaagggtaaggttcttcctaagactgtcaactgatactgagtcttaaccctgttaaaattcatcataaatatgctctagtattttttttaacttgggaatgctatttttttctgagaaaagtgaaaattacaacacacagaagtttctgtccaggaccagttttgtgaccttttttctctttcagtaccatacttctttacccaaaaacattcataccatagttttgattattttaaacttttgatactgaatttggaaacttctgggcttaaaaattgcatgcctaaggaagacgtgtaatgtgctaagtgatgaagatttgaggctgtcagtgttggtgactgtggtggagcactttggcctctatgcgtggaagctcagacaaggtctccataacatccacagttggctgaccatgaaacccatatcactgtatcattggattcaaagaccaaatatgaatcctcaatgaattttccatttgcttaatacacattgatgaactcttacatttttctgtacttgtgggattatacaacttaagttttgcaataaaaagtttggtaggttaaatgattttatttggcttgcaatgataactaataaggtctttctactaaaagcaggcagagtctgaaattttctgacattagtagtaagaaagaggaagcaaccatgttaacttacacaggctcaggacacagaaaaactctgtcatgtgcaaaaaatgtaaactacaagagcagggcaggggcaaaggctgtcttctgggttaatctattttaaagatttcacaaactagaagcgaagagggattgaaaatagaattgacatctcctttcccattgggaatttgtagaataaatttgatatcattatgttaattgtgcaaacgtacatattttttctttagtgtaattttatttcaaattaatccatttgtcatattaagattccttttcctaccaaaaattatctttaaaaaaaatctaaactgacaactccacattgcataacagtgtctggaatcagtgcaaaatatgcaaagccccctaaccctcactttggcagaagtgatgcctcagatgtaggcttaggtatcacttttagggagatgatctggcatttgtttgaaggaggatgtgcagtgctctagagtacaggcttcagtgacaggtagtatgcttcaccttcctgactctgtcgctttgtacttggacaagttattcaccctcatctagtctcactttttaaatctgtaaaacaggggaaataataccattaaagcaacatcccagatgtgattgtgagcacatgtcaaagttttttcaagcttcttggccagggaaaagccttaaagaagccaagatcaaaatttcctcttggtggagatattttgtaggagaataggaaggaaaaaaaagtttggttaaaaattattaagatagtcttaaggctagtttaaggttattgtattttaaaatatgatctgccttaggtttttatgggatccccttgctcttgtgttgggaattaactgaaggggtcaagaacggaagctggaagaccagttagctgaaaattgtagttattctggtgagagatgcttgtggctcagactagaggagcatcggggtggggtgataagtggtgagagtcaggacagcttctgaaggcccagccagcaggaattgctcacatcttggatataggctatgagagaaggagagcatcttcaagtttcgggacctagatactggtaagaagggtattgccatcaactgtgatagcgaaaaacacaggtgaagcaggtggtgggggcagggtgagggaggagatcagaaagtcaggtttggttaaaggtaacaaggatcaaggtgagctggatgggtaaattgaatttttcagcagactttttatctcatgaaaatctatcaaaattgtacaaagattttatcaggaatgctagatattctcctgccttcccccccgctcaaaaaaaaaaaaagctctaagttgcatcatgcataagggttctgcttctgatccaattagaggacaattatctttctaagtacttaagcaataaagttgttagggcccaaaaatacagctcaatggacataagtaatcaaaaggaattgcattactgacttgcatccctaagtggccactaaagaacgtccaatttatggtctctatcttacttctccactcagagaaacctgagtttctcttccctctctcaattgctccttgcctgtggctgcacagaagaaggctctttttccactgttttctcacctcttaaaaaaaaaacacaaaagtgaggctcctttgcctgccctctttcctactgagctctgattgtgctgctcaagagcgtgcaggtaatagtaaatgggtgaaggccagcaaggctgtgacaaactgaagaggcttagctaacagagggctgcaccccagaaatgcctgtcattcattcactcaatctacaacaatttatagagtgcctaccttgcttcctactttgggtacgtcagtggaccaaacagacaacaagcagcgctcttatggagctaacgttcattttcagagaaacagacactgaatcataaactgatggataagcagagtatctagtgtgtcagaagataatacacactaaagacaaataaaatggcaggaaaagagattccagggaaacaatgaggaaggtttgcacattaaataacatgatggtggcaggcccctttgagaaggtgacacttgagcaggaacatgagctgagacatggggcatgtggacatctggggaaaaatgctttgggtagagagaattccagtgcaagaaccctgacaaggtagcattcttggtgtgctttaggaacaacaaagtcaacatggttggagcagatgtagaaaagggaaaagtgtaggggtgagttgagagtgttaaggggagcagatcaataagaactggaagatcattttaaggatgttgcttttaccctagataaaatagggagccagaggagacgcgtttaaaatgatctgccttaggtttttatagggtcccccttgctcttgtgttgggaattaactgaaggggtcaaggatggaagctgggagaccagttagttgataattgcagttattctggtgagtgatgcttgcatctcagactagaggaacatcaggggaggggtgataagtggtgagattcaggacagcttctgaaggcccagccggcaggaattgctcacatcttggatataagctatgagagaaggagaggaccttcaagtttaagaacctgggtactagtaaggagggtgttgacatcaactgtgatagtgaagaacacaggtaaagcaggtggtgggggcagggtgaaggaggagattggaaagtaatatctattagacacccacgtggagctgtccagcagacagctgcgtagaggagtctggagttcaggagcgaagactgaactcagatctaaacgttgaagtcactggtgtgtagccgtgagatttgctttgactttgctcagtaatcttatttttgctttaaaagaagccaaaaattcatatttcttctgtgaaactttacaaattaaaaacaaactgccagactgcatttccctgaactgtcttgattcctactgctttcatcacacttttcccaggcctcatccactccagctggaaacttcagcccggccccagttaaagctaagttacagagaaataaccactctgatcttcctgaaggaaagctgtgggggtccttttgttcttcttaaggctgacctagagagagcatgttctgctgaaagtgtgcttgccaggatgaaattggactccagtttacatactcagaaatgtctgtctctagtctacctagtggctcaatctcacaacatcctacaaaatcttatctctgctctgaagcagtttatttggctttctccattgctgtgcatttgcctttaaaaagaaatactttgtttcttcatatttcccatgaacagcaaaacacagtacaaaacaaccaccttgaggcccaaaccatgtacctctgtaggatggactgtgagcttaggtccatggaccactctagataaaccttttcactttatctattacctggattgtcaatagccccacctagcaatgatccttctcttttggaagaattttttatttggataaacattataaagacttttaaccctctgactttttttttctcctttcattcctatctcttttctttctttcaatcctttatctcatttcccttaagacaatgcacattctgcttttatacagaggctaacagcttccaatgtgtctgccacactatctaagtttttcctgggacacatcaccagggctttggggagtaagaggaaagccattgtgtccatgctgaaagctttctttgttaaacattgtgcaccaaaggaggtcacatccatccagatgcagttatagatgcaatatcgttaggattttagaagacagatgttcaatgtgtttatctcctagcaatttggattaagagccttacacctaaaagagtgagtgccctcacgcttaattcactctttccacttcccagttctatgatgggtctttttctgggttaatgtcttcgatgctcagtttatgccacgtagacagagaaagaaacaaaagcccagttaaaatgagctgattaaagaatgtggaaattatactcatgaaactgccccttttaaataagaaaattggtgtcatgtgtcttttatctcaagcgtcttctttacagatgagtttttctaatcacagtgtgcattgaaccaaaatgaaccaagcttgaaggcagctctactagtgctcatttattattattttttctttctcattctgggaaaactagatttttccttgctcaagtactcttttacccttccaggaatgcatcattggcttttctgagtgaccatagacaaatgagtttctagtaagttaataaagatgtagtttctacatttttatggtaaattgagtttatcattgtaaaacaaggtctgtgtgaggcatattaaatatgtgttctaagtgcccagatatttcttagagctttcccctaaacccttctcccaacatgccgaagtagattttgtaatcttttgttttaaaaacatttaaagtggggcaggtgccatgtggctcatgcctctaatcccagcactttgagaggccgaggcaggtggatcacctgaggtcaggagttccagaccagactggccaacccgtagtagagatggataaacctcatctctactaaaaatacaaaaattagctgggcatggtggcaggctcctgtaatcccagctactcgggaggctgaggcaggagaatcgctggaacccaggaggtggaggttgcagtgggctgagatcttgccactgcactccagcctgggtgacagagcaagactccatttcaaaaaaaaaaaaaaaaaactaaagtgcagaaaacgtttctttttctttttgtaattacaggattcttctttcttacccaaagttaaaattctgttagttgaatgtaagagaatcccagctcggactatcctaattgcattggggatttttctggaaaagggttaggctacttcacagcatctaatatatatgaaaatagccagctcttaggaagttcacgggtgcaatgaagtctcaaggacagcagggaccgaccacacagtgttggcatcccccttttttgctgcttgctgcatgtcagcatattttttgtttattctgtctctctttcactgcagacaaattttcttgtgtctcaaaacttgaccactgagaatgtctgggttttttattttatagtttcagccaccaaaaaaagtcaaccctgaactttcttggggcccaaaacaacaaaaaaaaaaactacagaataagcacctattgagtgtgctttgctcagtttttctttcttaaggcaatttcttgttttgttgggggagggcagcaataatactatcatttgctcatatggaaatctctgtttgtgtttacgtgtgtgctgtggggaggggatgggctggggcaaaaggaggtgtggaaaggtcatggaaaaactgggcagcttcagaagagaaaattatggcacaaggtaaactgcagaagaagcagtatttcagaagcagggagatgctgggatgtgaaaggaaacagcgtgtggggacagggggcattcaaaacagtgctagccccccaggatctcctgaggacatgcctggagaaagaaatccttactgggatgaggacatcaaggctctaagtttttggaacttccctcccagcacaggcatagagcaggacaggatctctgagttacccaagagaaaagcctgtggcctctgctgtccaccaagaccaggagagtgggtgggaataaaaaggaaaggtagaatttgaacagagagaggaccacttttttgtttgtttgtttgtttggttgttttgtgtgaatacatcccgtaacaaaactatgggtcctttatttaaatctttcctgtactttaggctatcgttgaataccataaagttatcaacaagcttttcccaaacataagccctgtcagcacaattgtatatttgctgtgctgagcagaaaatttctaatatgtctgaacatatgcaggaatattagtttctgggatttgaaacaatcattgctggaggctttcctacttatatagggcagtcagagtaaatcatcttacttttgcttgcctcagattcttagtggcttcacaatgaacccatttgttgtattatataccacttctgtaacttcattgcttgcaccctctctctttttaaattcgcggaatttattttcctgtactctctcaggccctataaagattgttttcaaaaattatggtatgtatcattgtttttactcttaatttcattcactgcatttactgagcaccaaccaggttatctcttaatggtggcagtataagaggtgcaaagaataacccaaaggcaccatgtagtaaaggggatttgaactcagatacatgtctccctaaagtctgtgatttctgtctggaagaaaaaaatgttacctccactcccattagcccaagtctaaagatttttcctttcaactatttttgaagtttataaagcctgtgttttattttgtggtgttcatgcttcgtatcttaaacttttacttaatctattataatcatgtttgtcctgttataatcatgtttgttataatcatgtttgttctgttataatcatgtttgtccacatcatttgttggagttttatgatagtccattaattttatgtactacagatttcctaagtaattttctaatgttggacacttatgttgattcaccattatgaatggcatcattgtgaataacactaattagcatatatatttttcatattttgaacaatagccttaagacaaggtcatctcagtgtgattgctgattctaattatataaatattttatggagtttttaatgtgtgtggtaaaaatatttttcagaatagccatgttattttgaccttaagtagtgaagcctttgttttaaggatagcatttacacttttacaaatgataaaatacccttgcattttagatgaacaaatatcatcttttctaacttcgtgttgtctttgtgcagtttaaaatagatacctggtcattccccaaaagagaagcatgaggacaatgacctcaattatctgcctctcctttaaaaatacaaaaccattaaaaaatgtaaaatgattatctttatacattttattttttagtaagtgaaaaaccttacaaattctgaccacttcaaattaactttaagtcaacatgaatttgcctcaatattaacatccttaacttaagtacttacatcagctttgcgactttcattgcgcagtaatgcaaggtgattctaccttttgtgctaaaactgtaatattcatactattttgatgtcattcaatctgccttaggtatgggagtatagcaaatcaatatctactattaattgaggcagttggatatgagacatttttgctttcccctttctgccaaatgatttggtttattttcttttcatttatgttttcttccattaggtgtttgccaaactactgtgaacatggaggaagctgctcccagtcctggactaccttctattgtaactgcagtgacacaagttacactggtgccacctgccacaactgtgagtagattgatcatttgcccctggtggcttggacaaaactccaggaacaccattgttaacttcaggatgtatttagcatggggcaggcatgttttattcactcattcagcatgtgtgttttaagaggttattatataccaaacactttgttgggctcagaggatgcatggatacaagccatattcttgtggagtttatggtctaccagcaagacaggcaggaaatgagatcatgacagtacagttgaataagtttaaggtggaagcaaaggaaggtgctgtaggcacacaagagggagctgttaagtcaattgcatagtcttgatgagttgttaggtggctataataaacaaactaacatctctgtggtctaagtaacaaggtccatgctatacctgtgtcacatacccatcatgcatgacaaaggcccttcttccaccttgtccttgttcttagatggtaacaaaattctattatctggaagattgctgtagtaagaggaaacacagggagggaagcacagggaaacatgggctagcttttcaaagcttctacttggaagtagcaaacattacttccactcacattccactggccaaataaagccacgtgggcacacccaacctcaataggggctgaagtgcaatcttgccgtggaatgggagaaaacagaacctgaatattggtgaaaagtgctaatgactgcctgtcaaccgcagtgttagggagacttcaaatagaagaactgagctgatcttgttgtagaaatatgggaggaaacaaaaacaagaaagaaacaaaaaggatactcagaagcaaagaaacaaatggagacataaagcacaggggtcctctgctctgtggaaaattggaattttcaaatagtttcagatggctggagggtgctgaaggtgaggaggagtgataagaggggagacagagataggctagggtgtacacaagataaggagtgagggatagaaaacaaataaagaatatgagccttgattttttatttgtttatttatttatttatttattttttgagagagagagttttgctcttgttgcccaggctggagtccagtggcacgatcttggctcactggaacctccgcctcctggtttcaagtgattctcctgcctcagcctcctgaatatctgggattacaggtgcacaccaccacaccgggctaaattttgtatttttggtggagatggggtttcaccgtgttggccaggctggcctcgaactcctgacctcgtgttccgcctgcctcagcctcccaaagcactgggattacaggcctgagccactgtgcccagcccagccctgatttttataattgtatagtcttattgagaccacgggtagggggaaacacatgaaaaagtatagaaagtttgccagtcagagaaatgtatgcccaactacggactataagtgtgattgagaaagataattctgaaatcactgtctggaattgcagagcatttcatgaaaaattagaaatttgaaattggcttagaaggtagaagggtaagataaacattttctagacgtaagagtgcagccaacgcctggagctcttctgaggactccagtgagaactatcgctcagggacagttctctccggtttttcttaagtgcctgctgtttttgggctggcacttggggatgcagaaagagcatggtagatgccaatagggctggaaccctgggattccagccaaggataagtaacgttgatattctcatctttaaagacctctcagccattccttagcctcttccattccttcaaagcaggattcactgatgatgtccatagggaagtctgatcaatttagagaagaactagtccactagtccactggtcatcagggagtgatgtggttattgctgttagttgcctgcagaaacaaaaaaaatattgtttggctttataaaaatatatctcattaaaacttttctactgataaatttagaaatcaaagtaactagaagagtatcattggattgttcataccacaaaggataaatgcttgaggggatgaatacccaattttctatgaagtgattattatgcattgtatgccggtaccaaaatatctcgtgtaccccataaacatatacacctactatgacccacaaaaattaaaaataaaaatacaattaaaaagaaatttagaacagtgaaaagaacaatagaataacagagattgaatttaaattttacctagatcctttttttttttttttttttttttttttttttttttttttttttgagatggagtcttgctctgtcacccaggctggagtgcagtggcgcgatctcggctcactgcaacctccgcctcccaggttcacgccattctcctgcctcagcctcccgagtagctgggactacaggtgcccaccaccacgcccagctaattttttatatttttagtagagacggggtttcaccgtgttagccagaatggtcttgatctcctgaactcgtgatcctcccgccttggcctcccaaagcgctgggattacaggcgtgagccaccacgcccggcctttacctagttcttctatgtgaatacgtataagattttatcaattgagggatcctttttttttttttgcagatcctaggaagaaaaactaatgaactcttgtgggtccatctaaggctaaaattatgtgtttttatctaagagtcccagtaaacaccaatctctaggttttaagtctggttccaaaaatattatcaccaaatagccaagaacaccatatacctatagagaaatgttgcaggacccccataaggctgtccagattgtaacgtcagtgctgctgtaagaagtcagagacaactgaaatggccatcaatttaatagcaagacaagggaaacatgaagatttaagtcaaaacaacccgaatttcagccaaatcacattacaacattcccgtgactgttaaagcttattccgctcactttctccaaaagtaatttaacaattttttgaggagttcatctctatggatactgttctcctttaatttacttcatccatcaggctaaaaatagaagatgtcgagctttaaaaaaaagtgtgaagttgaaaatcaatggaggtgaggtgctgatttttaaaggaacactgtcaagcctgatgagcaggagactcaacacacaaaaaccttaaaaatatcattttttaacaccttcctatttccttttctgtgaaattgctcaatgcctacactgtaggctgcaactttgtgaaactctatctttgcttctgggcactcagccaggacaaatcaaaatcccttgaatatttgtgacatttggcaagcacaccttggttccctgtgcaattcaaatatttgtcctccctctaactaatttccccctcccccagttgaatgaggaccattgtttttagtcattttgcaaaccaagtgatttcatcagcaagcttgtgcctcactctcagcaagcatgggtcccactcacaggccaggtgagagcttctgcagtgcagaagatggcacacagggcaccctttggcaaaaacaaaaacaaataggcctgaaattctgcacttgtggaaatgacagaatccttgctgtgtttgagggatgttttactgaaggaattgaccacagtcgaaacaagaaatacaaactctttggattaataaattatttataataatttcttgagtattctcttagttttgtcaagctcttcgaaaacagtcttttccccctcattgttggtgctttctagtaaatgtgaagcaagaggacagacttaggacagataggattaactttttttgtccagcctttgtggataagagaggtcctgggtgaggcgggcacaatggactctctaaaaaataacagaatggaaattcccaaagcgtgtagacacagcatgctgctgtcgaaagtagagatatcttcagtccgtcttaattttcttatccttacctgatgatacttaagggacttggatatgctaatttggtcacttttcaaacatacatcattcaaaactacctttttaagaaaaacatgatgaatgtgtgggcaatttctgtccaatctgtggcagctttcccatatgaagaggaaacctacctcataaagtgccattggagactattatatgatgtttgtaagttgttatggttagaaaatttctcccaaagtggtatcctattctccacaggagtaaccgaataaaaacagtgtttgcactccaccagatcaatccctggcaacccaaccaatgttcaatgccttccgactcccagagacagataccatggttattagtggaatataacgtgcaagttcagaagcctgtataatcaaaaccaagcttctaagtactcagggtatattttggtcatggtatgtcatatctactttattacaaatccaaattaagattaaaaggagcaggtttttgattgtgggatattagggcatagatgatagatagatagatagatagatagatagatagatagatagatagatatagatagatagataccattacaacatatcaataaagggatatgcatagtgttattatttccattttacagatgagaacattgaggcccagaaagcttatgtaaattccacaaggtctcatatctagtaaatggtagaagttgggctttaagccaagagaatctgcgtgttgatgccagatgctaaatcctgcatcttatttcttccttcaaacaagcaaggcatttgcaaacctctgtattacaaacttggtgatgggacattcatgacctcttttatattgcttaagacgcagtagaatagtgtgagatcataattgaaaatacagttctagaagactgagagatgagaaagtttttgtgttctagaataatcatgaaagcattatggaaggaagtagaatgacttggaggacatctaaaattgaagtagacaaaaggaaaagggaggtctgtcgaaaacagactgtcaagggctaagacatgatagtagacatacatgtgctgtattctgggacaatgcagaacttgcctggctcaaaaaaagaaaacatgaattgcactagtcattcattcctgaaggccaaatgagattcctataaagcactttcccctagagaatactgaagcacacttactattataaccagagcttttcacatgctactgcaacacctctaaatattattttaataactccaaattattttaataacaccaaaataagtagcccaagacgtttttgtttctatattcaaccatcttaatatttttctttgtctttcttattctggtgagagaggcagaggatctgttttgtttccaaatatttattattgtagccagcactatgttaagcatctttgtatttaagtattttctggccgggcgcggtggctcacgcctgtaatcccagccctttgggaggccgaggcgggcagatcatgaggtcaggagatcgagactatcctggctaacacggtgaaaccccgtctctactaaaaaaaatacaaaaaattaccctggcgtggcggcggacgcctgtagtcccagctaatcgggaggctgaggcagaagaatggcatgagcctgggaggcggagcttgcagtgagccaagatcgcgccactgcactccagcctgggcgacagagcgagactctgtctcaaaagaaaaaaatatatatatatatcttttttctaataccacaagttctatggtttacttaaacaaacctcagaaactgctttattgagtaaaaagttctgaatggttttaagaatcttgattcatatttccaacttgttttcctaaactcttattacggtttacactctgatcactactttctgagatcttgttttaccttctctgacattattgtttactacaacttgtaaaacgtttttacatgtatttttactaacacagtggcatattaaaatagagattattattgaccctcattgtgaattccagattaaaaaaagagatttttttcagatgacttgtattataggaataagattgcttccacaatcttttttcagatgacttgtattataggaataagattgcttccacagaattttcttttttcattcaacaagtactttttgaaagtacatctgattcattaaactgtgaatttagtgattactgtcacattgaacagatccagtaagtgatacaagcacttgtccttgatcttctcgatgtttatgtctgatgacactcacatgtgccctgttcaggatcttttcaccatttctcagcctttgccaatcccttttcaacagtgtaggctctctgacatcctaacaatgccctttagctcatttttcagctttgcagaaggatgtcagctttcttcctcttccaagcctgatgtagtgcttcttctatggagaagtcaatagccatgtattaatttgaagcatatcaagtcatctggctatcagatgttatagtaatcattgcagagggacaacacttgctttaacagtaggtaaatggtcctttgactgcatgtagttatgttaactaactactgagactataaacctatttaggtgagaaaacatgccttactcacacttgtaccagtcacattcaaggctttggtggcatataggctattatagaaatggtgagacagaagattaagcagaaaaagataatacagtgtgctcttagtggaaattccataagaacgggatgatatctgaatcttcccagggtctccagcctctgatctaatccctgacacatagtagatatccactctttgatgtataccaaaaacaaataaatgaatttatgaggcatgtgcacataacaatgtcaagttactgtagcaagagcattgttactttcttgagaaagtgagaaagtgctcaaaataattgaccttttagcagagatttgagggatgagaaagaggaagagcaccgacaacggccttgcaggaagagtgagctccatgagcaaaggcaaagtgacacgaatgtcaaacaacaaagtgggggctatgggacacctggcatagctagaattgaagatgaaatgggggaggcaggaaggagatgcaggaaatgcagccagggtagaaaaggcagacaatgaattgagaaggaacttacttctctgctggccaactaagagccagccacagtttgttggggatcgggttgctaatatttgtttgttgtttgctttgttcatcagtttcttttttttaatgtaatggtgatggtgctttggagcatatactgaagatggaaggtgtgggtactagggacagatactggatgcaatttgcaattttgtgggcagcaaataatgagaaccagcacaagctagaaagcagggacctgatatgaaaggcatatctaaaattggatcaagtatacttaaagaaaaattgaacacagtagagagaaggatgacttttagctttttaacttggaagacctcatggatggagaatggagtgactaagtcctgaggtctgtctcactctgacagcctagtgtcaaatgcaggctctacaagttacaagatatatgacctagggaaagaagccatgtgagctccatgtgctttaacttcctcacctgtcatatggggctaatgatagcaatcatttcaaagaagtattatgaggactgagtaaaacaatcttatttagcatggttcctgacaaatacaaatttcctgttccatgttagctgctgtttaaatagacagaggatgtgtagaaagaggaggagatttagtagttggacttcagtctagtttggggcacagtatttgcctggaaagtttcccactgtgcagaattagctggaaaactctggagggaggtccatagggaatatcagaatcagtgggtgtatagttgctgaagccttttgagtagatgaagtcaatcaggtgtggtaggccaagtgtgggaccttgaaagtaaaatattttaagagactcaagaagagatacaatcaagaaggaatgatagccaaaacatataaataaagtactacggaaagtgtaacctaggagtcagaagagggatgtttcaggaatagactattcacagagatgtctaggtacatggtatcccactgagtacttttttttcttttttctttttttttttttttttttttgagacagagtctcactctgtcacccacaggctagagtgcagtggtgcgatcttggctcactgcaacctccgcttcccaggttcaagcgattctcctacctcagcctcccgagtagctaggattacaggcacaggccaccacacaagctaatttttgtatttttagtagaaatggggtttcaccatgtagatcaggctggtctcgaactcctgacttcaggtgatccacccatctcagcctcccaaagtgctgggattacaggccgaatactctttcatcataatgattggtaattgttaaacgactggatagatgtttagggagaagatggaaaaaaagcacaataagggggaaaaatgaaataagcaaaccaataaaattcaacctgaggaagctaattcaaaaaaagaaagaaagaaatcagtaattttctgtcggcagcctaagactgtggcagtattggaatgcactggaatttgctgatccaagagaatttgtttgttgatgagtatcccagattttgtcaggatctaggtgattcaaaagcattcactgctgttgagaggatttcattctccttcaggagaaaaaactccaacctccttgaatccgttaatgaacagtgaatgcactgtgcaattgagtgcacaggactgcctgtaagggggaatgcttcttctgggagggagagatctgagcaggctgaactggatgtgagaaagtcttcttaaaaggaaacagcagatactggggtctacctgagggtggtggggtgggaggagtgagagaagcagaaaagatgagtattggttactgggcttaatacctgagtgatgaaataatctatacaacaaacccccatgacacgtgtttacctatggaacaaacctgcatgtgtacccccaaaccgaaaataaaatttaaaaaggaagaaagtcttcttaaagaagagattggacctgggcataaaggctggacttggggagtcagataggtgtcaggaggatgtttttcaagggtggatattaaaataagaaccaaaaataaggatgagcacaggggatgtttggggttcacccagtgctctagcctaaggggaaaggaatggacatttgttgagccctatgtaagtgccgtatgctttactcagtggtgaatacatgtcatctcacattctcagctctagccctgttagactccggcggctcttcaaacaactagaccttcagatttgcacatctcttggccacaaagacttcttaccactgtcttttcctgaagaaaatctgtcaactgatgcaagaaatctgagcggaccttttgcagctattacttctttttgctcctttagcattctctcacatagcacttattctaccgtataaaaattgtctgcttcttgtttttccttgcaaactgccacttttctatgcatttctccttgcatatttggcacctagttacacatagtagacaatcactgaatgtaaacattcttttatggccaaaatgcttaaagccacagaaccggtggagtttgaccttagttctagatggcttgaaaacactttctcttcacattacaacatcttaagtgcattgaagagcactcttaaatattttatggaacacagaaggatttaaaagcaaaactaatccaaagacttcttatcagagaaaggaaggaatgcagggtgtatattcaccttggattgattttcttccttttgaatacatctcagtgatttgagagtttccctcagtcatatcctacatgtcaattggttccatttcttctttccttcctctttatctatgtctttctctccatcttcctccaaccccttgttaattgaggatacagtaaagccaacttcaaatatttacactgggttgataaagagcaagaaatgtaatcacaagttttagctttgttccaaacccctacaagcaacaaaagattccaaaatgtaagtgaagataattaactgaatataatttaattgctgatgttgcttccattggagaatcattgatatttactttgaataccaagcaagaaaaattagcacctatttttaatgtatttcaatcaacagaagattaattgccagaaaaatacaaagctctagtatgtcccatgagtaagaagttatctggaatatacatacataaaaaattcaatatatgaagacacagttttcatttgtgcctccactttgaatccagacagatggaggttatcaatagctctctggtatcagacaaattatttaacttctttcagccttggttgtttttggtctctaaaataacagtaactcctttacacaattgttatgtggattaaaggcaagaaacagacaacatctagcacaatatttgaaatttggcatttccaggttaaatggtatctattacatatatataaagttattgccataaaagtttagaaatactttttcatataagagacatcctttctatgctgctaggtcatatggctgttttctactatggatttctactatacattttttatactatagactaccaaatagaggttaggttttggcataggtgttgccatcagtagaaaaaccaagaggcaaaacgtcaccagtagaaccccggtggcaggttgcgggggggacgggggatactcctgcatgagtcagatcctctctgccacaaatgaccttaggcaagtcacttactttttgtgatccatgattcctcatgaatactgtgtggattatacgtggattatacatggtcactaaggaaaactgttttgatttgctctagcagcatgactcagaataagaatgtgatataatctcactcaatagtttctatttcttatcttagccattttataatattctagcctaaaataacaattacataaaccacatagtccacatcttgtctatagaaagcactaagtattaatttacactgttacctcaaataggcttttaaaataaaacaggttaaaacatgaggaatgttctgcaagcatcacagctctttcagcttccccttgaagtatttggtatagtttaattacttgggttttcatttggaatgagtcaactcaaacagtaataagagtagtgagcaataataaaacgaaggcatcatgtgattgttcagtataatttatcagtattttttaaaactatgactgacttgactaagttgtcatgaaatgaaggaatttccagtgtgttcattccgattcatgcaaatatattttgactatgtaattcagagacaaaagtcagaatacatttccctagtcattaaaattctataacacaataacactgtgacttatgtatagcaagttatttcagcaatgtgagcctcatttgtgccatattcaagggaaaataatagaatctgcccctcagtgctgttgggataaattcatgaatcaatgggcgtgaaatctctctgacaagtatgatcataaccctttcttatagatttcttctcatgtatttacatcatttttttcccactgcaaccttgatgagggacgaggcaagtacgctttaatgtacagaggaaagtcatgagatgtacaatggtttaatatggagagcccaaggacattcaggtacaacagcccagcaggacacaagcctgaatattgtgactctttccaagattcttcagatatatcatgctctagacaaggtcagttgttagggaaaatccagggttcttttaaaatatagtttctgttgtttcctaaaagtgactttgattatatcattgcccaacttcaaattctttagtggctctctataatcttattgaagaaaaccctttactatttgatctcagtaagtgaggcctttcattatttggaacgctcttgggtcacaaaccattttcagtcatggccctgtatgtgtccactttatagcagttgtgatccactattcattccctgagcatgttccgtttttcttatctttccagtattttggccttgaagttatttctcctggaatgttcttcctgacttgttttccaaataattgtctattctctattctactctatgctctgctctagtatcacctccacgtatacaggtggctgcaataattgacttttgatctttctctggcattaggttgagctccttgaggtcatgcactttggcttttcttgttttttgaatgtgttcccaactcctaaaccaggtctggaatattactcttgcaaaataggtattgagagaatggagttctaattttcaaattgttggcactaccttgaaatatacttatatccattccttattgagggaaggtgaaagatagcaaatcagataacaggccacaacctccgttaggctttcccttttagcaatcaggtaggaaaacttcccatttttaatttgatggaagaattgaggatcctgctttttatttaaagagtatttcttaaagatcctcacactacgtccccatttgctctcaaactagcttgtaaatgattcttcacttggcatagctgtagttccagattttaagatattagcataaataggatttttggatggctgtatatatctatatctatatctatatctatatctatatatatgtgcagaaaacatgaaaaggagataaaattttccattgtcatagcgggacatgcaactgagtttattagtctgttaacggaggagttgtcaaagtcagttttcagtggcacagatttcctgctggcagctaatgtgatgatgaagaccctggcaatcattcccttgttcctgtctgcttgattttgctgtcgtgatgcctggaagagggagctaatatttctgtctgctaacattttatttcattactgcatgtttactaaatgggcattcaatggaataactgttacataacatatgcagattagggatacctgcagctcacaggccatcagaggagaagctgggctctctggcttctactttaacagaagtcttccatctaatgacatcactgggggaatagtcaaaactacagaaaacaaacccgttctgtatttggttttgtgtttaatggcaatgcagtatgaaaaaggaattgtttttgaagattaggctgccctgggttaaattccaggctctaacaattactaattgagtgacctgtgggaaattattcaccttctcagaacgttagttctctcatctctaaatatagggatagtgatatctatgtcttaaaattttttaataaataagagattatgcttagagtggtggatgcagtgcctatataggaagtgcctgattaagtttacttattttacttcgtcagtcctctacacttctacattttctggccatctgtgcgtagcttttggactagtagcaagttctgatttctatgtttggaagggacttttaagtgcaagtatgttttcttgcagacttcttcaaatcgatgctctagaaacggactgataaatacctcctgttatcactgtagttctccagtagctataagatttatttcttttaggtagtaaaatgtaccttctaactttccttagttagttttattttggctctcaatgatcctactatggacttgccattttttccgcagcactatcatcacgtctcagtcgcttgacatgaagtacactggtgggctccatagctcctgaaatcactggattcagaacatacctaggaacaatcagagtgagaaattgcctttacttattttaattagcatgtagtttacttatcattacattataatacatccctaaatcagtgaaagtagctgattccacagtttattttggctgttgttatgacataatttcattgagatatttatttttattcaacaccaattcttgtacatctctcctattttggggtcacccattcatgcaacacacatttgtatcaggcatgtataaatatctattcagggttcaacagtcaaccaaatattgtgggtgacacttgtgcaattgaaggtctgcttcctgttctcaaggactttaaaattagcaggaatgtgggcagaagggagatgggttatatactaagaaaataatgcaagattgtacatggtcagaagctaaattgaatataggaaatggccaaaatataggcaccaaacaaggagaaggagatgagccgtaaagggaagggatgctggataatgctggacttgagccaaaccctgtggcatacatgggatctgcacagacagagaatatgacagagggtcaagaatcaagactgacattaacttggttggagttggggtcagagggatatggacttgaatagttcggggattcttattaatggagagaaataatgatgatagacaaaactggtatcagccagagttcagagaacagaaccagtggaaaaatacatgacaacaatggtcacattgttatcctgaattgaccaagatgctgaacatggccgggcacggtggctcatgcctgtaatcccagcactttgggaggccgaggtgggtggatcacctgaggtcaggagttcgagaccagcctggccaacatggtgaaacctccgtctccactaaaaatacaaaaaaaaaaaaaaaaaaaaaaaattagccgggcatggtggcaggcacctgtaatcccagctacctgggaggctgagacaggagaatggcttgaactcgggaggcataggctgcagtgagctgagatggaaccactgcactccagtctgggggacaagagcgagactttgtctcaaaaaaaaaaaaaaaaaagatgctgaacatgtgaaaaaaaactgcccttgctttctacattgcaacaaaacttggggattcataatcttacagctcaaaagggtctccccacagtcttggaactgtacacccactggaaaccacaggataaagctcaccagggaattttctccccagagggagacagcatccctacttcagaaggccgaggcggtggatcacttgagctcaggagtttgagaccagcttgggcaatacagtgaaactttatctctaccgaaaactaaaaaaattagccaagcacggtggtgcacgcctatagtcccagctccttgtggggactgaggtgggaggatcatttgagcccaggatgttgagtctgcagtgagctaagatcacaccactgcattccagcctgtgtaacagagtgagaccctgtctcaaaaataaataagtaaataaataaataaataaataaataaatgagacaacagcatctttgatgtggacagctttttcccaggatcatagatcaagacttctctattatcatgacactctttgtttttcaatttttttttctttgcttatgcctctatgaaagatagaagtgacaagggagtctgttgtgcacactcaagggatacacttttatttgtgaaagatttttcagctagctttaaacatgcataaccttataccttgatagatgggagatgaagggccagtgtgggtgagaaaattttatggtacatatgttgcctcataatcagtcagaaacagacattgttttactcctcttaacatatgtaatggatcaaaaataatgctgccaggaggtcttcgctcttctagaatggcatcatttgttaggtcctttttaccatgatttggagtaaatgaggcaatgattagaaattcattcctcatgataggctctatagtagattctattgtaaaggatatggttacacaaaatattttatattctcccataaaagttatgctaaataatagaattgctctaaattacttacttactggataaacagaaaagtatctgtgcagctgctggaacttcttgttgtccatggagaaatacatcacatcaggtattatagagattcagttgtaggagattaacgtagagactgcttagctaaaacaagtagactcttcatctagctcattctttgatctattttatcttagttggtttggtttatggggaccctccaaactcttggtattatcccccgatagtcataatagtagtctccctggtgcactgtattttttcaaaagttttaaatgtttgcatgcagccttctctagaatgtgaaatgatctgtcttcaactgggatgacaagagctgaaaaaaatgagtgatcgtgagggcaccataacctgtgaataacatgctgagaccagaaaccctaaatgatggtcactgagagtggtgctaaggccctaagttttggtcacactctcacctaagtgagaaaatgaccaaaaggagggagtttttaagcaaaataatgggaagcaattgttttggactgagttcatgcactaggttccaacagaccagaccaaaccaaagtgtagtcacttatgctaaatgtgacataatcaaactaagactttaaggaaatacatagatcctagaacaggccaggttttgttctttgtttgtttgtttgttccatcataaggaggcaccctctactctaactttcacagaaaataacctgaaatcctgtccccaccttacaaaactcactattctgctatttcccagtgggtttcaagactaaataagtacattgacaatggtgacaatgacatcaatgactaaagttctggtcagtctctcaaaattgagaggataaccaaaagcggggaattgttaaatcaagtttagcctaaagctgcctctttacatattttaagttcagcctaaaggcttctctgtaagttgtcaactataacctaaacagagttgtaaacagactgtagccactcactgagttttggccaatcaaaggtggtcaactgttcaaaccatgttcaaataaggcagatgccaagctgtaaccaatttggttgtttctgtacctcacttccactttctgtccacatattttcttctaccacgtggctgcactggtgtctctgagacaagtctgactcaggaagctgcaaaattcacgaatcgttctttgctcaattaaacacttaaatgtaatttggctacagtttttcttttaacaagtgcttggccccctcctccttacagcctccacaatgcataacagttacgtttggtcatgatgcccagaagggtgcagtctccgtctctctctctcagctgtccatccccatctctcaatatctgtttatatagacctatgcatgtgtgtatctgttcgccttaacaaggtgagaggacaaaacctatgcatatggagtgatttgcatgacagtacttgattctttgctgaatgataaaatagatataaaggagaagttcagaacaatatgggatgtcctaagtttggggaatctttatacagggagtgaggagaagcgaggccttacaggatgcaggtatttgcataatgtgtggagcacagggggaacgggagtcattggaagtagagggaatgcctggctcctcaaaggctctcactgaaggattatagaatgtgatggatatgatagggaagagcacagatcgtgggcttggggccaatgaggaaaccaggggaataggtggatcacaatgaagtatctgctggagaggcggtaggaaacaaggctggaagtcactaacccttggagagagaatatcctgttttatgctttcaaattcttcaaaattcttctccgaacatgagtctttattagcaaagatcatttcaggtttcttaattttaaattaaaatcatgccaaggtgggaataaaagtgaaacagggaaaaaagtaaaagttgaaataatgcctttgtaatagtctctagtctcctcatttttctttctttaaaaagtccaatcctctaattagaagacaaagaataaaagtgagtgcatagattcccttatgtgattcttctactaagaaatcaaagctctttcattttcaattttctagcacgacaacataaaacaatctcattaaggactttgtcgaatattggtaaaggttagacagagttcaggcggcagggactgagaaaaagtgtttgagagtttgagcaaaaattggaaaacttcagatttaagttttcaggaagctgaaatggaacaaaaagagaaagcccacaggtaatgatcagtcaagagaccctcccttatacccaaagacctagccagcacagagatgaaccagtgtcctgaaatgcaaacttaataggaagaaatgtgaggtgaagcccgttgagatcccagcctgctgaggaaagaaatcctattgtatatgcacatgacgcatccccaggaagagaaagactacctgcattacaccattctccaaaagcggccgtcatattgcagtgtcgatggtacctcagggaacctattctcaagtcaaagacagaggaacattcttaagctggtgctgtttcacaaacacggaggcaggggcttagagtaggagtttaaattacttattaaaacagatggtgaaatctctctctactttaaatctgcgttaaaatgaatcttgaaagactgaaatccaagtgatctggaaagactacaaatggaagttgctgtgtaaatctggtgaacttttcagtgtaaagcgattccatgccatttagcaggagcttgatttctttggatcggaaggcctcggtggctgtgtctcgtgtctgtcattttgcaggcatgtggttgggaattggatggcacaggcaggcacaaagcagcctcatcggacagtattcaagtggcagtagttgttgctcacctggctttactcactccagaaaccaggatttgactcaaagaggcagctgatttcccctgtcaattgtctgtttataatagtttctcaaaagagattgaactcaagatttctgataaggacaaaaataaaaataaaaaagcaaactcagagcctagaagtcaaaaggcaggataaagatccctggacactaagcaaactctaaatcaagagtccagggctcttgcctacctgggctagcagctgggacacatccctgcaaaagggggctgccagcttgtctggatgaccttggaaatgatccagttctgatggcctgctcaggctctgtgcactgagctggggcagaccaagtttcaaagggctcaaaatttatataatccatgaaagtttttttttcctaaattatttttggaatgagaaaagaagtcactacaaattactaacattttaggaaaaagacaataccacagatatttgcaaattttagaacaacataatgttttaattaacttcttgacacaattttataacacttttatttccttacaacttttgcctagtgtttgattgcttccttatatgatgattttgtttaaaaaattgcagaaaataaataagtaattcagtttttcctctagtatggttgataaaatcatttcttaaaaaattatattcataatttaaaaaaggcttttttttccagcttgacacctcattattggtgatgccacataaacttttataactgtgattgaattggggatatccatgtgaagttccatagattagatagtaagatttattagaatttccacagaccagcttctgcttctgtacatttcacaccttgcttccctacacgacctacactcttccattgctggtgctacaggagacatctctagggagacatgacctctggccctgcaccatttttctctgatgctggatgactttgcatagcaaggagcaggaatactcagggaagcaactcctcaaatgcaatggctaacaatccatgtacatagccgggaacgatatggttatatgctaccaatgtaaactaaatatgtatccacagcatcatttcccctcactggatcttaaaagtttctgtggcctctccaatgccacctggcttgagaagtgtaacagtgggaagggcaggggaaagagacagtagtattaacccattgcagttcaatattttgtttttactgattgccattaaaataacttttgtgaagtttaatagctttataatgtgtcaacacaatttgactgaactaaattccaaagcatttcctttcctgtatatttcgacttaggggaaaaccacaggaaagatacttttgggaggtttggaagggggaagggaggctgcagtccttatgtgtttcacatccactacatccactgttgctggctttttgactcatctcaccggtgaggcagtgtctgggcctggaactgctccaccttcctctggatcctgcttcagcatctctaccttctgggtcaggtgtgtgtgtttagctctgtgacaaagccccccagcttttccagaatactcacatcaccaaggtcaatgacaacaggaagttccatgggttgcagtctgtcttcctggccccagcatgtcctcatgggtttcaatttaacctagctcccgcacctcctcacatccaccttctcctctccactgtggtcttcaaactccagcatctgatgagaagacaacagctttccagagatcacttcacctgctcccacaatagcatcaggtcaaatccttataataaatacaggtatacctccaaacagcctacttctctgacagcctacacacaccagcccttactgacacacatagtttacaaaatgcataatgttgtaaacacattgctcgggttttgcaagaagatcttgaagctgcagcttccggagctttaaaataaattcatctctagcccagagctttctgcctcggttttcctgctggtggtcatgaagtttcatgacaattagtattctctcatcactgtggtgataaggaacttaactataagcatgatctagtaggaagaattacaacgtgatttgtatttaatctggaaatgggtatctcatattgcattaacataaaatgtcctgggtaacagaagtaaatatcctctaagtgtagctcatggcatatttgttcatcttttcctcaaacctcatgtgaactgcacaagctaaaggacacagatttttcatcgtaaaatatccttctcacagcttgaaaaatagacattcaccaattcacacagaaagaccactctttaatggtatgcaaatgcaaaaatgtttattatattaccaccatggcctctgcacaaagaattctggactcgttaaaacaatgacagtgaaatatagacaaataaatactgtataattatttccaaggatgccttcaaataacttccactaggatagcccttattactctgtctagttgaaaccagttttgaacacttatgaccacaatataactgttttatgagttttttgttttccgcatttagaggcgaaagcatggagcgtagagtcaagaacaaacatcagatttacagatagagcccttactaatgggggtggctttggggaaagctctcacattgtatgagctcatttgcattattcataaataggaatacttgttagcaggctctttccccagaaggcttcaggaaccgtgcttaagtttagggagcaagcatgtaggctaaggtggtaaatgaccctaacctgtcagtggcttagcaaaggaaaagtttctgtttttctcactcacactgcaggatggctggtacatgaagctgtacaggggctcaatcagcttctatgttatcactccatttcctttcaggtcctggggaggctcttttcagctgatagagagagaagaaaatgagaatcacatgggaagttctaagggttatgcctgaaagtggggcacgtgtctcactcagtttttacttgagcaacactaaactacccttagttcagaagcttgcatactatcctggcaaaacagggatgggagtggagagaggaattctgttgaggggcatcaaagtctaacaggaagaatggatggatccaggaacagagatcaacttgtaaatagttctctttggaatttgaatgagcctaggagacaggatctgttcaaagtgtggttacattcttggtcttacagggaggggaagaaaaaacaattgttctttattgtgggtccagacattaggcatataaaggaacttcagagaacaacttcattctggcttagggacagtgagtcagggagagcttgaagcttttttttttttttttttttttttgagttagcatgtggaagagtagtacttggggtattggtttctgagccccaaccttacaaatcttctgaagcagatcttttagtacccttcaaagaaaacagaaccttggaacagtaatgaggccaggtttataaaactcataaatagcaaagccaggattttaattaaaacctccttggctaaaacacttctctcttttttactgcacaccacgaactcaactctcaacaacagtatcacttggttgtgaggtcaaggcttacaaatatgaaacaaagtgtgaacctcctcacacaggatatggatctgcttctcaatatatggtcctgaccaggagctataaagaaagaggactggagaaggtgggtctggaataagcctcaggcaacttcctatagtaggacttctcatatatactatttaatacctggagaaaagaggcaggacttcctcacttagactccctgctcactagatggcgatttcaataccaaagccaaggatcaacgaatgagctgtgctatcttatctttagagattattttctagttgtatgactcaactggcaatttgtactgatgatttgatctgttcaagtccccaaattttctgagttattgaggttttgttccatgtaatataacaacaatggcatgagtcagggtcgctgagcccctgtaagcatgaggacagcttagctactatccagcggagccaggagcgggtgctggcctgcctgcaggacacatgattttacctctctgagcttcaggttgagttgctttcctgtttttgtttttagcttttttatgtataaaatgaagaatacaataatatcctcatcttcaaattcttaaaagtcatttcttatttaaactttcacctctttacctttttagcttagagataggttagatgatgtgatcaagtcagaggcctcagagaaataaaagaacaaataatgttatccatggggagggtgtgtcaagagtgaagtatcacagcaatctaaaggctttctttgctatgcatcaagctagaaagttgcaattgggtggatagatccttccagggcaacctccaactgtgtttggaagctaactacagggaacatttgaaagtttgtaaagatttcctggagactctgatactgaaataagtctctgaatatcatatccgattttttatattaaatgtacctgggtaagatgcatgagctcctacctctgtgaaggggaaaatacgcagagcaaagcctggcctgggttcagataccagcttcctgctgaatggtgagtggacttggacaagtcagagtcctgttctgagcctccttttacttccctgtaaaaatgaagctcaaccctgttgtatgagattcctgactgtatgtgagtcaggcactataggatcaaatggtaaccactaactcaagttgtaactatagtatcaaatgctaactattgttatcagatggtagctactatgattttgtctttagttccatgtgctataatcatctgttccatgaccatctccctgtgctgaatacatttctccccctcattatatactgtattgtgtagcatcctcaatttattctgagtctttggataatttgaaatggattacaatgacagatgcatttaaggcttaaatcttaccatagtattgaatcaacttgtaaacaattttttgccccagaaggaagaaatatttatatttttctttgatgtctgattgtttccatatgttatacccagatatatggagtccaagataaggtatagaatagttgtctccaaattctagtgtgcataaatatgtccctctgccaaacttaggtctcttttttaaaagatctcttattgcctctttctggctcagatctttattcttcctcagggggattgttgcaatagtctcctcgtcttttggggcctttgtatagctagttccactctggcttccagaaaggtctctcagaaggccacgtctttataaatcatcagtgatgcttgaattcagagtaatcagcctccaaaaattatttctggaaagacctcaggtggtaagatgataaaatcactagtcggagcagaattattgaataagtgagttgggaaacattcttaacttacatagttacatgatgactatttcccctaaaaaaaagtaagattactaggaaaaacaaaagaggagagaagaaatatatatagagacttagggttctgggaaaaggtaaatttattgttttgactagtggtatgttgatacatattggaaacttgagttttcagcaatgggtttaaaagtgtaaaaatctcaggcctgtcacgatttaataagagttaattttcaaagtttcctttcccttccctttctctttctttctttcttttcttccttccttccctccttttccttccttccttttccttccttccttccttccttccttttccttccttccttccttccttctttctttctttctttctttctttctttctttctttctttctttctttctttctttcttctttctttatttcctctttcttcttcttttctttctacaatgcttctgaaattttaacttgcaaaagaattacctgacactattatgaaatgcaacttccagatccctatccccagagattctggtttaataggtcaggatggggcccaataatttgcatgcctatcttgaaagctcagagtatgccaattgtcgtcggtctgaggaacatactcagggaaccaatactttagaaggtgtgtgtgcccactgagaaggttcaagccttgccgtatctttacataccaacgactttacttccaggcatctgatggcctagactcaattcagctttgaattactgggacagtttatattgagcttgcttatgtatttatattttaaatataaaccttattattatgtaaatctcatagattaatgtatcagatcatggagggtcagggtgacgtcaatgtaataagaatgttagtcacaacaacattctctacttatatttagcaactgttgctacgttttatcttaactaaaatgtgtggtggtttttaagaagaaaatgaagtacagatgccggcttgggtggtggtgaagctctaggcaggcacagtgctttctttgcctttctcacagagccagaggtcatctggctcctgtgttgccctaatcagacaccacaggccaaatcaagcagacaccaggctctggtgcagtgtgtcccgggagcctgaaacatcttttgggacctgacctacaacataacatcccatcctttaactttttttcaggtttattgaagcatatttcatagaccatacatttctcctatttaaagtgtacaggttagtggtttgtagcatactcacctggctgtgcaagccttcttcactatcttaattgtagaacatttcgatgccccaaaaagtgaccccatacatggtaagtcattcctcatctcccctccaccacccccagcccctgcagtcactaatgtactttctgtctctataggcttgtctaatttggacatttaacataaatggaatcatacaatatatgctctcctatgactggcttctttcatttagcacgttttcacgatttatctgtgttgtagcatgtctcattccttttcactgcctagtaatatttcatggtatggaaataccacatttgtttatccattcattggttggtaggcttttgggttgtttccactttttgactattatgaataatggacatgcatatgtcagcttttatttgggcacatgtgttcatttctcttaaatatatacctgcaagtgagattgctgacttaacctcctgcctcctttttcgactttgtaccttgacataatttatagtaaactttgaacaaaaaaaagcactgtgaggttctgtgtaccccagtttcccctgtgctaatatcttacgtatttatggcacgatatttaaaaggaaattgatgtcggtatactatatggagcttactcagattgtatcctttttacgtgaactcagttgtgtgtgtgtttagttccatggaattttaaccacatgtagacttgcacaatcactgccataatcaagaagcagaatagtttcatcatgaggattcctcctgctatccttgctgtggtttgaatgtgttccccaaagttcacatgttgaaaacttaatgcttaatgcagcagtgttgggaggtgggacctttaagaggtgattaggccatgagtgctctgacttcctgaatgggttaatgctgttattatgggagtgggttagttactatgtttctcatcaaaggatgagttttcccctccctctctctctctgtctccctgccattccaccttctaccaacggatgatataggaagaaggtcctcactagatgcagtcccctggaccttggacttgcaagcttctagaaccataaaaaaataaaactttgtactttataaattactaggtctcacataccctattatagcagacagcgaactaagacaatcctgttatggccgcacctgcactctcctatctccatttgtaacctgtagcaaccactaatctggttccatctctaccaatctccttttaggtaatgaaaatgttacagaacctatgtctattttcagcctgtaccagctatgtgcagactgggacaccaaaagatctattttctaatttaatccccagacacattgtttgaactaatttcagcactcccattagttttaacatatttatttttcttttcttcactgaaataaggccaaggcaaagtccctcaaacctaccgcacaaggggtttgataaacttaattaaataaatggctgctaaatgcaaaatgcttcacaagcatttacttaattactagaattaatttgatcctattgatgtccgtaggctgtgcatggagatctgtaactaaatatgcagtcatgtggtaaatattatattgctggggacataggaacaaaggaagaaacaggactgatacatttttaaggccttaaaaatatgtactcagcttcttgtctatttctatagttttacaataggaatataaatggcagtgcagaaacaccacatctctgaccttgatacttgaaaaggtgaggtctaaataaaactatttcgctgtctgaatactatcattatctttaatgagagtgggcatcacaaggacatttcaaattgtaccttaggcaataaattagctgccagaactatattcagactattttcctcaaaaatgaaaacactgatccatctgctctgtccagctacattatacatctgttcacattaatataaaaatctattctgaagagacttaatatgtctatcgttgtccttttcattgaagagcacatatctttctgagtacccctaataccagaccttcaaatgcaacaataggtttactagttactgttttttctaatggagacaaatcttgttactgataatgtttattttgcttttccttcacactcccatcttcttcccaacagaaaatgtgatgatttcctcaaagatgaccttcaatgctaatttagagcttgtgtaagatgtagcaagtcatttcatatacagtggatggtaatctctgtcttgagctttactaggtattgcagagaacaaagatattgccatacaatttttaagtttagctcaatttaacctttaccaaaggttaaacaagagagatcaaaatgctaatccaaggatttccatacatagcagtggagaaagagaaaggaagtctacctaactcagactgatgatatggaaaggctttctggaggaaggaagccttggatttagtcttgatgaacatacatattacaccgatatgtcaccatgttgcacccttgttgcactgttgctgttctatactgagaaggagccaccctgcactcatatagtgaacacctactcatattttaaagcttaccttaatggtgggaacatttatggtgtcttctctacctctgcagaaaagattactttataattacaagcagttcaaaaaatgcttgtttatggaacaatgtaaaaccaacaaaataagtcttcatcaaacaagtcttgcttttattcttattccttcttcctcttcctttccattctctatacataacctttataaaaatgctgttttcttaaaaaagataagcaaatacaaataagttcatacccccatttattagataaacattagcatagtatacatgcattgtctgtgcttttctctcatagctatatattcagaagctcagcttgtagtgttacgtgtggggatgcttcattcctgttcaaagctgaactatattccatgagtgcaacatagtttattcaactagtcctcaattgatgaacaccgaggatgatttctgtctttttgcaagcacaaatggtgtttttaaaaaaatatggaaacatcttttttcccccattttttaccagtgtttcttggagcagatcactagacatggtgtttctgggtcaaagtttaaatgtatctgtaattttgctagatattgctaaattccacatttaggatttgtatgatttttgcattccctctcagccacatatatatatgtatacgtgtgtatatatatatgtgtgtgtgtgtgtgtgtatcaaaataaaaggttaaatggacaaatatttatatataattagcaatgatccaatatctatgctcatgatatgagtgaccactcatagaaaaataaatgcaaataaatctacaacacataaaaacatgtctgaccttgcttataggaaaaaaaaatgctaaagaaaatgacattgaaatccaatttttcacatatcaaattagcaatgatccaaaagattgacaacactccactgctaagcctgctagggaaaaggcctttcccctataatataactaatattctcattttcattagcacttatttttctataagtaacgtcagacatcttttatgtgttttagatttatttgcatttatttttctatgagtctccactcatatcatcagcatatattcctataggttgctacctattgtgtctttatttttaacttgtaaaagtatattagaaatgttagtgctttgtgatgcaaattgtaatttttcccagtttgtccatttgccctttttttgtttattgtatcttttgccattcaaaaatgtttgtttatttttttaatttattttgaatattaggaaatttatctatatttttgttcattgcttctggattttgaatcattgttagtaatacttttgctgcttctaatttacatagaaattcagccttgtttttctctagtacatgtatgtattctatttttcaatatttatttatttatttatttattattattattatttttttaattatactttaagttttagggtacatgtgcacatagtgcaggttagttacatatgtatacatgtgccatgctggtgcgctgcacccactaactcgtcatctagcattaggtatatctcccaatgctatccctcccccctcccacctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtttctgttcatgtccttcgcccactttttgatggggttgtttgtttttttcttgtaaatttgtttgagttcattgtagattctggatattagccctttgtcagatgagtaggttgcgaaaattttctcccatgttgcaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcatcgtttattaaatagggaatcctttccccattgcttgtttttctcaggtttgtcaaagatcagatagttgtaggtaagtggtgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggcaatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacaaggacaatttgacttcctcttttcctaattgaataccctttatttccttctcctgcctgattgccctggccagaacttccagcactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttgtagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgctacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagacatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttctgatctttgttggtttaaagtctgttttattagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgaactttttctctggctgcccttaacatttttttccttcatttcaactttggtgaatctgacaattatgtgtcttggagttgctcttctcgaggagtatctttgtggcgttctctgtatttcctgaatctgaacgttggcctgccttgctagattggagaagttctcctggataatatcctgcagagtgttttccaacttggttccattctccgcatcactttcaggcacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacttagttctcgagccttgggtttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcgggcgcccctcccccagcctcgctgccgccttgcagtttgatctcagactgctgtcctagcaatcagcgagattccgtgggcataggaccctccgagccaggtgtgggatatagtcttgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaccttcaatatttaaatctctgattcaattaaaatttgatcgtggtctgcagtatgaggagtggatttaatttcatctttttccatatagtttcccaattatctcaataccacatgtaattttttttgtttttctactgatttgagttgcctttatcaacaaatatctatagttgtgaattatttatttaaatatttagataaattattaaatattgaacctctcttgattttttggattaaacattcccttggccattatgtaattttaaaatacgttatttagttctgtttgctgacactatatttaaaattttgtgattgatattcatgagtgattctataattttggttttctttctttatgatgtttgtcaggttaaggatcagctttgcatttactttacataacaaatgtggaagatgggaagatatctttcttcttctgttctttggagaaatagaagtaccagtgagatgatttgttctttaaaaggttcatttgagaaaccatttactctcacaatattacaatcttactctattatctcagggagtttttttgtttttgtttttgtttttggagatggagtattacttactcagtgacccaggctggaatgcaatggcaaaaatgtggcttattgcagcctcaaactcatgggttggggggagctccttaaatacttttcctattttttataggaacaggtcgatttaaattttgtgtcagattgaggttaatgttggtaagtttaagacgctgaataacttgagatttagaaccatgtcttttttttttgcatgtgattttctcagagcttaccttagattagtgaaaaacaagtgcattctcaataaacgtgtgtggagtatttgttccataatgtgttaggcaagcaatgtaggccgaataatttagtaaacaaaagtgtatgcttgtacttcctgaaacagttggtgaattgcacatgtgtgtttaactttgtttccttacactcctcatgaagaatagtaaatggttttttttttatttttattttttaatggctctgtaagccagcagcaaatcagaggaactctttgtcgtttaccatctccaaaacagcaacttcagtgatggggtgctcataggagactgaaaattcacctggctagaaattaggctagaaatgagggaagctgaaggagaaggtagcccatctggagtaacgcactagtaacatgtatcagtagatgagcccatctggctgccacacactagtaacatgtatcagtagatgagcaatgatgtgtgtaaatctacagtagcacatcctgcccttcattgaccttacacacatggaatcaatgtctgtgctatgctcttgcacctgccgcatctcatgtaaaatgtctgttgtgggatatgctgaccagagctatgcaaggaaaggaattctggtaaatgtagttccagtttggcttaaattgacacaactcgaatccaccacaatggcatgacaaaaggagacaaatacaggggcacacacacaaaaacccccaaaatacaacaacaatactcagagagagagagagagagagagagagagagagagagaaagagagagaaagagagaagcaaaaaccacaggggaaaagggcaagaaaatgttgaaagcagaaagtgagtagacgaataggaacaggtaacagattaacataattataatgctgaatcttaatttacatgcagtgaaatccaagaaacaaacaaatccacattacaaaatcccccaaaggcacagaagtaggaatcatcagtcacctttgcaagtgaaggtgaaggtaagataaatacaggaagagtaaatctacatctgtgtaagaagtagttagattatcaatcctctttccagttgtggacacttggtgattgctccttcaccactgagagagaagactggaagtttttcttttggagaaaacacaattcctaaaactgagagaaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaaagcactattacatgaaatgtaagatagagaccaaaacaaaacacacaacaattaaagcaattaaccaaacaagcacagcttaaagggaacagcctatacggagcaaagaaaggatcaaaggtactgtaatatgattaatattcttagagacatgaatgaagtattgcgtcaatgagtcaagcatcacgtgctattagagaaaataatattcaaaggaaaaaaaccaatcttctataattttaaaaatactacaactgaaatagcttaaaacggaaacaacccaaatgttcttcagtggattaattattaaactgtagtatgtccatgttatgaaatactactcagcagtgaaactggaattgacaactgatacatcacaaagcttgaatggatctcaagggaattatttttagtgaaaaaggccagttttaaaaggaatatccagcttgagggtgaggagatgctttggggagacaactgtaaccagacgggtagctcaatatcccgtattacagcaagtcagaagaatccagaagatacttttgattttcaaacacattttcaaacatatgaaaaagataaaatcggccaggcgcggtggctcacacctgtaatcccagcactttgggaggccgaggcgggtggatcacgacgtcaggagttcgagaccagcctggccaacaggtgaaacctcatctctatgaaaaatacaaaaagtagctgggcatagtggcatgtgcctgtaatcccagctactcgggaggctgaggcaggagaatagcttgaaccaggaagtcggaggttgtagtgagccaagatcatgccactgcactccagcctggcgacagagcaagacttcaccaaaaaaaaaaaaaaaaaaaaaagaataaaggcaatatcatgtaattgtcccacatgtatccttcattcaggctcaacagttatcaatattctctcatttttatttcgactatcccctcctcacttgtttgatgcaacatcttatttatttgtttgtttgtgtttttttaaactgagacagggtcttgctctgtcacccaggctggagtgcagtggcttaatcatagctcactgcaggctcaaactcttggactcaagctactcttctgcttcagcctcctgggtagctgagactataggcacaagctacgcacccagctaattttaaattttttgtaaaaacggggatctaactatgttgctcaggctggtctcgagctctcagcctcaagtgattgtgccacctcagcctcccaaaatgttggaattacaggtgtgaaccactgtgcccagctgatggagaattttagaaacaaattgtggacatataattttactacaactacagtattcatagtgaacaactctctaacacaggacaactcatcttttaaaacataatcacactgccataattgtaactatcaaaattaaaaatacttaatataatctgttataaaatctgatctataatttttgtggttatcttaaaacatcttccctctctccctccctccctccctccctcccttctttccttcctaccttccttccttccttcttcttttcttcctttctttctttctcatcttttctttaatgtgtttgaattagggtctaaacaagatctaagcatagtgtttgactgactgatatatcttttgcatttcaactccatttttgccatttttgttgaagaaactaagtgaaacattccagtattgtagatttaactaattgcattcttacagtgtggctgggcatgtgggcctctttctgtaaattggtgtttagatcttggggctcgaatacatttatcttcaatttttgtggcaagaatgtgttttagatggtgttacatatgtcttattgtgccacattagaggcaccctgataatcacttttcatgatgttaagattgacccatgagttcaggtgttaattgaatccactgactaaaatatcccattaatgtttcaactaatggtttggcagtccttgatgatcattgtttaatcctttatctcactgggcattactaaaggatgattttcaaattctattattcttttgcagattctggtttggttattctctaaagacttttttcatggactgttaagttgcattcaaatacatttatacaagaaagacaggatatgatctctgttctttctaatattcaggacatgacttcattctctattaaacttcagaggggaccaatggacttgagtagagagacaagatagatgctacgtaggtagatagatagataaataaatacatacatacatatatacatacatacctacatacatacatgcatacatatataaattgattgatggatagatagaaactaataaattgtatatatttaacaatcaaagtgactattattttttatgcccaaattgtcccatcaaactaactcctgggctgttttgagataattccagtctttaataaaagtcttgtttttaggcaaagcaagacattccactttcattctgtacttttcatggtcccaaaattgactcagtaaaatcttttttccttttatgtgttaacttttatttagagacaactctctgtgcattaatttgcttcttgcactttcagtggtccaaatgtgaaaatgcatcattttttgaaagcattaaattataagcttaagcttattaccaattctaagatatattgcagaattttatctgtttgcattttatattttatcttttatgataagtaatttagtttctgttgataagacaattattagctttttcttgctatgtttaatagtttcataatataatagcaatatcgtttaaaatgaggttattaaatgtatttttatattttaaatttttttggtaggatacatcctactagtcaaactactgtttcaatatcaaatatgtttaaatctatacattcataataatactaaaaatattttcatccgttactttggggcaccctagggaaacatttcagcatttcgaaactgatgaattaaagtgaaagcatcaaccatgtaactcgcttttcccaaataatcttgtagtttagggaaatcaaacgatgaaggttgtttcagttttgtaaaacattcccattaataaatcaggaagggatgatagcattagattaaccacctacaagctggtttgtctttgggcaaagtacttatattttatgaactcatttacagtgtccataaatggcaatgctgttaccaggctttgccctcagagatctcccagttactgagccagcatttaaggaacaagtatatcaataacagtaggttaactaagatggtaaatcaccccaagatctcaatgacttagtgaaataaacatttattttatgttcacatcccatgctgtgtgacctgttcaatgaagtcaaacaatgataaaatccatgtctaccctattgatccatttcatttagcttcttgggatttttttctgagaattttggatgcctcactgatttgccttgggcaatggggcatcagcaaacatcatgcaagcagaggcctgacaagtactttgtttcttgctgttctgggaggctgtaccatgtaaactcccctgctacagtgtgagaggccacgtgggccgaagcaaagaactacagcttaccaccacccagcctggctgacccagcagctgactgcagatgcatgaactgcccagccaatcccagactaaatggctggcctgcagaatcatggcttagtcatgacttaaagtcaaatttggagttttatgtgtgtttgtttttatacagcaaaagaactgatgcactgaggatatagatgatggaagattagcaatatactgggagttgctgaagctggttgtgatgctagcaggatcctctctgtgctctttgtatttgaaagtttctgcaatgagaaagttaaaaagaaaatattaaatttcaatattgctttaaataattcctggttaaattatcttgttttcattttctttcaatgtttaagaactattattctaggctgagtgtggtggctcacacctgtaatccctgcactttgggaggctgaggcaggtggatcacacggtcaggaatttgagaccagcttgactaacatggtgaaaccctgtctctactaaaaacagaaaaaattagccagatgcggtggtgtgtgcctgtagtcccagctactcgggaggctgaggcaggagaattgcttggacctggcggaggttgcagtgaggcaagagcatgccactgcattccagcctgggtgaccgagcaagactctgtcaaaaaaaaaaaaaaaaaaaaaaaagaaggaaagaaagaaagaaagaatagaaagaattattatatttaacttttaaaaattattgaaaatagttttatggtttcaaaattaaaaatataagacattcagaaatgtctcactttcatctttgtcccctcccacatttttctctctctccatagttatcctcttatgttaattcttacctgaacattttggtagatattttagatagttgttagtaaatttggagttaaattagcaatttatatgtagaaaactaggcaaatgagaaaatatgacaattttaaatttcaagaaaaactaaattttgttcagaaaagaaaaagtaatcacattataatatgtagttaatctatgaatagcatttacaatgtcatatcaccaaaatagtaatcattgatgtagctaaaattattatacaactagactggatggatgggggaatggaaagttgtttttattttggggatggggggataaaaagggctaaattcccattttccaactgttaaataaatagataacttgtaaaagtaaaaaaaaaataagaagtaacaatatagacatgctatttagtcattccagtcaataacagaaaaatgaactaagaatgaaaagttatttctgtgcagaagggaagttggagctactgatcttttataccaaggcttgtggtttatgatgaaaattgaaaaaaaaaatcaggtatacaaaaactgtattagtccgttttcacgctgctgataaaaacatacctgagactgcgcaatttacaaaagaaagaggtttaattggactcacagttccccatggctgggaaaacctcacaatcatggcagagggcaaggaggaacaattcacatcttaagtggatggcggcaggcaaagaaaaaagagctggtgcagggaaactctcccttttaaaaatgatcagatctcttgagactcgttaactatcatgagagcagctcaggaaagacccgccccctaattcaattacctcgcaccaggttcctcccacaacacatgggaattgtgggagttacaattcaagacgagatttggatgaggacacagcgaaaccatattaaaaactcataaaaaaaggagaggcaacaagtcatgaaacaacactactactattaataatataggctcatattaatcaagcactttctatgtgccatatgtggattgtgtctttgaatccttactacaacagtatgagggaggctctttttgagttactgtagtctaatgagacaatttatacttcgagagttgattagctacctattgtaatgaaggattctaaaacaacacctggaaacaacagacattatcatctcagagtgtctctgggaccgtaagcaacttagctaggtggttctgtcttggtctctcatgcagctgcaaaaaagatgtccacagggctgctttcgttttaaggcttgatatggggatcttgctttggtgcccattctcagggcatgctaccaaaacttccaggctcactcctgtgggcctcttgcaagggctgccttgttacattggagttggcttctaccaccgtgagtgacctagaacacccaagatggaagtcactgttgttttataatctaatcttggaaatggtatctaccacactatcatattctatttgttagagcaagccagtaagtccagcccacttggagggaggatgtgattttgtcagcagaacatgaatcccaggaagtatctgtccatcacgggaattaccttagaggttgcctagcacaggtggggtagcttgtccacgcttccacagggagaaaggggtagccctgccaggaaaaaccacccattctgattccaaggtttatgttcttaactactatgcaactgctcacatgctgtggggtggtgtttcccttttgtgggacaacagcaactccttccacatagctgtcatcccgggaatgtgggagtggttgggaggtcaacatagacaacagctgattttcacctttgtgacaaacacccaagggcattatcaggtttaggcaaacaaaaataatctgtacattatgctcacaatgtggggcacagattgtggcactcccacatacctcctgctgcggaaagtttgctggaatgcaagagagaatgccatgagaacaaggataaccttgagttcactctaatttataaaaagtcaaaccctctcaggcttcataactttcctggtaataaattatttgagccacccctcacatttgatcatgacaaactgcagcttcctcttcctgggatgggacattagtcacaaggggcaggagttggctaggagaggagttggtactatatcttgaaagctgttgggagccactgaaatgtttaaagcatcatagggtgacatgattggagatgtagctgctgctctgagcaacagcattttgtctgaagcatcagacaacattctatattctcatatatgagacagtagatgtctcctttatacccccaacagatttattcatgttagcctaataaaatttatatatttcccaaacttgcagatttatcaaagctccctatctcaggacacctgaacctgcctctatctgagcatgcagacttttgtggctgccaatcaagctgtgagctttctggggtagagatttattgcctcctccatggttccatcctctggtggcaacctcatctgttgacacgtattaggaactcagtaaatgcttattaagtcaaaataaactgaacttcgttgtgcacttactacatgttatgtactatacttagtactaggtacataaaaataagacagtctgggccaggcgcagtggttcacacatgtaatcccagcactttgggaggctgaggtgggtggatcacgaggtcaggagttcgagaccagcctgatcaatatggtgaaaccccgtctctactaaaaatataaaaattagctgggcgtggtggcatgtgcctgtaatctcagctactcaggagtccgaggcaggagaatctcttgaacccgggaggcgagtttgtagtgagccaagatcaagccacggcactccagcctgggcaacagagcagactctacctcaagaaaaaaaaaaaaagaaaaagtctttaattagtaaaaagccatactgtatgtaagcagtaatttttttaattcatgagtcaaacattggctcaggccctgctgtgattgttgcactctgctagatgctggggcacaacatcaaatgacacgtgaccactactcttacaggttctgtaacccattgaaagagacacaatggtatttggatgatccaagctcagtatacagtgggagcaaggaggaaggtcatagagataagcaaagaggagggccatgtaagaggtgaggggccacattttgagaggcattacctctgcactgattttaaaagaatgaatgaatttaaataaatggaaaataaggctgggcctggcggatcatgcctataatcccagcagcttgagagactgaggcaggagaatcagttgaggctaggagttcaagaccaacctggataacagagtgagaccccatctctataaacatttttttaaaaaaattagtcagggtggtggctcacacctatactcccagctactcgggagactgaagtgggagatcacttgagcctgggagtttgaggctgcaatgtgccgtgagccgtgatcgtgctactgcagtctaaaacaaataataataaaaagagagagagagagagatgaatggaaaatctgaatgtcaaacatcagtatcaagccactggtactggtgtgttaaggcttggggaaaaagtcaaggatatagaaggagggaaatgaatacacatagagcaaatctaagtaggagttactgattcctgcaaagggatatgcagagccaagcaaagttttatctctgctgcctttgtctttccagccatctacgagcaatcctgcgaggtgtacaggcaccaggggaatacagccggcttcttctacatcgactcagatggcagcggcccactgggacctctccaggtgtactgcaatatcactggtaagggtgcagtagccctactcacacttaaccaccccacttcatggaaggaagcaaaaataaattcactggagggggatacctacgtgaataaaaatttgaaagaccaactggtctcctttggggaggaaatggtattctggtgagtaatgcaaatttgcagctaggttaattttcatgagacagaaaaaagaaaacttgttaatggtcttgataatgtttcactgaagcaagaattaattatcagtggttttctttagggcctccaagggcattttctctcctgaaactcaaaaacagaaagaaaaggtaaataagcaaacaaacaaacaaaactccaaatcagtgggaagccctgactcaggaagctggaaagcttgattccactctggccccaagggatgcatgacccttaggtgaatactatagtttctctgagctttatcagtgaaatgagaataatagtggctacccccagagctgtgagaattagatacaatcatgtgtattggagcagctagccaggctggttgttcttagatgcctaaccaaaacaaaacaaaatgaaaaggtgagttttttcatttttctctggaaatttcttgatagcttaaacttatttctcaaatgcagaaggacatggtaagaggcaatcattacatgggcttagaaatgacatatgatccttaatttaccatgaaatacatttccacaaaaccaaatcttgaggtaatcattatttaaaaatccagctatgcagccaggtgcgatggctcacgcctgtaatcccagcactttgggaggcctaggcaggcagaccacgaggtcaggagatccagaccatcctggccaacacggtgaaaccctgtctctactaaaaatacaaaaattagctgggtgcggtggcatgtgactaatcccaactactcccgaggctgaggcacgagactcgcttgaacccgggagacggaggttgcagtcagccgagatcgtgccactgcactccagcctgcgacagggcgagacaccgtctcaaaaaaaaaaaaaaaaatccagctatgcaagcactcctattatgagcatcattaattggcacacgcacattttttgtttgtttgtttgtttcaagcactggtcttcagagatgccagctgcatcatgtaatgaagcaggaacgtaggggcctctttaggctcattgagccttcaggcctcaggattttctgcaacaaagcaaccacatttatggagtgctttctgtaggcagacactgttttagatacagagggtatgaaaagtaagacacagtggctgttgttcatgaggcagtaaagtcaggaacactaccgtgaggtatctccagctaaatgcaagaaaactattggaaagaaatggtgagtaaggaagcacagtaatttgcccatctggatacaaagtcctatgctgtctgcgtagaaaatgctggtgacctggcattgggtgccacgtccttgcatttccgtaataactttctttatctctccaaaatggttgtatgatagctgcttttcaaaagccctgtaacataattagaaattgtgctcctgttgtcttttcatggttgtggtaacctatagtgttcaacaacctggtcaaaaactaggcttctcagtggatctcggttattttaaaaatgtaattaacatatggactcttgctaaaaaggcagatttcccagccccagaaattccaattcagtaaatgcacttttactgagcttttcaagtgattctgatgcaaattgtccctgttccacttttccaaaaaacagggaaagtaatttggctgcaaataaggcaaaagagataaatgcccactgctgagtggccaggtgtgacttgtaataataagagtggtataatggacagcaattactgagcttcgactctctctgggaattgagctgggagtttacaaataccatctcttttcatcctcacaacaaaaatcagaggcagacattttttttatctccatctaacgtagaagggaagagaatatgagcatttcatgactggctcaaggtaaattctgtgactaacagtcaagacttaggaagcgggcatagccttctggttcagtaataattcatatcactaaaatgttaattggatatgttctattacatacattttgtttttaaagtgttgttttattgttagaaaattttgtaacaataattgaagaaattttgagggaaaaaagtatgaaggaaatattaaagccaactgtaatccgcaatccagagattgccattgttattaaattattagaatttcctcaagacattttaaaatgaatgtttatgtgtgtttttgctatgaatgtgtatgttatatatatacatacagacacagaaatatacatatacatttaaattataaattttaattttaatgtgttgtgtagattttccctattaaaatatatattgaaattaagataaatatagcttagaaatgttaaactcttcaaaataatgcaaggacaaggacttagagagtctgactgatacataggtttcatgtacatgaaactctctgcctcaccatccaacagccttctcccagggtttatgtttgatcatttgtccaagaatggctaaaggtgagtgtgtacttgtatttaaaggttactgttttgctgatatgatcctgaagaaatcagagcctctgaattgtgtcccgagttgatcagcttgatgcgtatggtggggtatttattttgaatatgatttttttgggtcatattcagctgcacgatgtctaactttctgtttttgttttttaaaatacctgcaaaaataaaagcagaccaggcatagtgattcatgcctgtaatcccaacactttgggagaccaaggcaggaggatcatttgaggtcaggagttcgagaccagcctgaccaacatggtgaaaacccatctctactaaaaatacaaaaattagccaggtattgtggtgcatgcatgtagtcccagctacttggaggctgaggcaggagaatcacatgaacctgggaggcagagattgcagtgagccgagattgtgccactgcactccagcctgggtgacagagtaagactctgtctcaaataaataaataaacaaataaaaataaaataaaagcaaagctctgtgtaggctgaactacacaactctcatatttaaatggaaaacaattttctgatacatacatgtaatgatgatcaaatatgcatctttctatttgaaaattttataagttgaatgttgttaaaacatgagtgacttatcacagtatgaaaagtgtgacacagtggtccagggaagagagtcaggaagaagggagagaagaaacagaaggaaacttgtgctatctttaacactgggataatcccagaatgggtgtccagagcaccagaaggcaggaaaaccaagctctctttctgcaccttgtgcctgtcagctcagttaagtgcctggggcccaagcccacatctgtaaaattaagatctgggtcctctggcttccacagcctttcctcgttgagaattctctgagcttttctttgaggttccagagaaaagagacttttcttctaagaagtctacagatacttgcaaatggatgtcatgggactgaagatggacaggtttccattgtagaaagcaatagtacatttgagtcccagctgtctcctcttacagtgcaccctggggaacgttagctcccccttcctatatgcaaagtagtccctaacctgtcctgggagatgtaagtctgtgcatctcacctgcacacagggcagtcttcaggaggggagttccccaaatgctcaaccagcaaccaccctatgtaatgtaaaaagccataatctctgtgaaaggaaattaacttaagggagatgattaagcttactgataaagtggactgaatctggacctccgcacacttttgacggggtgccatccttggaactatgttctaagttgcttcaccacagggctatcagatgggagacggggagagcacaatttttggttggagaattgagtgaagtgatggataaggaagttaaagagtaagcttccagaggaacacacacttgtcagacttttaacaatttttttaagtgatttacaataaggttcagccaatataattttactcaatataaatttgggcattgtgggcactgtgaaagtgctgtagttttaatagtgtgtctatattagtttcctagggctctataacaaactacataacactggttttatttcacaccactgcaataaaatgagtatcacaataaagcaagtcacatgaattttctggtttccaagtattaccgcaaaggggtcctgatccagaccccaagagaaagttcttggacttcactcaagaaagaatttggggagagtctatacagtaaagttaaagcaagtttattaagaaagtaaaagaataaagaatagctattccataggcagagcagccccatcggttgctggttggccatttttatggttatttctggattatatgctaaacaaggggggatttatcatgagttttccaggaaagtggtgggcagttcccaggactgagggtttctcccctttttagaccatgtatgataacttcctgatgttgccatgacatttgtagactgtcatggctctggcgggagtgtctcttagcatgctgaggctattattattagtgtataatgagcagtgaggatgaccagaggtcagttttgtcaccatctcggttttggtggtatttggccagcttctttgcagcatcctgttttatcagcaaggtctttgtgaccagtatcttgtgccaccctcctatcacatcctgtgactaagaatgccttaacctcctgaggatgcagcccagtaggtctcagccttattttacccagtccctattcaagacggagtcactctggtttaaatgtctctgacacaagttcatataaaagttatgtttacactacatggtaaactattaattgtgcaatagcattatatcaaaaaaaaaaaaaaccaaagtctatgtcttaattaaaaaaatactttactgctaaaaaatgctaacaaccttctgagccttcagtgagtcttaagagaccccatcatttttgctggtggaggaaaaagatgttagtggctgctaactgattaggatggtggttgctgaaggttggggtggctgcggcaatttcttaaaataagactacaataaagaatgtcacataattgactatttcttttatgaaggatttctgtgtagtgtgtaattttgtttgatagcatttcacccacagtagaacttctttcaaaattgaagtcaatcattccaaattctgccactgctttagcaactaagcttgtggaatattctaaaccttttgttgtcattttaacaatgtttacagcctcttcaccaagagtagattccatctcaagaagccactttatttgttcatccataagaagcaactcctcatccgttaaaattttatcatgagaatatagcagttcagtcacattttcaggttccacttctaattctagttctgttgctatttccaccaaatctgcagttactccctccactgaagtaatgaacttctcaaaatcatccatgaggactggaatcaacttcttccagtctcctgtttgatattttggcctctcccataaatcatgaatgttcttaatgagatctacaatggcaaatgctttccagaaggtcttcaatttactttgcccagacacatgggaggaattactatctatggcatttgtagacttataaactgtatttcttaagtaataagactgaaaagtcaaaattactccttgatccatgagctgcagagtaaatgtgatagcaggcaggaaaacaacattaacctctttgtagatctccatcagagctcttgagtgacctggttcattgtccataagcagtaatattttgaaagaaatcctttttttgttgtttatggacaggagttctcaatggtgggcttaaaatattcagtaaaccatgctgtcaacaaatgtggtcccatccaggctttattattccatttagagagtacaggcagagtagatttagcataattcttatggatcctaggattttgagaatggcaaatgagcattagcacttgcattagtccctaccaagagatacagcctatccttggaagctttaaagataggcattgtctttcttctcttctctacctctgataatcttagatggcacctattgcttagtgtagccactttcatcaatgatctttgttataccttatgggtaacttacatcagcacttgctgcttcaccttaaacttttatgttacgaagatggcttctttaattaaacctcatgatccggcctctgctagcttcaaacttttcttctgcagcttcctcacctctctcagcctttatagaattgaagagggttagggccttgctctgggttaggctttggtttaacggaatgtcgtgcctggcttgatcttctattcagcagctaaaattttctccacatcacccagaaggctgttttgctttcttatcattcacatgttcactgaagtagcattttaattttcttcaagaacttttcctttgcattcacaacttggctaacttgcacaagaggcctagcttttggtctatctccactttcaacacaccttcctcattaaggttaatcatttccagcttttgatttaaaatgagagatgtgccactcttcctttcacttgaattcttagaggttattgtggggttactatttggcctaattttgatattgttccatctcagggagtagggaggcctaaggagaaggaaagagacagaaatcattggccagtagagcagtcagaacacacaatattggtcaattaagttcattgccttatatgggtgcagttcatgatgccccaaaacaattagaataataacattagtgaccactgatcgcagatcaccatagcaaatgtaataataataaacaatttgaaatattgcagtggtggattcgtggctcttgccaatgttcaggctctaaggatataacaatgataataatataatataataacgataattataataataatatacataaattaccaaaatgtaacacagagacatgaagtgagcacacaatattggaaaaatggtaccgacagacttgctcaacatagggttgccacaaatcttcactttttttttaatgaactatctgtgaagcacagtaaagtgaagttcaataaaacaagctatgcttgaaccagagactgggtgacttataaaacagaggtatattttctcacagttctagagcccagaaatccaaaagtacctgcagtgccacacttcctgttaaacctgtagggtgaatctcttcttgccacttcctagcttttgatggtttgctcaatccttggcactccttcacttgcagcctcagcactttaatctctgccttctagagattgctaccctgccttcatgtgatgttgtcacgtggccttctcctcccatgtgcctgtgtgtccatttcttttcttcttacaaggatacccttcatactggattaagcccaccctaatggagtgtgacttcatcttaacttgtttacgcctgtaaagaatctctttccaaatagattacattcacaggtacggagggttaggacttcaatatattatctttctggtgacaaaattcaacccttaatagtattatttcagtcttcttcacagactaatcaaggagatgacacagcagcaattaacgtataaggacaatgacaaggtgtgcatagtgcttgttgggagctcacaggagagaccctaacctagcctggtgtgcagtgggaaggctactgggcagcagataatgcctctgaaacctgaataggagtagaagctggtcaagagctgcaggaaagcatttccaggaagacagaatgaagggcaggaacaaaggaccagcatccctagaacctgcatgtttttaggagtcaccaacccactgagctgacttgataggttggaacccagaaaatctcataaagctgtgactgaacagaagagaaaggatcaaattgacttgagcagcagcaagcaaaggctgttgaagctctgtaatctgaactagagtttcccagcacaaacatctgctgtctcagattcaacagaatagaaaaggaggaatggctttatcatagatagctcttcagcatgtgagactatttagctggccctgaaaaaaattaaaaaaaaagatgagcaacagactaagaggtagcaacaagatgtcctcacagcatgcatggaccttagcactgaccccatatcttgaggacagtggatctctcgtatggcttgttcaaattagggactattcataaaggtgtgaatatataaaaggaatttatagtgtagggactatagcacagagatactaacagagtgggaaaaaggcacatgttcagaagctgtgcctctggagatctgtggccccctgtgtgggaagcagccagctcaatccagtgaccactttgacctcagtctctcgttgctccttctaggctcctttctatgctcccctctgatgaaacccaactagaatcgagaatgcaggagtgcgtattgatagaatgcttttagtcagccttcctgcgcacagagaaggctggagatgtgcagaaagtggaactggtggggcaagtggaagatttccatattgacctgcttaaaggactgaccaaaaacgtctggggaaaatgattaaaattcataagaattaaggatggtggtgagggtaggggctgtaagtggaattcacaaaccatccaaataaatgaagcgtagacttgttaaatcaattttaacctgaacaagaaaagaccactctttatgggttaaatggcactaaggttagaatgaatgtaagaaacacacactgaataagatatttagaaaatgacctactccaagatttaatacaggtactcaatttataaacaacctagaaacaagtaaataagtaagaaaaactgtgacatgcttaaacgtaatattttgtcaaaaggtagttctcggcttcatacctccatcggatgataaaaatctggaatggatgcagagcatttcagccaatgatgtaggagtttgtgatcatcctttgctgcaccaatctaattgggtcggtagggaaagatgcatttgagacaaccaggagtccactggggactaagaattgggtttctggatgaaaatgcacataaggagaccttgcaggatgggtgagatgtcaccaggaagaaaaggagttcttggaactgggtcccatataaaagaaatggagaaagagcaggtcacagtaactaattgaaatccgtgaacacctgaggtggctgtataggaagcttgggttgataaaacagaagaatcggcttctgaggtggggcgatctgcccttggggtgatggttaattttatgtatcaacttggctggaacatggtacctaatatgtgaacatactgtcctgaatgtttcctgtaaaagtgtttttggatgagataaacatttaaatcagtggactttgagcaaagcagattgacctccataatggggatggacctcatccaatcagttgaaggccttaatagaacaaacactaacctctcccaaatgaggaggaattctgaaagcagatgtctctggtctggaactgcagctacttcctgggtctcttgtctgccagcttcccctgcagattttgggcatactaaaccttcataatccaatttcctgaaaatcaatctccttctctcactgtctcattcatatatatatatatatatatatatatatatatatatatatatactccttctctcactgtctcattcatatatatatatatatatatatatatatgtagtgcacacacacacagtttagtttattcaggtagttctgtctctggacaaccctgactcatccatttgggtgtctcaagatgggtttaatgcccctactctgtgttctgctcatgacattaatcacactgcattataatgcagtgtttacctatgtgtccccacagggctgtgagctccttgttggaaaataaggaacagggtgtgatgaatctttggatctacttttatacacacttgaatgagtctagtgtaaattgaactctgagaaatcactgccaaattgaagactaatttctatctttcccgtttttttctttcctgtttccataatctatctttgactcaagccctgttccattaaatcaataacagtttgggatgttggaaacagcctcagtatttaatcttgactgagcttgagtcattcctactctttgcaatgccttctataagtccaagagtacagagtgcccatctgttcctcactgccttcatgactgtttgttgctgctcaacctctctccaagttgctgtttccttcaaacatagaaatgactaatgggtagaaatatgatttggagtcacactggagtttaaattctagcacattctagctgtatgaccttggataaatcatctaatatttctagatcttggtttttctagctggatggccttggataaatcatctaacatttctagatcttggtttttttatcagtagtgtggagacaataaaaaattggtgacatgtaagattgtgagaattagcatatatatatatgctacacacacacacacatgcacacacacacacacacacacacacacacatatatatgcaaactttctagccttaaaaagtagatggtcatttaatatgctaatgtaatgtcatggtgtgattattaattgtgtctacaaccactcttacagttgacatagtatgaatgatattacatagtcattctagtcatgaaagatagctatcacctttgccagcgatagaaatagaatctttacttgtataggcaccatgagatttcagaggctcttggagcctggagagagcatttctgctgggactccttcaatattgataaaacagaattataagggtgaggcaccctgacaagattttccttgaaacttgacattaaactgattctactcagtttacattgtgccttttttaatgttaacaggacacactgtcaatgtgttaaaagatatttcttagctgtatactgtttttcctttgtacagtacaattgtacattgatatgcaaaattgtttgtctagaatcactagcaaaaacacatttatttcttatcttgatggattcaatgccaatttcatgcatgtggatctgtaaggcaatcatcaggcattacaaggaatttgcaaggaacatttagtcaaatctctaaagcgaaacttattttccattctcaaacagctcataatccatttgcaaaccaacttacaagtctccatatcttgtcactctggctattatgatgctctgtttctcactcctttggcagcagcctctgttttcattaaaactcatcaaagcatgcataatggagtaggtagaaagctgcaattgaggtctctccaatatttctgcacataattgtgcagtgtgattgcagtaatagattatcatcccaggtattgacataaagaaagaaatgtatccatgtggtttggcctaaattggtagccttgcttcctgaagttagagcgatgtcagtgaatttacctgtgggctgcacccaggtctgccagtgtaggggaaatgagaatgatccatgacataaaatgggaccactggttatgaaacatttatttctccccagccttcttaggatgttgttaattttgccagctgtatcatatagcaaagtaagtagaatttagttgattacgtgatttgtatctgtaatacaatttggtactggtatctccttgcagattcctgtttgaaaacactctactttctttttttttcttcaacttttattttaagttcagtgctacatatgcacgatgtggaggttttttacataggtaaacgtgtgccgtgatggtttgctgcacagatcaccccatcacctagatattaagcccagcatccattagctattcttcctgatgctctcccacccccgaacccccaccctttgacaagctccagtgtgtgttgttccccctccatgtgtccatgtgttctcatcattcagttcccacttgtagatgagaacatgtggtgtttggttttcctgttcctatgttagtttgctgaggataatggcttccacctccatccatgtccctgcaaagacatgatctcatttctttttattgctgcatagtattccatggtgcatatgaactatattttctttatccagtctatcattggtgggcatttaggttgattccatgtctttactaatgtgaataatgttgcaatgaacatacacatgcatgtatttttataaaaggatgatttagattcctttgggtatataaccggtaacaggattgctgggtcaaatggtatatctgcctctaggtctttggggaattgccacactgtattccacaatgggcgaactaatttatactcccaccgacagtgtaaaagcattcctttttctccacagtgtcatcagcgtctgttgtttttactttttaattgtagccatcctgattggtgtgacacgatatctcattggaaaacactctactttcaaaacccacacacactcacacacacactcacacatgcacaagtgtcaacttccattgccctacttcaggcttatacaaaagcaagctgagttcaagttctgaagtttgcttttttatcacaagttgggtaatcatcattgcaaaagtattgttaccacaaagttgtcatttgattacagactgtaaaatattgcacagaatatctacagggtaccaagctagtacaacatgcattatgatgaagtagctggaataatttttattttataagtgcacgaatgaggctagtaagtactagaaacaggataccaattatagctgtctagagatgaagcttctgccctgtatgctgtgctttttatcaaagggtagtaaggcatgggtggcaacacttcctctactatgttgaatcaatattcattggttatctgttctggccaggcactgacaagccactgggaatatagaaatgattaagatatggtcctgcaagttcacagactttataatctcatgtccttgtgggaaaaaatgcccatgtcttcagctttccccatcgtgattcataattcacacaacagctaggctgatctttaaaaaacacagggatggccatgtctccccatcccttccacctctacctgaataaattcccatctcctacccatggcttacaatgtttgaagggcatggttgtgaatctttataagtttatatgcatcaatgaaaactcttagaacagtgcccataatcactacaccttctgaattactatattattgtctaattactttgtggggacatgagtaaaaccctccatctttatactttagtttctctgtctgtaaaaggagggtgatgatgacagctttttatggttgccacatagtcaattgaatgagttaacatgtaaacaatgtcagaaagtgacagtcacagagaaggtgggaaagaaagcctagatccttctccttatcttcttttgcctttccttggaaacacatccactgtctttagggacagcaggtttagttcatcctagggaggagctcacaagctgagtcccctggtggcacaagcattgtttcctggttgagactcactcatgggtgacatatgtgctgtggctcactggtagtttaatcagttggaataatacttgtattgttgcttatatttcagagggacaatttgctttctgtaaatgaagcttttccagaggactattttaggctgaagaatagtaatttaacagcttagaggtgggaatttttatttaagtgtctctcttttctctctaatgggtttatgatgttgaccaaagtgtggtgaccacatagggcttccagaaggctggtctcttaggcgaagctctggagctgctctgcgtgtgttgaagggctgagctttaaagtggtctctctggactagtggcagaaggcataatctcctgctaaattgggccattaaataaaactactaagtcataaagctgtagtattaccctgaaattaaagcattgtcacctttgagttgccaagaattttaacaggcacttagagaaattcctttcacatacccgttttagcacggccagttgactccaacccacatggatggtagcaggaggctcaggtgattgcagtgtgattttaattcatttacttgatcattcattcatccatccctccctttactaacttatttgctgctttcttgaattcctttattatcttctcatttatgtattcatttgttaattctctcatttatttacttcctcatttattttttcaggtttttaattacttacacattattcattaattcagtcactctgtcaattattcagttggtaattcagaaattaagtaattcaaataaacttttgaatattgactgaacttgacatcaagtttacaaaataaataaatctgttcttgtcctcaaggaattcacagtttggagaagatggacattgtaaatggatattttgcacagtgtggaaaatagaatagaagctggtagatggtacagaaatagtacaaaggaaacaggggttgaaagtacacaaggaggctgggggtggtgggcagagaagatgcccttgaagagctgccctctgagctgaattttgtagtagaagcagctaacatttatccagcagctgctggtattaggcaccatgctaggtattttatattcaagatgttatttgattttcttagcaatccatgttacagagataggcaccatctggagagactaagcaactagcccaaggtctcacaaggagcaaacggtaaagccaggaatggaagctatgggtgaggttgtgaggctgggttattaaggccaggtgacacagtctctgaaacagagaaagcctcctgtgtccaaacagaattcccctctggcctgcattgccctgtctcttgttcacagtcccttaactcaatgccatggtggaaaactcctccaggaagtagccttgaagggtgagggctccattatacccactttacctccgtgtccgtcactttcctcatctgtaatgtgggggaaatcatacccacttttccaggttttcctgagtatcatatggaaattatataaagcagaggttcacaaagcttagttttctaaagcatgagctgggatgaacatttaagacgctattttctaggcctattcccagcaatgtttattcagtaggtatagcatagtatacttactacagtatacatagtatagtatacatagtatagtagtgatcagaaatagcatgtttagcaagcacctgaagatactggactttgggatatatctatataaggtgattagcacagtgctcagtgcttaataagtccccatccttatgtatctccccacttccgaggggctcaggccagggcctagaatcgctgctcttctaagcactgaacacagggcttatcctgactccttccggatgggtcttttcatcttttactgcagataactggtgagtctcatttttggcatcaggggattgggagacagtccagtcaacaaagatttattgaggcactgcttgcgtaatgtaagctgctggtccacacacaaaggacctcacactgtaacaagaaaataaagccatccatctcttacagcaattttagctaggccattttatttattcgtacaactatcctgtagcaacttgacaatggaatcctggtcaagttgcctaacttttatgaggcttaatttcctcatctgtataatagaaatgatcacttattcttacctcaatgagttgtacaaaattagatagaattaaataagcaaatgtacccaacacacccagtacaatatctgacatgccctaagacctcctaaaataaaagtaatcacttttatttcagagccaacatcatagaatgatctagatgctaaaggaatttagagacaggaatagtcaaggaagcattatgggagacactaggcttgggtttgaccttggaagacaggtatcctggggtgtgttagtccactctcacattgctataaaagttatacctggtaagaaaggggccgagatggcagaaaagaaacagctctagcctgcagctcccagtgagacgaatgcagaacgtgggtgattactgcatttccaactgaggtacccagttcatctaattgggactgactaggtggtgggcttgacctacagagaatgagaagaagcagagtgggtcatcatttcacctgggagctgcactgagtgggtgtacctccccgctgagccaagggaaatggtgagggactgtgctacctgccaagggtactatgcttttcccatggatttttgccatctgtggatcaggagattccctcgtgagcctacaccaccagggctctcagtctcaagcacaaaactgggtggctgttcgagcaggcactgagctgcaagagtttttacatacatcgggggtgccttgagctccagtaagacaggagaacagtccactcccctggaaagggggctgtagccagggagccaagcaatctcgctcagcaggtcccacttccatgggcccagcaagctaagaaccactagcttgaaatccccgctgccagcacagcagtctggagttggcctgggaccactgagttcccggtgggaggagtgaccatcattactgtggctttagttttcccctgacagtgctaaggagactgggagatttggactgagcagaattcaccacagtgcagcaaaggagctgtggcagatcatggctagatggcttctttagatccctcctcactggagagggcctccctgtaggaaatctagcagctatagtcaaagacttacagaaagagctctcacctccctgagacccagcatctgcggggaggggaagccgtcatctcaggttcagcagacttaatctttcctgcctgccggctctgaaaaaatcagctgatccaaatgaggaggattccccccagcacagcacaccagctcccctaaggggcagactgtcttctcaagcggatccctgaccctgtgcctcctgactgggtgagacctcccaacaggggtcaccagaaaccacagacaggaaaatcccagcggacatcaggtcagtgtccctctaggatgaagcttccagaggaaggagcaggcagcaacctttgctgttctgcagcttgtactggtgatatccaggagaaaagggtctggagtggacccccagcaaaccacagcagacctgcagaagaaaggcctgttagaagaaaaacaaacagaaagcaacaacaacatcaaaaaaaaaaaaaaaagaccccacaaaaaccccatccaaagttatcaccctcaagatcaaaggtagataaatccatgaagatgaggaaaaaccaatgcagaaacactgaaaaatcccaaaagtcaaaatgcctcttctcctccaaatgattgcaacgtctccagcaaggtcacagaacggagctgaagctgagatggatgaactgacagaaatagacttcagaaagtgggtaataataaacatcactgagctaaaggattatgttttaacccaatgcaaaggagctaagaaccatgataaaagattacagcagctgttaactagaataaccagtttagagaggaacataaatgacctgatggagctgaaaaacacagcacaagacaatcataatgcaaacacaagtatcaatagccgaactgaccaagtggaagagaaatggcagagcttaaggactatcttgctaaaataaggcaggccaacaagattagagaaaacaaatgaaaaggaacaaacaaagcctccaagaattatggtgctatgtaaaaagactgagcctactactgattggagtatctttaagagatggggagaatggaaccaagttgtaaaacacacttcagtgtatcatccgggaggacttccccaacctagaaagacaagccaatattcaaattcagaaaacccagggaaccccaataagataatctatgaaaagatctaccccaggacataatcatcagattctccaaggttgaaatgaagcaaaaaaatgttaagagcagccagagagaaaggccaaatcacatacaaaaggaagcccatcagactgacagtggacctctcagtagaaactgtacaaaccagaagagcttgggggccaatattcaccattcttaacaaaaataaattccaacccagaatttcatatctggccaaactaaggtttatgagcaaagaaaaaagtaaaatctttttcagacacgcaaatgctgaggcattttttcaccagcaggcctgccttgcaagagctcctgaaggaagcactaaacatagataggaaaaaccattagcagccactacaaaaacacactgaagtacacagaccaacaacactactaaacaactacattaacaagtctgcaaaattaaccagttagcatcatgacagggtcaaattcacatataacaatatcaacattacattaaatgggctaaatgccccaaataaaagacacagaatggaaacctgggtactaagaccagacccatcagtgtgccatattaaagagacacatctcatgtccaaagatgcacatagaatcataataaagggatggaggaaaatttatcaagcaaacggaaagcagaaaaaagcaggagtagcaatcctagtttctgacaaaatagactttaagccaacaaaggtaaaaaaagacaaagaagggcattacatcatgctgaagcgttcaattcaacaaaaggagctatttaaaatatatatgcacccaatacaggaacacctagatttataaaacaagttcttagagacccacaaagagactcagacccccacacaatgatagtgggagactttaaaaccctactgtcagtattagatagatcacggagacagaaaattaacaaagatattcaaggcttgaatgcagctctaggccaagtggacctgatagatatctacagaactctctaccccaaagcaacagaatatacattttttcctggcaccacagggcacttactctaaaattgatcacataactgaaagtaaaacactcctcagcaaatgaagaacaactgaaattataacaaacaatctctcagatcactgtgcaattaaattagaactcaagattgaaaggtccactcaaaaccacacagctacttggaaattgaacaacctgctcctgaatgactcctgggtaaataatgaaatgaaggcagaaatcaagaagttctttgaaaccaatgagaacaaagagacaatttatcagaatctctgggacacagctaaagcagtattaagagagaaatttataggattaaatgctcacatcggaaagtgggaaagatctaaaattgataccctaccatcacaactaatagaactagagaaccaggagcaaacaaaccccagagctagcagaagacaaggaataaccaaactcagagtggaactggagatagatatatgaaaaacccttcaaataatcaatggatccaggagctgtttttttttttttttgaaaaaaccaataaaatagatagactgctagcaagactaacaagaagagagaagattcaaataaacacaatcagaaactataagggggataccaccattggccccacagaaatataaccatcagagaatactataaacacctctatgcaaaaaaaaaaaaaaaaaaactggaaaacctggaagaaatggataaattcctggacacatacaacctcccattctgaaccaggaataagttaaattcctgaatagaccaatatcaagttctgaaattgaggcagcaataaatagcctaccaaccaaaaaaaaaagaatcccaagtccagatagatttatagctgaactctaccagaggtacaaagaggagccggtaccatttcttctgaaacaattccaaacaattgaaaaggaatgactcctccctaactcattttatgacaccagcataatcctgattccaaaacctggcagagataaaacaaaaaagaaaacttcaggccaatatccctgatgaacattgatacaaaaatctccaacaaaatactggcaaaccaaacccagcagcacatcaaatagcttatccaccacgatcaagttggtttcatccctggcatgcaaggcttgttcaacatacacaaatcaataaatgtaattcatcacataaacagaactaaagataaaaaccacatgattatctcaatagacacagaaaaggccttcaataaaatttaacatctattcatgttaaaaactctcaataatctaggtattgaaggaacatacctcaaaataataagaaccatttatgaaaaacccacagccaacatcatactgaatggacaaaaactggaagcattccccttaaaaactggcacaagacaaggatgttcttcctcatcactcttattcaacatagtagtgttgggagttctggccagggcaatcaggcaagagaaagaaataaagggtattcaaataggaacagaggaaatcaatgtctttgttttagatgacataatcctgtatctagaaaaccccatcaactcaacccaaaagcttcttaagctgataagcaacttcagcaaagtcttgggacacaaaataagtgtgcagaaatcacaagcattcctatacaccaacaaaagacaagcagagagtcaaatcatgaatgagctcccattcacaattgccacaaagaacataaaatacttaggaatacagctaacaggagaagtgaaggacctcttcaaggaaaactaaaaaccactgatcaaggaaatcagacaggacacaagcagatggaaaaacactacatgctcatggataacaagaatcaatatcatgaaaatggccatacttcccaaagcaatgtatagattcagtgctatttccattaaactaccattgacgttcttcacaaaattacaaataactattttaaattcatatggaaccaaaaaaaaagctcgcatagccaagacaatcctaagcaaaaagaacaaagctggaggtatcatgctatataacttcaaactatactacaaggctgtagtaaacaaagcaatatggtattgctacaaaaacaggcatatagaccaatggaacagaatagagaattcagaaatgaaaccatacgtctacaaccatctcatctttgacaaacctcacaaaaacaagcaatggggaaaagattccctatttaataaggtgctgggagaactggctagccatatgcagaaaatcgaaactagatcccttccttacaccttatacaaaaatcaactcaagatggattaaagacttaagggcataacccaaagctaacaaaccctagaagagaatctaggcaataccattcaggacataggcaaggggaaagactttatgatgaaattgccaaaagcaattacaacaaaaccaaaaattgacaaatgggatctaattaaactaaagagtttctgcacagcaaatgaaactatcatcagagcaaacagacaacctacagaatgggagaacatttctgcaatttatccatcgacaaaggtctaatatccagaatctacaaggaacttaagcaaactcacaagaaaataaaaccattaaaaagtgggcaaaggatattaacagacacttctcagaaaaggcacacatgcggccaataaacatgaaaataaagctcaacatcactgatcattagagaaatacaaatcaaaaccacaatgagatactatctcacactcatcagaatggcattattaaaaagtcagatgctggcgaggttgcagagaaataggaatggttttatactcttggtgggaatctaaattagttcaaccattgtgcaagacagtgtggcaattcctcaaagacttagaactggaaataccatttgacccagcaatcccattactgggtatatgcccagtggaatgtaaattattctattataaagttacatgcgtgcatatgttcaatgcagcactattcacaatagcaaagacattggaatcaacccaaatgcccatcaataatagactggataaagaaaatgtggtacataaacagcacagaatactatgcagcaataaaaagaaacgagatcatgtcctttgcagggacacgaatgaagctgaaagctgttatcctcagcaaactaattcaggaacagaaaaccaaacactacatgttctcacttataagcaggagctgagcaatgagaatacgtgggcacagggaggggaacagcacttattggggcctgttaggggaggtgggggaggggagtgcattaggggaaaaatctaattcgtgctgggcttaatacctatgtgatgggttgataggtgcagcaaaccaccatgacacatgtttatgtatgttacaaacctgcacatcctgcacatgtaccctgtaacttgaaaaaaaaaacaataaaatgtttgtttaaaaatatacctgagactgggtaatttatttttaaaaagaggtttcattggctcatagttccacaggctgtacagggagcatgatgcttctggggaggcctcagaaaagtttcagtcatggcagaaagggaagcagaagcaggcatgtcttacatgtccaaagctgggggaagagaggcaggcagggaagtgctatacacttttaaacaatgagatctcatgagaactctatcatgagaacagcactaggagaatggtgctatttaaaaacccaccccatgatccagtcacttcccaccagaccccacttccaacattggggattacaattgaacaggagatttgggcagggacacagctccaaatcaaataattctgcctctagcccctccaaatctcatgtccttctcatatttcaaaatacaatcatgcctacccaacagtccccctaaattttaactcatgttaacattaactcaaaagtcctcaatccagtgtctcacttgagacaaggcaagtccctttcacctatgagcctgtaaaatgaaaaacaaatttgttactcccaagatacaatggggttataggcatttggtaaatagccttattccaaaacagagaaattggccaaaagaaagggggtacaggcaccatgaaactcagcagggcagtcattaccttaaagctccaaaataatctcttttgacttcatgtctcacctccagagcacattggtgcaaggggctagctcccaaggctttgggaagctctgcccctccggctttgcaaggtacagcctctgtggctgctttcacagactcacagtgcaagctgttagtggatctactatttgggggtctggaggatggtggccctcttctcatagctctactaggcagtgctccagtaaggactttgtgtgggggctccaactccacatttcccctccacactgccctagtagagcttcttcttgagggctctatccctggagcaggtttttgcctggacatacaggctttccaaataatttttgaaatctagctggagtctcccaagcctcaattcttgtactctgtgaaccctcagacttaacaccacctggaaaccaccaaggcttatggctcgcaccctttgaagcagcagctcaagctatatctgggtccctttaagccacactgaagctgaataggctaagatgcagggagcaatgtctccaggctacacagggcagtggggccctggtcccgacccatgaaaccattctgtcctcccaggcctccaggcttgtgatgggagaggctgccatggaggtctctgaaatgtctttgaggctttcccattgtcatggatattaatattctgctcctctttacttatgcaaatttctgcagccagcttgaatgctttccctgaaagtgggcttttcttttctaccacatggccaggctgcaaatttttcaaacctttacactctgctttccttttaaatataagttctagtttcaggtcatttctttgctcatgaatatgagcacatgctgttaaaagcaagcaggccacatcgtgaaagctctgctgcttagaaatgtctttctccagatactctaaatcatcactctcaaattcaaaattccacagatcccaagagcaggggcacaatgctaccatgttctttactaaagcatagtaaaagtgacctttgctccagttcctaataagtttctttttatatatgatgcacacacaggcacacacgtgtgtgtgtgtgtgtatacatatattttttaaatgaggcacggtatcactttgtcacctaggctggagtgcagtggcatgatcttggttcacagtagtgttgacatctgggttcaagtgattcttctgcctcagccccccaagtagctgggattacaggcatgcactaccatgcctggctaatttttttttgatagagatggagtttcaccatgttgctcaggctggtctcaaactcgtgagctcaagtgattcatccacctatgcttcccaaagtgttaggattacagatgtgagccactgtacctcacgtaataaatttcatatctccatctgaaatctcatcagcctggatattattgcccatatgactcagaattttggtcaaaacaatttaacaagtctctaggaagttccaaactttcctgcaccttcctgtagtcttctgagcccttcaaactgttgcaatatctgctgattacccaattccaaagttgcttccacatttccaggcatccttagagaaattccccattaccagtaccaattttctacagtagtccattcttgcactgctgtaaggaaatacttgagactgagtaatttatcaggaaaagaggtttaattagctaacagttccacaggctgtacaggaagtatgatggcttctggggaggcctcgggaaactttcaatcgtaatggaaagtgaatgaaaagcaggcatgacttacatggtgggagcaggagaaagagaggttgtagggagaggctacacacttttaaacaaccagatcccatgaaaactctatgatgagaacagtattcgggaggatagtgctaaaccattagaaattgccaccatgttccagtcacctcccaccaggattcatctctaacattggagatgacaattgaacatgagatttgggtaggaacacagatcaaaccatatcatggggctaggcaaagaagggaaaccggaggaaagacaagccttgttgagctcagcaggatcatgaatgcagagatgcaatgagaaggtccatcaagtcctcctgacttccctgggtgttctgatggtctgatgttggctgaatgaatacttttcctgtttggaagtggaaaataacaaatgggtgtcaaaggtgtctcccagaaagcctgcttgctcttgttcacttttgttctgagccccagtttccaaggagagatgatgaatcaaagtaagtctagacattccaaagaataaaagggccaagattgactgtggtccttgttctgggaagtaggcaggccaagcaccccttgcttgagagctttttcttactattcctcctgagcaggctcacgtcacaggaacaccaatcagcctgcattctcagtgtgcatgtgtttgagttctcatatttatgtctatttgtaaagagaagcaagtaggagacattgactgattgctgtccatagggacaatttcaacatgggttttccagtgctagctgtgagtagtctaacttttatgtcttacaggaagttttgctctccctctttagagtatgctgtcattttgttctcatgtaaagctcctttgaaagtcacaatttttatgcttgtaattgaaaaacatctaccaagttagttatttagagtgtgggcttggtaggaatcccagcactcacatttcctacttttggcaaattatttgacttagttgagttacccagcctccttatacctcagtttcttcctttataattaatcatagaatctatttataagtttgttgtgaagcttctatgaggtaatcgatgtaaactgcaagaaaaaagacttgacattacatatctaatgcatggtagatactgttagttattattttcattattctgtccccagaaatatagactctggtttcttggtgtttctggggacatggtgataaaaataatgactagtaactttttttgtgtgcataacacctgacacaatgaaagcactcatgaaaattaattcaacagagtgaataactacttatacttgaacatgaatgatctaccataatgtaaatggttaaatttaataatgattgtaatttagtttaaatttagtaatagctttctggtcattattttgccaattactccttaactctgtgtgtgtgtgtctgtgtgtgtctgtgtgtgtatgtgttggtgctgttataaaagcatgtgcatgtgaattttttggagcttagaataattttcagcacttactacatgtgaaactttctggcaaactatcttgttttcccagagttttattcctaaatgtccaaacctacagaaaagttgaaaaaataatgagtagccagatacccttcacgtttacgattctgccacatttgcaaatttgtgccctcctcatctctttctctttttctcctctcctcattttctcagacattttaaaaaaatttttacggaaccatttgaaagtaagttgtagacacagcgataatttaaatcgaaagactttaggttttatcttctaagaacaaatatattcttctatgtaaccagacataagaaaccattcataagaaaataagcattaattaaattaattatccaatatatagtccatgcaccaagaatccaaagtcctacaatgtgttttatagcagtgtctattttcatatttttattcataattcaagcagtgtctacaatttggaattgattgccacgacccttcaacctcctttaatctggaaggcccaactccctgaccccttctttttgcttttgttgttgttgttggttggttggttttcatgacattgatcttttctggagattaaaagacagttgttaaataaaatatcccatactttggatatttctgattatttaatcagtgtagaacattttggccagaaagtctcatgaacaatgcttgcctttttagtgcagcccgtgagcagacacatgacatcagtttgtcccgatactggggatgcttctcgctatcatttggctaacacagctctgccagatcgttgcattgtgaaggcagtttacaaccagtgagtgagttatctgtagtattacgtgagcacactatgtgaatgccctgttcctcaacatttcctcccaatatggtagggatcctgactcttttaagttattacactggaatctgtgacgtgttgcttttctaattctacaatttcctttcatatttattgctgccattctgaagtcttacctacagaagagatttttttccctttccctgactccatctccccttgtgtcgttatggactctaattcatggtccctttaattctgctccagtttcttttttacatgtgtctattaatattggagcattttcttgtgttcttgcatggaaagatattctcaatgtcaactagaactttccctaccctagaaccagactcagctcttttcctaaagaagcctacctcttttttgtagcaaatggtatttggaaaccaagacctagatgtttgtttgctcattgtttctgggccctttcagtgggcagaactaaaattgtgtgtgtgcatgtgtgtgtgtgcgtgtatgtgtgtgtgtgtgtttatgagttcataaggttatttacaaaacaaacctagttccattagattcttttctcatcattctgtcttctatatatatatgatatatatgagatatatataatacatatatatgatacatatatatgatacatatatatgtaacttctctcacagtgagaccttgtttcagcaatgtcagtatatttacccatttgctccattctgcagtatgcacacaatcatttcagaattacttcagcaatatcacatcaataacaatgtaaagttaaagatttccttgaattttaatttttatccttagaatttattctgccaagggtatatagtgagacagaatactatttgaaagttgcttaaattaacttttttcttttttatagttattttatcaatttaatgtacagctaggctttttagtttctgattaatattcaacttttggacttgccttttctttatccttttgattttaacagtgtaaagcattttcatgttacaaaagtcaaatacagacaaatatgcacacactggctgatcagagacattttgctctcattcctattgccttcatcttgttcttatccaacttttttagataactatttatatcagtttgtcctttctgtgtgtattcatttttctcttttgtaccttcacaaaatgtatcatactcttttgtgcatcaataccttgattttgtcactttacaatatacagtggaaatcattctggatcagtttacagagatcttatgtattatttattatggctgcattgtactttactgtgtcagttaacaatgctttattcgatcagacacctatggatgtgtatttaatttttttccaatattccgctatttgcaatatataacctcggctgcacagcggaatttcaagtatgtatctaaacatcctttcccaccatgtgtcactttcatgctgatttcaaaagctgtcactgaagtggataaaaattctggtagtccgttaagtgtttagtagtaagtgaatacctactttaggccatatgttagagacacggagatttctgagacaggttttcatatgtagtacttgcagtatagcatgggatactgaggaaacaggttgttgtaataccatgtaaatgcgacgagcacgggatgttggcaggactggaaaagaccacccgttggagaggccaccagcatcacacaatctcattcatcttgtgatgagctccagagtagagatgtcagctgaaagaaagatgagtaattctgctcttgtctctgagttttctttttgtcaatcccctccagaatcagaatataagctccatgagagcagagtaagtagatgctctcacccttagagaaggcgtctcttcttttctgacccggtacaaggagatataaatgctgcctttggatatctcttcaaaagacaaaggctagccctttgcaatcagctcactagctcatgacgtcctctgagttcaatactggctactttagatcttataaacagagggacaacaagtactattatacttatactattacagcacaacaaacacaagaactgtttattatgaacttgtgttccagtacattatgtacttatgtgggtccccagtcttatcctcagtgtgcaccaaaatagtttctatgaccatgatactcctaatgacctcataaagctttctaatggcaatcaaaacacttatcaacagcctcacagtcctctttccatcaggtgacttagacttagggcttcttttctccttttcctttgccccaaatgccaatacactgagtatggggggaatggtatcttgttcccacccactcccccctttgctgctgcagatactcttcccaacaggaatgcaacacaaggcagtctgccttcctagaaccagctgtgaactccctgagctcagggtccagcctgttagcgaaacttgcacccctcatccgacccctttccagtccctaacatagtgctctgcatacactaggtgtctaaattaaataataataataaactagtgaacaacaaataaacaaatatgatacagtgcacatagaatccgttccacaccactaccccctaagaccataaaacaaatttcccaggtctctttgatcatacctattttaaagcaagaaaaaagagaaaaattacccccctgaaaagatacataaaaagtaaaggctaaagtgaagtgtgaatataaatcagccaagtatgttgtctggaagtcgtaaagtgtggcccacgcaggcaggtggaaggcagtaatggacggagcccgccacgctgcggtgtctgcatggcactaatgcagagcgcatggtagccctaccagccaccctgaaccggtaatgcgcacacctccaaacagctgaaacccagacactaaaagcagccacgtctgccgtggttttagtgaggcacggatggattctcgcacagacagctgggctggtacacatgggagggaaaacagctcctgggggatttctgaagccttttaaaggaattggaaatcactttacaccaattgtctcccttccttttaaaggtcgggcggggggaaggtgcaatgtaccccctcagtaaaggttcccagaagtgtttctaataatgaaataatctcttcacatcctcccggcttcgcttcaacagaacggttcatagcagatcagctttgacttggagtcaggtaccaggtgaagggttaggaaggaggagcaggctgggcccggtggctcacgcttgtaatcccagcactttgggagaccgaggcaggaggattacctgaggttggagttcaagaccagcctaaccaacctggaaaaaccctgtctgtactaaaaaatacaaaattagctgggcgtggtggcgcatgactgtaatcccagctacttggaaggctgaggcaagagaattgcttgaacccgggaggcagaggttgcagtgagccgagattacgccattacactccagactgggcaacaagagcgaaactccatctcaaaaaaaaaaaaaaaaaaaaaagacaaaaaaaaggacggaggagcaccactcagagccagcaccacgctcagttcaaccctatgctttctattcagtgtttatgacaacactgcacaatgagttatgccgtttacagaggaggagactgaggctgggggaggtgataggtctcttgcatgtccaggaatccagtgggtggcagagctggcattggaagccagccctaatgatgacaaagctcaagcttcccctcatcacatctgcctccatgaaccatgaagccctttccaagcctatatttactagcagtcattacctatgatttaaatggagagataagggagaaacatatgaaaaattaaataactatcaatgcaaaatgacaagagatatcacaagattgccaatgagtagatggaaaatgagaggtagagacagtactttgaggattatttaaactgtctttacccttggcatagaaaattcactttgtcaacatagataactacagcagaagtgaccctggggaccttaatatagacttgctctattacaataggagtataagtgaattggcacactgttcaaaggatgagaagcagctccccacagatatttcagttcaattaagctgggtattgacaatctgtaggcttcccttccttccaagcacattgatataaaaattgcagtttttttctggctctgcaaagagacagatatgtgtgtagaatgaggtcttattaatcagagttatttcttgtgtctccttttttactttccttttgtttgctatttcttctgagttgtgatccccatggtaacagatggaattgcttacagcgtctgtaattactattattaataataatgatcatcataatcagaccaatctgatatgatgagagaaaaaatatgaaagaaaattaaattgtggctctgtatgtaaactgtttacggcttccaaaatgagagccagaggaacaaggtaggtcacacagagatgcactagtgaaggctgtctgggagcttttctggggtaatgaccagggaagattttaccacactgatgcgaatacaaaatgtttcagaatattccaccattactactctgctggctctttgtacagcctctttttcttttctctttttgttattgttgagtgtgcgtgtgtgtgtatgtgtgtgttttgatcttttaacttgagacttcttttcagtttggactattacataatacaggcttaaaagagcagcttcagaaatgccgaaactaagaacctgacagtatacaaaggactaattagtttcttcacttgacgaagccatccagaagtgctaactcaggtgctcagtcctagcttaggttctggtagcctgaggatgaaagaccactcttgaccttggaagttctcaaggaaaagagtgcacagacttcactgcgcagggctctctaataacctctacccatgaactttgccccagacagatctctggaaagcccctcttcctttacttgtagtctacagagtatttataacagcctcagacatttgtcattcttgtgtacacaactttctccccagatgatggtaggcttttggagaagttaacatattttcctccagtgtatgtactctggtggatagcagagcactaactgggcacatatttaaacacaaaaatgaattatgcatttcatgtcctaaaagatctcatagctttatgaagaaatgaacttgaaagctcaaaatcacaatgcaacttgggaaatactttactggtttatatatcaatacacagtctgcctttggaagccatggggcacagtatttgatggcccataactcatagttcctttctacatgaagaaggcatgatagctgctctggatctgaatcatgagatcattgacactcatgccaacccactgtgctgaatgcaactttaaaaaagccaatatttcacttagataactattactttcagggaaccagaatgcttagtgaagtggccctatttcctttcccagctaatgatgaacaggttcctgcctattcaaaaatctccaaatgcagtcctctcctaagtaaaagaattgatctgggttagtcaatacatgtatgcctttgagcagtgaaagagaagaggctatgtgtctaattgtgggattgggtagtggtgtgcagtagaagtaatgaaagagaaaaacaaactgggtagcaaaaagtagtatcagagggcaatatttttccaggtttctggctccatgagtactaaagagcaaattatcttgaaggaatttcaggaaatgcaaaggacacaaataaagacagagatacatagggcaattctatagtggaaaaaaaaaacttaacaaggtggtaataatttagtatatacaggagcagctatattacaagaaatcacagtccatcgcacttgttaacctcatttgcagagtatgttccccatcgcagtcctctaaggaatgaagtccaagccctcactctaatgttgtagaaaacttctaatgcttagagtctttactcatttgagtgccagacagtctatgtgcaccaaatcattatgatacttctatggatgcaaagattggtgtaaatatgaccattttccaatgaggaaacctcagaaatgttatgaaacttgccaaaagctttactgctgacatggagcagaacatagattccaatccgaataggattgtttctaaagccaacctgtttcatggtcttattggtgccattgctgcttttcaaatatgaccaataagaaaactgggcattgaagaagtaataatttcatcagggttgctcccacagttagtgttgtgctggcacacaaacccagatttgctgactccagagcccatactttgttcactaacctccactgtccaactaacttgaccatcttgaacatttaagtttgtgggtccaattttcattgaagtcatgtgtgagtccacttaaaagagaatctccacctcctcacccatctaaaggatggtcaaaatgaattttgcttgttaaaaaatcattcaaagatgactgtcacataaacctctccagctcaaaccacccttccctagcctagagcaggcatcaggagtatctgtcaccacagctgactttctttcagtggcattaacacctgacctttcaatatttagtcaggatgcagggctaaatctacacaaccaccaatgcagctgaggaagaaaagataggaagcgaggaaaaatattatggcaataatattagtggctttaagatgaaagattgactctctaatacaactttattttctttattgccaaaaacaatatgatattggtaaagcaattcaatgagtaaatgaataaggaaatcaataaatgaatgtatgaacaatcagatgaattaatatatggatatgaaaatctatgtttacttagaaggaaatataaatctatatgaattagtaaatatggagaccaattttggaatcagattggatgcactgagactggggacaagtctaagagacagatacagatgatacaggtggaaaaaatgatatacatttacttccttgtttcagtctttatcctgctgtctcccaggagaacagtaatcagaggacatagggcagattcaaaataaaagccaactcaggggctctaggtttcaagcaatcatttctcctgtccctcgtacagtgtttgaagctaagggttgtgatgtcagttatatatatcatatgatcacacacacatacacacacacacacacacacactgtgtgtggtggattattgtgagtactggagataatatatgctaaatgtgctggaataaaccagtagcacaacatttagtattatagattagacagggttttccttgtcttctttgtataaacatcatggacatttcaaaactgtccatctttatttctccctctacaatgtttcattattgatggataagatttttggttattttatcagcatttgtctatactggtatgaataacattttaaaagttctgggttaattgtttttataatattattatctttaccaacatgaattatgtcttatttttgtttttaaagtcaaaagcaaataacatcaacttgtttagactttatggaaaatataatcttaggttggatgcagtggctcatgtctataatcccagcactttggcaggttgtttgaggccaggagtttaagaccagcctgggcaatataatgagagcccatctctaaaaaactttttaaagattatctgagtgtgatagtacatacctgtggttctagctacttgggagtctgaggcaggaggatcgcttgagcccaggtggccaaggctgcagtgagccacgatcgtgccactgtcctccagcctgggcaacatagcaagcccctgtatctaaacaataaaatataaccttgcctcagtgaaacactggggacatgtgggttatcaatgggctggttttaggaaatagtcttaagacaagtcagaatgtttgagcacagtttaattttttgctgtgtattaggccatttttgcattgctaaatgggaatacctgaaactgggtaatttagaaagaaaaggagtttgattaattggctcatggttttgcaggatgtacaggaagcatggtgatggcatctatcatcagcttctggggaggtctcagggagcttagaatcatggtggaaggtgaagagggagcaggcagttcagacggcaagagcaggagcaagagagagagtgaatggaaggtgccatgcactttaaacaaccagatgtcactgtcgcaaagacagcaccaagccatgagggatccactcccaagacccaaacacctccctccaggtcccatctccaacactggggattacaattcaacttgagatttgggcagggacaaatatccaaaccatatcatgctggaagaagtattttcttttatagaattggaaaatcctttagaggtaattaaaatcatactctctttttctcctgcttctaatatgttgaaactaaggtttggaaagatgaaacgacatgtcccaagttgtgtacagagctagtgagggagaaaggattaaccaagggcacccaagtggcctattcttttctcttttcagctcagtcatgccaactgctgtgcttctgccttgtagctgtgctaattaatcgtggtgactttcagtgtatgtgctcatcattactgtttcatggatgtgcctcgggtcatttctttactttctggaccttagtttctccatttgtaaggctaagaggatggggagggaagaaaccacatgatttctatgctagattccttttcagctctcagaatttatgaagagtaatgatgtaattatgcgggcaagattctcagatgacaaaagcttttcaagtcttcctatttcctcttttgctgtatttgagaggatgttcagaattaaattgcatgtccaattgcagtaaatgttttagcctaggttattactacagagtgtctgatacatcccagatagagccttgcaactttgtatttgtggttgcttttccatattaccagtgctaccagggtattgctctcttgtttttgttgcaattgttgttgttttcttaactgactataaaactaagcttcagaaaagagaagggggctgggcacgctggctcatgcctgtggtaccagctacttgggaggctgaggtgggagaattgcttgagcccaggaatttgaagctacaatgagttatgatcaccctactgcactctagccagggcaacagagagagaccctgtctctttaaaaataaaaatttttttaataaaaggaagtgatttatccaagcttgttcttggcagatacaggcttcaaatacagatctcccatgttctaatgcccaaatatctcccctctctcactgccttaccttctttcgcctattaggcaaaatatgtccttccgtcatgatttaaaggtcctcatctttcattgtaaatcttcccaaatatttttggcaaagagaggtaatacggggaataaatactaaacaaaacaaaaccctacaattaacttcattgcatgcagagtgtggatcacacaatctcaaccttgttctctgagaaaatggttctctgaaaacatgctagtgtttctcttgtgaggaagtgtgtcagtagctttggagtcagacatcctaggctcaagtccttgcttagtcacttattaactgtgggatattgggtgagttgcctaattttctttcacattttcctcatttttgacatagcggtattgcttcacttccaacttaggcattgtcaattttaactgagatcatgggattaaatgcttactgtagagcctgtgggaaaagggctccgcaaattgagctcttaagattactgacccccatcctaactctggtggagctccatggggaaacacaatttctctgtcctactctccatacggtaccggagtgttgattaatgttgcacgctgagtggcccatcacactgctcacatgctccatttttgacattgcttctaacgtctcttgctttgtgttgtgttgtctgggcagaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccgggtaaggcctctgcatgcatgaccacagtgggatagatgggaccctcagacctggagtattaggcaaaggaaaatttgccaagaagggggctatagttacagttagtcactgtgcactcgagagaaacacaacaagaggggtctggttatgtagtaatcctggctctgaaattcagcatggaagctagagtgagttctgtcacctttcaaagttttctcctcatcataaagaaaacgattccaacacccaccctgcaacagttgtgagaatgaagaacatctgaagaggaatgggcctcaaagagggcatttgagcttgacatagaaagtgtggccatgggaaatgctagtttggggagagagaatagagcttgataaggcaccaggatctcagcacacccacccgagagggatgagttatgtctggggtggaggatgcctggatgcctaagggggcagtgttaggcagggaggccagcaagataggcagggcaaacctgtgggttcatggcatgaacggagcctgagaaataggggctttaggggaaatgactctttttataagtaaagtgtgcttctagaaaaaattaaactaacactgcatatgaatttatttattttcccatggttattttttacagtaaatggatgatttagttattaacatgctttgaaaaggaaaaaaaacaaaacaaaacacaacaacaaaaacaacttctagaactgcttactaagactcaagagtttctgtaaaatgtaagatagggttcatcaaaatttacatgtttcctgggagtcagtcatttttttgtgaatgtcagttcatcatttgtttcatgggagaaaaaaggacaaaagatctgaagtatctaagaaagggtgttataatctctagcctcaagaaacttacattccagcacttagaagttaagaactttgaaaggctggggaaaaaatggagaataaaatatcaacaaaggggaaatcatagaaacctaactaaattcaacagaatgcctccttgatctaggatcttcagggaagacgttgttccacgtaattgaattttccaggtaactgtcacttatccttttaagcaccaaaaatctttccaaagaatttttaactatttgaaatgaaaatctttctcaaatggattacacgcttccatgccttcttaaccagagaattctgaacataaaatgtaacctttcttggtgactcagcatcagcattgtgaaaatcaattattgtactctccttagattcagccaggcttgcagggctgattagatcagacgtactggttcgtgtccctttacccagcatcctcagagggtgctgccctgccagagtcaatgtttatatttatgtgtgtttctctctccatgtctgtcaagcctgcacgtgctacctcagcacagttctcagggtgcctgtctccagaaatgcccttccctcttctcattgcgttgtttctagtttttgaaggtttcggtttggccgaattgtaggactaatggcggggcatgttcattctgactatgggacttcttttaggatacgcactccgtgatatcaatttggctacaccattgactttgcaaatgtgttcttttcctaactcagctgcctcactgtccctggccttatttgagtgggagggcacgggtttggcagcaagtcatattgggagtaagggcttgatgctgtcatttaccagttatgtgactttgtgcaagttgctcaatttctatagtttcgatttcaccacctgaaaagtttgcatgaaaatcctgaacccatgcagttgatctgaggatggaagaaaaaatttagtctgaactccttgtgctatgcctggtacataataggtattcaacaaatactggtgtccttattcgtagcttccattgcagcagggaacatccaaaattgttccataatgggaaacaagcacaaagggaaattttatttctattttaacaatgtaaatagaataattgtcataattatgtagtaacagaattgattagaaaactcaacgtagataatctcatcccctgaagatggcaactttaacattcagatgtgaatccttccagacattcttccatgtgtatattctcaaaggcacaaggaagacacaccatatttttgtgcatgagggtcttcattaatcgtctttccccatgtgctctgaatcaaaaggagggagataaaggagaacaatgggtatgtaggctcagtgtctactttcttcttgtgagctggcttggagaatgtagcatgaaccacttcatcctcttggcttccacctccagactagacactgcttgtggggcaagagagtcctcatttacccagacagtcccgtagaggtgtgatttagcttcacactttcactgccaggacagaagccacctcgtcccccatgcatgtgagctcaccgtctggaaaagcaggaatgggaaaaacaatatataacatttgtagccacatggattcaacagccagcatccagggcatacacctacatgaatgttttcctggtccttattattattaagccactcattcccttcccaagaggaagcccaaggacagaagcagaggaggatagaggccatctcctccttacctatctaagattctggaagaagtttgtgcaagtttttcctttatcagatgaatctgtggtctatgctgggaagagattcccgaccctgtgatactcttttacagcctgtatttgtcacacacaggaaatgtacaaatacctttctttatcaataaatacaacttcatatcatcattttcattaactatagagtattttattatatggagctactccaatgaacaaatctcctatttggacctgtagattgtttccatttttttctctgttacacgtaatgctgcagaacagttttgcatttagatctttgtgaacataactgattatatcctcaggacaaattccttgaggtgccatttgcagggcagcgagtatgcatatttttaagactcttgccacattgaattctgcaatgcatcaaggttgtaccaattcatactcccaacgacactatgagactgagtgcccgtttcccagcgatagatactattatcttccttcaactttggtaatgtgataagtgcaaaggtggggagtcaaagatgattataaatagttttgttattaatttttaaaagcgtgcaggctgattaccatagcctactggctattgctaactagtagccagggtgagtagacgttatgaaaaattataaattatggctgcaggtgcatttaaatcaataagagaatgtgggggttgccttgtgggcatagattctcctatatactatgcacaatggttaataaatggatacaatataagaaggcaaaatgaaagacaaagaaatatttaaatggccaataatgactgagatttcttatgtttgaggatatgtgtggggtgagctactggaattatctctaacccagacaacagatctgcaccataagagtcattgtccccatctgatatttcaggaaacagaaactcagagagaataagatgcttgtttaatgccacacagaaaggggcagatctaactcttgcaaccaaaatctcctgaagtcagagcaaaagtgctatttctgatacatcacaaaagcggccaagagccaagagttacaagtaaatgaaggagtcagaaaaaacatgattttgtataaatttccttattgtgtaggaaaatggaaggagagagaagcgcaccaagcactgtctctgtgaaggccacggagttgtcagggttgcctgaactgggcacattcctgggcggcatcagagggtttgcatcatcctggcctagactcatcaccttccatggctcacgcaccccttcatgggaaggcctgtgtatccctacacagcatccccagagcctccttctgcctgctctcggctccagcaagggctctggttccattcatttagcagcggcagagggagaaggaagagacaggcaggataaggtcgtgcatgggtcaccactgggcctttttcattcagttggtgactgaaccatgacactgtcattttatgacagtctccttggatatttttttcccagaactactgataagtgccaaccaatggaatgcatcctccatctctgtagctgaaggtttatactagaaactctccaatgtctcaccaggacatccgtatcccagggaaagtgtctttgtgattctcatggatctttgtctttcccctcactctgcttgctgctttctactctgagctttctgcagggctggaggccctttgctacagtgcagcttccagtacagagcccagggggggagaatcaccacagcctgccagtactcacagtaccttgtcacagggaaggagacaacacttatccccactgaaaaaggctaccttggttgagcccagaccttttctctcttgtcagcaccttcataggcattttgcctgaggctagagtcctgaaggcgacatgtgatgagcatacgaaatgaaacaggaggacagaaaaataaatatcaaagccatagtctggaagattcttgaatcacatggccaattagctctataacccataactttcccctggaaggaggacaagatggagaggggtatagcaagtgaccgcatggggaaactgagtgcccagatctctgctgggaatgggcattggaaggcctccctatcccacaattctcttgcaatagtctccatggtgccttgaaagtcccccgccactggattccgtcattagggtgtcagtatccggtgtaggcatcctcttgcactcaccactccaagtaatggaaatctgtttgtggaaaccctcttcagtaaagctgtgacctcttgcaggcagagggaagaagtcaatattgaaacacgtgaaagcactggaaattcagactccattactttgaaatctaatggctgtaggacagcctgagctggaatttactttgatttttctgaacagaaagcatttgcggagcaaatcagtcatggaagcaagattgccgtgaggattgtgtaagttcttcaggagccctaagaatccagagccctacagcatcacagaacctctgtttacctaccagtaacatgctggttaaaagccattcctattaattcattcatgcagctgagagtggtttctacctgcagtcaattgctttacctagtcatgttacaatggaatttaaagggacagcatgctatttattttaaagtattttaaaattctgaattttttctttaattactgatactttagtgagcatacagctaactgactatatataccatacataataatctagactatataatacatagtatatagtatggataaatatatatgtgtctgtatgatagtatatagtatatagtatatagtatggataaatatacatatatacaatatatgatgtatatactatatagtatatgctatgtcatatttgtccataatgctatatacattcatcacgtactctttatgtgtccaaacagctctgtaaatacacttgtgcatattaattctgtttatttgcaatattccccttcacatgtgaaaaattaatgatttagtttagaaatctgagtaaggaattgtgatgtagaaaagtcaaattacaggtagaaaagaaacagtatgtcaagatactctggggttcacaaaactaaaaatgctttcttctcaatacttgtaccacccaagatcaattagcagaattaacatttttctttcatacactaggcatttttgagtatctgttttgtgccaggcactggggagtgaaaataaaacactgaaaaaacagagttcttgcctgcatacttgtagtagggaagacagaaacatgcccccactgcccccaaccccccccccccgccacacacacacaatcagtgcatgttgaaagtgatgctgaaaggtccagaaggacaaatgactagagtatcagtggatgtggggagctgcatctcacatgaggtggtgggaaagtcctcccagtgtgcaggagctatccagcaggaccctgagtgaagggacaggatgaggcaggtgcctttttggggcagaagattccaggctgaagaatagccaaaaggccagtgtggctagaggaggagcaagggtgggaggaaaatgatggaaagtggtatccagaggccagattttacaaagcctgggactgcaaattttattctaagagtaaagggaagtcactggaagattttaagcagaggattctctttctgtttcaaatccaaagggtaatgtcagtttatgtaagtcaggctaaaccaggtatgaatattttcatatgaataatttgctaagcacatagacattttaagtcatctcctatgcctagtgaactggaaaaaggtatgagctccctgaaggaagaaacatgtcttatatcactctgtaacctcacattctaattcggggctgtgtgtggaaggctgtgaccaccttggatcccctctgattcatggtggtgattctgttctttctcacccaattaactgagctgcgattgctttggctacttcacccgctatgttcttgctgcggcccactttcaccatgctcacaaagcttggaggtccgcgtcagagagctgcaatctttgcagtctatggcaccacctctgctcccatatttctttcctttcttaattccctctttctttcatctttttctttgtccttccttctttcttaaccaccccccgcctccacagacacacgcctaaacatacacaaatatgtgggtagaactgatccccagtgtctaccgttcttccacaccagaattaaaaccacaaacttacatcatgacatctggaagacaaaatatcagggtagtatttgactttttttttttacttatttcttaaattatgctccctatcatctttttattattattattgttattattattattatactttaggttctgggatacatgtgcagaatgtgcatgtttgttacacaggcatacatgtgccatggtgtttttctgcacctatcaacccgccatctaggttttaagtccagcatgcattaggtatttgtcctaatgctctctgtcccctttcccctaaccctctgatgagccccagtgtgtgatgtttccctccctgtgtccatgtgttctcattgttcaattcccacttatgagtgggaacatgtggtgtttggttttctgttcttgtgttactttgctgagaatgttggttttcagcttcatccatgtccctgcaaaggacatgaactcattcttttttatggctgcatagtattccatggtgtatatgtgccacattttcttaatccagtctatcactgatggacatttaggttggtcccaagtctttgttactgtaaatagtgctgcaataaacgtacgtgtgcatgtgtctttatagcagaatgatttataatcctttgggttatatacccagtaatgggatttctgcatcaaatgattatatatatatatatatatatatttaccaaaaagctatttctactttatgtacaacaagaatataataaacccaggtggactgggtgccatggcttacacctttaatcccagagttttgagacgccgaggtgggaggatggcttgagaacaggagttggagatcagcttgggcaacaaagcaagaccttgaccctacaaaagatatttaaaaagttatccaggtgtggtggggcacacttgtagtcctatctcctctagaggctgaagtggaaggattgcttgatcccaggagttctaggctgcagtgagctataattgtgctactgcactccagcctcaacaacacgtgagacctcaactggaaagaaaagaaagaaagacagaaagagagagagagagagagagagagaaagaaagaaagaaagaaagaaagaaagaaagaaagaaagaaagaaagaaaaaaggaaggaaggaaggaaggaagggagggcacaccttggtgacagaataagactttatctcaaaaaaaaaaaaaaaagaaaaagtcactgccactagcccacattccaggggagggaaatctgcttctatcttctaatggaacaggtatacagacatgttttaaatgacaatgtcatcttcaaaattttacatgaatagtcaactaccctaagaaatgcagtgaatacagggcagagtcgagagtcaaaccaagctctttctaactcaaagtctaggcccttagactctggtgtctaagtcagttataattcatgttggaaatgggtttggccctccattttttcccgtgagggacttttgttacccttaaagtgatacagctaaaatgtgtttttaagcgtttgccacagctttcaaaaataaagagatcatcacatgaatcaagccagtgcaatttacagtgcatgaaagccaaagccatctttcctaatgtcctagtaatttactcttggtatttcactggggacttgaagtcaaaattagaagtgggtgggtcttaccaacaaggtggataacttaatcaagctaaagatgttgatatgaatctgaggaaaaataaaaactatcctatgtaaagtcaacagatggtatatatctgaccacaattgagttgctgttcagaccatgaattatttaaataatcaaagttgattgcccaagaatcaacactcagacactacataaaataaaatatgcatttttcccatcactttatgaaagcccatgtccacttcctttatctcaaggataaaggaatgcacatgtaggaagaagaatacaatgttctaatattaagatacggtacagtggcagcacaatggaaagaacatggattttcttcactgttttctcttcctttattaattgtgagaccttaagtaagttaaatgggccttctgagcctcagttttcttatgtgtgacatttaatgagacagatgccatgtctggcacagagtaggccctctggacactgctgttattttagccagtattttatcacattatccagcggcaaggagaacattaggtcccttaggtactgatagagggtctcccaatctcatagtgtggccattcaaagagttcagttgtggagcttgcctcttcatagcttgggggcacacctactttctaaattgcacttcatttatttgtaacttatggcatttacctactcctggtagcactgttgaaagtgtagagttaggtctatgttcctctccccatttctgccaaatacccaaatccactcatctgcttatctttctcatttcagtaaatgctaccttcatctactgagttttttaagaccaaaacctacgattccttcctcttcaccatctccattccccattcagtatattctccagtctcttctctctaattccacatcaaccacctccattcacaccctcatcatctcctcaccatactagacaagtgcagtagattcctgcttcctgtcttccaccatcccatgccccatttccccacagcggatatcccagcctgcagccagagtgataatcttttcaaaattagattatataaccatggctccaaacctttccctctggcctggaagcaaaacccagactcctaactgtagcctgcagagctctgccagccacaggcctctgccagcccctgttctcccattaatacagtgaacttggccccactttgctttttgttgcttcttgcccagcttgccccacctctcagacctgatacactgactgctctctctacccagaagccttgttcctctctccatgcttagctgtctctgattttacgtacaactaaagtattcacttcattactgttaactgcttcatccttcctgaatagtctgcattgaagttgtttctatcagataccttcttcttgcttatttgttcactatctgcctctgtcaatagaatgtgagcttcttgtaagaggggccttctttgtctcattctttattcccaaaatgcttagaatagtacctggcacctagggacaattgagtgaatagttgttgaatgaataaagggtctcttctcagtagtaagtatcaccagtagtcatatgatgtcaaaggacagatgacaacacacgtgcacttggccaagcctgtcacacagaccctggtgggaggagagcaacttcacagagcaagaggctaggcttgtggggagctgccctctgactcccagctttgccattgattctctgtaaccttgagatgttactgatgttttatgggccacaggtttctcctctttgatactagaggcttatatttaatgttctctgagtgtccttttcactctggcactccatgtctctatattcaccacacaaagttagttaaaacacatgtcagagtttattacttttttgtcacagtaaggaacttgtcggggttagtaaaacaaacaaaccaaaaaaaaaaaaaagacttttgtcagcctctcaagcttatgaaatgtgctaatatagttatgtaataggtgatattttttgacaccttcatacacctactctcctcagaacatactttccttaccgtggcatagattgtgcaaagaaggtatgaaacttccctagggtcatacataacaagtcaagaatagcaagaaaaacaatttattactgtagcatatgtttgtgtgtattaccgtagaatatgtatgcatgtattttctttataaacaaacatatttggtggcttacggggtagatatggaaacgaaattataccaactacacagatgaggttaatgggtctgcataggtgttaggctataatggcacctctgagcttgcttttcagggggccatggctagatactagactttcttcacacctgagtcctcactggaaccttcccaaagagaaggctccagagttctggtgatgagctcacttacatgttgcatcagttgctttggttcaagcacttgctccactcctaccgccatgtgaccttagatgaggtactcaccatctctaagcctcagtttcctcaactctaagaatgaagatgagaaaaataacattaatgatacccacatcattggaagaataaaaagtgtttgaaaatttcactcttcataactttttagtttacctaagttgttttgaaattacaggggtgcctttctgaacataattttcattgtcttattatttgctgagaagagggagtgggttttctgtgtgtgtgtttacgtgtgtgtgtcagatcagatgaggaaataccaaatgtgctttctatatggtagcggtgatttcacagcgaagatatgaagcttcctaaaactggtaaatcattatcttggaaagagacagtggaaatgttttagcctctgaataaaaaaataaaaaaataaacacaacataattcccccactctgccacttatttttggagtagccatcatcaggaaaggtaatctgaatctgcatttcattttcttctctgcgaaatagctaacatattgacctcacttgcatctcattttcttctctgcgaaatagctaacatattgacctcacttgcatctcattttcttctctgcaaaatagttaacatgttgacctaacactatgcatgcgtagtatggggctggactagtggctattattatttaaggagcctatccccctacaggcagaactagagactatatgtacatgtgagcaaggtatacagggctctgaaaaggagaaactacttctagttaggtgaacacctttccagaggttttctatggaaaagcacctcttctttgtggacacaacatgggtagaagtcattctgagttgagggaagtgatggggaaaggcatgaagggaagactgaccctcagagaatgggggagacattgtaggaataaaacagttaaaagttcttgctgcttatttcagataaggagtcacagaggatggaaagaaaaaaggaagaaaggaggaaggaaggaaggaagaaaggaaggaaggaaggaaggaaggaaggaaggaaggaagggagggagataggaaggaagatggagatctttctatgtttcagatacttcccagcatgctcctatagattaactcaccttctttcactgaatgaagacatttgaactggagaaggttaaccatgtggatggaggtagagagaacgcactgagtctgaaggagagcacagagagaggctaggtaggcatctatcttagcggtctagggaagagttaaaaagcatggaggtgatgcgtcataggaatagaaagataaagaaagacactaacacttagatgaaagcactagtacaggctggtgagttactggtttcaatgaaccaagtagtatctaaaacagtgctgtccaatgaaaatatagcacaagccacatgggcaatttaaaattttctaatagccccatgttaaatataaaaagaaataggtgaaattaattttaataatatgttatttttatgccaagatatccaaagcaataccattttaacatgtaattagtaaagaaaaaccctaatacactgttttacattattttttataccaaatcttcaaaattgggtgcgttttttgcatttacagcacattttaattcacagcctgttgctgtactgaatactgtaggcaactataatacaatggtaaatatttttacatctaaacatacctaaatatgaaacaggaatagtaaaaatacaagacaaaagatacaaaaatgagctgggcactgtggctcaaacctgtaatcccagctactaaggaggctgaggcacaagaatcacttgaacccggaaggcagaggttgcagtgagccaagattttgccactgcactccagtctgggcaacagagtgagactgggtctcaaaaaaaaaaaaaaaaaaagaaaaagaaaaaaaaatttacgctgtgtagggcacttaccatgaacagagctttcaggactaaaagttgaaagttgctctgggtgaggcagagagggaatgatgtgtgaatgtgaaggtctaggaaattacaaggtgccactgtacactttataaacactgcacacttaggctacactacatttaaaaaaatattttttcttcaataacaaattaacattaatttactgaaacttttttactctataaacatttgcatttttaacatttttactcttttataataacacaactgaaaacacacattgcacatctgtacaaaaatattttctctcttctaccttcattctataagcttttttctatttttaatcttttaatcttatttttactttgaaactttttttgttaaaaataaagacaaatacacatactaaactgggcccgcaaagaatcaggattatcatcatcactgtcttctatctccacatcttgtcccattggtaggttttcagaggcaataacatacatgaagctgttgtctcttattataacaatgcctttttctggaattcccccgaagggcctgcctgaggctgtttcacttttttttttaataagtagaaatggtacactctaaaatactgataaaaatagtataataaatgcataaaccaggaacatagtcatttattattattataaagtattatgtactgtacataattaaatgtgccatactttcataaaactggcaacaaagtagatttgtttacaccagtatgtacacattagtaattcattgcacaataacttgaaaaggactactacatcactgggcaatacaaattttttagctccattataatcttttataaattttatagctccattataatctttttttaatatatatattatactttaagttctaggttacatgtgcagaacatgcaggtatacatgtgccatggtggtttgctgcaccagtcagtccatcatctacattaggtatttctcctaatgctatccctccccttgtctcccaccccccgataggcctcggtgtgtgatcttcccctccctgtgtccatgtgttctcattgttcaactcccacttatgagtgagaacatgcagtgttttgctgagaatgatggtttccagcttcatccatgtccctgaaaaggacatgaactcatccttttttatggctgcatagaattatatggtatatatgtgccacattttctttatccagtctattattgatgggcatgtgggtttgttccaagtctttgctattgtgaacagtgctgtgataaacatacgtgtgcatgtgtctttatagtagaatgatttataatcctttgggtatatacccaataatagggttgttgggtcaaatgatatttctggttctagatccttgaggaatcagctccattataatcttatggggccacccttgtacatgagatctgttgttgacccaaatgccattctgcagcacatgactgtatacatgtatttatataaatgtgtgtgtattacaacagccgttaaatatgatcttgttagtccagttatataaatgaggaaatggacacttagaggtgaagtaaattgcctgaagtcttacacaaaggatgggattctaggcagatctaatttcaaagcccatacaaagtcacagacacatgtcaagagagaatgaaggtaaagcaggatcaggagaccttgagtccaaatacttttgctctatgtgatggttctgccaaatgaggagggagatgtttgccaactagaacatactatacgtagttgattacaaatgtcatatgtatccacatgtcaaataaactcttacctatatattattgcatatgatacaaatatatgtacatatatgcactttacatgttttttctggttcctaaataatctttatggaggaaacacttaaaatatggaaatagaaaaaggaaagctgttaacattagcccagcttttgattgtaacagctgaaatgggccaggctttgtggtaagtattttcagttcctagtacacacaaattacaaaaccatctgagttaatccttcgaatcccgtgaggtgtaggttattaccaaggaacaaacgcatgttcaaagaggttaagtaaagtaagaaccatgtgaccctatctgtaactgtaggattacacaccaatctagtaaaacctgttacggttaaatcccgctgcatggaaagacaaaaacaatccttgcttaaatcagccatgtcgccagctgcccagacgccagttagacattcgcttgaactgtgccaaacctagactggattttagctagtaaactagtattatatagacataatctgaagtcactcaaaagctatctgagtaatcattccataagttgccccccaaaaataaaaagctaaatatttctgtgaatgcatcattgacaaggaaaaggaataagataagaagaaaatcagaaacaaagttgccgacactgtaaaaatttatctgtatattcagcacaatttttgcattagaatttagaaaggataaaacattaggatattggagtagttgcagaatccattttgggagtatggaggttgggggctagggagaaagagagagaggaaaggagggaaaatcctttggggaattgcctctgagttagaaacctgtactctgcttcattttttatcttgagtaaatgaagagagattctcaacatggagacatgatcttaggtacataaccctttgtgatcttcccaagggccatacattatgatgctgaaaaacaagagtccatgataatgacccacagctatttaaaatagcaacattccacaatgaattcctcccttcttaaaggaagacagggatatggtggcaatgggagctcagagttggcaatttcttggcagctaagaagctcaacagggatgaattctttggtggtaaaattgaaatacaaattcctttttcaagtggaacttttctaactctctgagttttcaaaaacagtaactgggtcatatttatttctgaatacctctagagccattttagtgactggcacaaagtaggtctccctcccaaattttcttggatatgaaaatcctgtgagaatatgatccaaaaaagtactttgaagacaataattggaattctcatatgagacacaaaaaggtgacagggcttggtggctcacacatttaatcccagcacttcgggaggctgaggtgggatgactgcttgagcccaagtggtcaaggctccagtgagctatgattgtgccactgcactccagtctgggcgacagagtgagaccctgtctcaagaaaaaaaaaaaaaaaaaaggaaagaaaaagcttaagtgtggtgcaataacaacaaggtaaaaacaaacaaaacccagaaacagaacatcttaatggcttaaaacagcatcctttcatttctcaagtaggccagatatgtttcatgaattggcttggggctctgtgttaagttttctcctcccagcacccggagtgatagagtagcacttctctcaagtgttactggtcaccttggcagatgcaaagagggctctggagtacgtcaaacctgctgcagtctgggaatgacacatgtcacttctgcttacagcacattgccctgaatgaaatacatgcaatccgcaggggacaaagaagttttgtttgtttgtttcttttgagacggagttttgctcttatcacccaggctggaggacaatggcgcaatcttgtctcactgcaacttctgcctcccaggttcaagcgattcttctgcttcagcctcccgagtagctgggattacaggcatgtgccaccatgcccacctcatttttgtatttttagtagagatggggtttcaccatgttggccaggctggtctcgatctcctgacgtcaggtgatccacccgccttggcctcccaaagtgctgggattataggcgtgagccactgcacctggccaggaagtttaatcctaccgtgtgctcagaaggtgacgagacagaagtaattggtgcatagccttaacgtctatcagccagtgagaacacaatgaacaaaccaacaaacaaaaggcaaaaacaggaaaaaaagaaaaaaagaaaaatatcatacccaatagaagaattgaaatcaaagggtatatttacaatattgtctttccctttttatcttctatctactataaagtgaatcgttccttaatgcatggcacaccaaagaaaaatccatcagacctctgaagtactatgaactatttttaaatttgtaactctatttatagatcctcatgtaatcatgaatatgaatatcctgaattttagtttcagctaacatcaaatatttggttaacgtcaaaattagctttactatttagttaatattatagtttcagtgttagttcaagctaatgtcaacatcaactgacgagcaaatatttggaaagcattattttattcccttttttagaaaaagcaaagcaaattttcaaaattaactttgtgattagtcacaaagccctcacatacgtgtggataaaactgtctccatatatatgttgatgtgtagctaaaaaatattggccaggcgtggtggcttatgcctgtaatcccagcactttgggaggccgagaccggcagatcacaaggtcaggagatcgagaccatcctggctaacacggtgaaaccccgtctctactaaaaatacaaaaaattagccgggcgtggtggcgggcacctgtagtcccagctgcttaggaggctgaggcaggagaatggcgggaacccgggaggaagagcttgcagtgagccgagatcaagccactgcactccggcctgggcgacagagcaagactccgtctcaaaaaaaaaaaaaattatacatatttattgatacagcatcccatttaatgctgcttttataaatctgtggcctctgaaatagtgttcatacatgtgtttttgtgtacatgtatttttaaaggaaaaaacaaactgtaaaatactttaaagagatttattctgagctaatatgagtgaccgtgacctgggtaaaatataacccaaagaagccctgagtaagtagtcctgaagcggttgggttacagtttggttttatacattttagggagacagaagttacaggcaaacacacatatcaatccatggaaagtatacattgatttggcccagaaagttggggcatcttgagtcaggggcttagaggttataggtggattaaaagattctttaatttgccatgggttaaaggagtaaagctttgtctaaaaatttggagtcagcagaaaaaaatatttaagataaggaggtctgttaaccagtacactgggtgagagtgacttgtagaggtgtgtgacttaacccttgtctggcagagccttaggtcttatttattagtatcttattgtcacaaagagtttgttttgttagtctttgtaatattaatgctggtcagctgtgcctaaactccaacagagaggtgtcatcacaaggcatgtctgatctcccttcccatcatgacagggaattcgctttttcagatttctctagagtccccttggccaaggggcgaggggtctcttcagagatgaggggatcttagggttttatttttgtttacagtataaaatggtacaccactatgcactgttgacatatttttcctcatcccctaaatactgtcctattctctggcagctggccagtgagggccatcacctcactctgcaagtgcccatggctgcaagtattcttttgagccatcctgcagggagcgcatcccagcagcttgcgtttctttcccatactgacctcttctgctgctgcatattttgtgcttgaaattgctgtttggattcctcaagactttcaaagatgttcaggatggtgcataactacagcaaagaactaaagggagactattactctggacattaaatacacattttatgatagcttgatgtgctttaagaagaacgatgggggaaacatgagcaatgattgggcagttagagatgggtagaagtccattgatattataaaggactttaaacatcttggtagctgggaaagattaaccaaggaatgagctagaagaacagattgccccagggcagtttatgactgcatgcaatttgaatgcacctcagtagggtgtgctaagaccattatagtcctgattgattagcaccagaaaagtatttctacttcctgctaaatggaggatggctgctctgtgcaatctcagaggattgtttaatgtacacgtgtgtactccaggtgccacagaattctacagccttgatttgacaactcaggtctgtgctatcttcctgatattactcatttcacagtctgaatatgagagtatctttgtcactgaacaacagtgttcatgtatgtaaacctgctcattgcacctgctccttgccattttggtcaaggtaagtataatgcctcttgcagtcattcatcagtaccgttgggttttggtgggtgtgttcttccctgcctcagggcaatgctaatttcatttctcatcctccaccatgcctgaatacacagtttacctaaaggttaagaattgagtccaattaagaggatggagcaattccactacattaacattaatagtgcatggaaaacactccctatgtcttcattttttaagcagtagccattttcctgtctattctctctctcttattttttcttcctgcaccacttaatgaaaatctaatggtagcaatggcacctttgttgatgaaagagaaaaagtgataatcgttcctgcttgtctctttctcatttctcccgtaagggaagctaagagtggcatccttgagacaggtttgctttactgatcaaagacagtccttgggagaaacgacccagaggatgaggaattgtcaagaaagctttgccacagacgaatatgatggaactagttcatcaaatgataaaatgtgaactttcctttcatcctggaatggaaaagtcattacaggaaagagtgaatgttataaaggttaaacgtgagtgactgatgatgatgtatcagggaattccctggccctgtaaggctgtctggtatcaggctctcttggcctgtttcaatttatacacaaccatgagggccttacatccatctgttaaagcatgctgtagtcatacatttagctaggaaaaacctttggcatccggggcttctgcagggagcaggccaagagattccactaggttatggatctccttctccctgagggaggcataagtggcagagaagctgagagatcttaagcagctaacggaaaggtttgggaccagctgtttagcatgacaagcattccagaggcattgaggggcaaggaggaaattgagcatgtgttgaatcattactgtaaagaaataaattgccctggaaactgtgtatcagggagaggccttcataattactttatttaccaagccttgccaagctccatcctatcttcacacttgtttccctccacaggccctccctgctactctgtgcttgagtgcaggaattctcaaggtatgaaacacaggaaaggtttatgtgatgcatggatggaatttttgaaaacatcatttttttctattttaatgtgttataaaaaggtataccattagcacttaaaatttataatttcaaatctcttattactaagagagtagtgtaagttaaaaagaaattagtaattcacgtcaattaacttaaagagatttgaagtaagtggtcatttgggtagaaatggcaacaaactggaagatgcttctggaatgagggaaggaatgagggaaggttaggaagtgctagggcacttttccttcctcagacacatcctttaaggatgtggtgctatacctttaagccttactcactcactcctcttcccacttccagaggtgccttcttcctgcagtcctattggtaacattacattttgctttaccagctctgcctcctctgtgaagcccaccctgatttattcagaataattcagcatgtgttctttctgctccctttttatgtggttcatattttaattgcattattcactcactttcatttcagtcagttgcacacctaaagatgttatgcaaatggtattcatttttatatcctcagggacaggacctgcatttgggagatattaaatgattagttttgagcaaacaagttattcatatcctttcttatcaaagtttcatcaagctctacagccgccaaatcccatggcaatactaggagatcatttcttgattagtggcatttgacacagttgaccatgtcctattttgaaatacttgctttacttaacttctagaatgtgataccctccagtgtggtcttgcctctgactgtacttctgctaccttgtttgttggctccttccacgttaaacaagaagaaggtcttagggctcagcccagggctctcttcatcatctatgcattcttcttggattgccattcagtcacatgctggagaatctcaaatttagatctccagccaagattccttttctgaatacaagatgcatatatccacctgcctactggtcttatgatgtcccaaaataatttcctgatcttcttcctccaaatatgctcttccagcattctttcccaaactttgtaaatagcaagtcattcttccggacactcagaccaaaaaacctatgagttatccttggttcctctctttttcccatactttctgataaaaacgttcctaatccaactggctatcattgaaacagatgcaaaacttaagcactgtgttcgctaccttggccattcccaggcccaagatgcatcacctgtctttttgattactacgattgcttcttctcaaacacctctcagttatagagggacaaactgctcacaatatctatgtgtttcctcctgacttcagtgatccagtgtccatccccatccccatttcactactcacagcgagaccaggggccctcttagaccttccatgttctggaggcactggatctctctatattgtgctgacacttgcctgcctgccttcctttccttttccttccttctttccttccttccttccttccttccttccttccttccttccttcctccctctctttctctttctctctctttccttctttccctctttctttctttctttctttcttttctttctttctttcttaagagttatgttggtgaatatgaagcatatgtcattgtggttttgattttcattctctaataattaatgatgtcaggtatcttttcatgtacttgctggccatctgtgtgtcttctgtggaaaaatgtctactcagctcctttgaccttgtataattgagttgtttgtctttttgttgttgcactgtaaaagttctttatctcagatactagactgttatcaaacatatgactgcaaatatttttcccattctatcttttcactttattgacattgtcctttgatgtaaagtttctaattttgatgaagcccaattgaactattttcttgttgttgttgtttgtacttttgatgtcaaagctaaaatccaccttagaggtgttgcacttgttgttgttgtttgtacttttgatgtcaaagctaaaatccaccttagaggtgttgcacttgttgttcccctgattgcaaatctcttttccaatttaccacatgccttgctcgttcacctctttcaaaattccgtataaatagaaccttcttagcaagctttatttctgttcactctatttaaaattgcaatcttttctggacacagcaaacctgggccccttttttccactttatttttcctcagtatttattttcatatgatataatttactaacttatgtaagcatgtttttagacttaagcttcctaagtcagaggttagtgtctgttcatgtgtgattgtattttccatgcccagagcacagcttgctacagaggaggtgcccaatatacccaactggcaggggagttcagcctgtcgccacgggcctcattcttcctgtgtaaaagcagttttatctgcctttcctcacccatccttgacctcaactgttactttatcattggtataattattagcataatcatcactaccaagaaatgtttagaaagtttccacctcttcatggtgttaagctaagcataggcatagaagcacgtatctgggatttcccaagacaatcctgatttaaaaataagtttattagagaatgtaatctaatttttgttttcaaaaaacaaaggcataagaaacagcaattctacatttttgctcctgagctgagtgacattatagcaatggcatggtctttctgaaccacagttttctcacctgtaaaatggggttgttgtgaggattaaagaaaattatttttttaaagacaaaggaggaaaaaatgtaataatgtaatactcatggccctataatttaatttaagtgatctttcaagactttacaaaaagcagaattttctgaattctttgcttatctcttttgtttcaggaatgtgctatgaatgctaactttaatcttagagactcttatttttatttttagttatttatatttttgagatggggtctcactctgttgcccaggctggagtacaatggtgcaatcttggctcactgcaacttctgcctcccaggttcaagtgattctcttgattcagcctcccaagtacctgtgattacaggtgtgcaccaccatgcctggctagtttttgtatttttagtagagacagagtttcattatgttggccaggctggtctcaaattcctgacctcaggtgatcctcccgctttggcctcccaaagtgctgtaattacaggcatgagccaccatacctcgccaagactcttttaaagaaagcccaaaggccaccactttagatatacccagtgagacttgtgttcatgtgttaacgatgccatcacagggttccacaaactggtagcttacacaagagaaatttgttttacctcctcacatttctgaaggctggaaaccaagaccaaggtgtgagcaggattggtttattccaagacctctctttttggcttggaggtggccaccctcttctggtgtcttcacatgacctaccctctgtgtgtgtcactgtcctaatcttacaaggacaccagccatattaaataagggcccacccatttgccctcattttactttaattatgtctttgaaggctctttctccaaagacagttgcattctgaggcattgggtattagaaattcaatatatgaatttaggaagacacaggttagctcataacagtgaaaaaatatgcaggaggaaatttttgtaaaattttttactttattaatgcactgaaaagaaagaaatactgaaagtcaaaaaaagtgtaggagaatctaaatccatcattgaggttggcttctaccttgacagcatgtgcctaatacaggtgatcttgacctttggtcctcaaggcctttagggccccaaaagaagaggacatttcttagggcacagctaaggcaaggagtttaatgagagatgttaacttctcatactttataaaactgaaatttaaaggagaaacttgaaatcaattcccaagggaacacacggaaaatttcctgtaccaatcaggatggaataaaaatctctcctataaatatgttcaataagttggtgtacatgttaaaaagactaaaatatgagtaggaaactatttcaagtgaccaagaagatttaaagaaatataaataatttctcaaaattaaaaatgtaataattaaaactaaaagcacaagggataaacttaagagataattagaagtgactaaaaagagaattacagaactagaaaatatttctgaaaaaaattacccagaatgcatcacagagcaaagaaatagaaaacagaaaaaatatttaagtgatggagaataaaattgtaattgctaacatatatcaaattggcattttggtaagaaaatcattcctgagatgctgtgcaaaatgtaaattgtgtgcttaattttatttgctagtaaacctggcaaataatactttaaatggtagctattattagcagtattgagcttactactaacaataacagttctgtcttaagagtcgagtacacaatcttaaaacactacattctcttaaaaaaaacacatttaaaagcactaacatgttctcagaatgtgctttcctaatgaatttaatctggtgattgcagttgcagtgatggcactgatgacgatgactaaaatgagcaataatgaatgaggaatttgcaatttttgatagggcggtagtaacaccatgtcataaaaaatgttaaggtacttgagagttacagtttctttttttttttccctagctctcatcttgatttcctaggtattttagataacttacgtttcttgaaggcctcacacatgagggtatatgttaatatttccaacaggctttgtttttgggactcacttttgtacataataaattatctaccaggacaataaaagtggcatccttttattaaataactactctgtgtcagaaagccaggcctctaactatgggcattacgtaatttaataatcacgtattatttttctgattttatagagaagcatctaaggcatagagagaataagtaatttctgcagagtcctacagcattaaaaaaaaaaaaagagatcctctagacaatttttctgactccaatgccctcaaatattttcacgatgataaggtactcatttttaagttttattaagatatatttaataagacattaaatgtactcacaaaaatgtataatttactgtttttagtatattcagagttgcaaatatcaccacaatttaattttagaatactttaacactcccaaataatatcttctacatattttcagtcattccccattcctgctcccaccttgccgcattcaccacaatgtcccaaacccagcagtgatatatcctctttcatccctgttttagtgattttagtcttctctcttttttcttgctcaatcaagctaaaggtttatcaaatgttttgatcttctcaaataatctacttttagtcttattgatttttctctatagttttactattatctgtttcatttatttgtgtgtaatctttaatattccttctccttgattttggcttagtttgcgcttcttactctaagtttttaaggctaaaggtaaggttgttgatttgagaaccatccttccctccttccctccctccctcccttcttccctccctccctccttccctccctcctttgttctttctttccttccttccttccctccctccctcctcctctcctctccttcctttcctttcccttccttcctttccctccctccctccctctctccctctctacttcctttctttctttctctttctttctttctttctttctttctttctttctttctttcttcctttcttcctttctttctttcttttcatctcctcctactccttcttcttcttaaatacaggcatttacaacaatagattttcctctaggcctgttttcttgcatcccaaaaagtttgggtatgttctgcttttgttctcttttgtttcaaagtttttcttatttccattgtgatttctttttgaccaattggttatttggaagtgtactgttaaatttccacttatttgtaaccttttcaagtttaaattgttgatttttaatttaaatttaagaattttgggtaacatacttttaatgattttaatcgttataaattcattaaatcttgttttatttttaagcatatggtctatcttggataatttttattgtgtacttacaagattatgcattctgttgctatttggagttttctattgatgtatactgttttttaaatgttctatgttcttgatcttctgcctacttctatttatttttaacacaagagtgttggattctcaaccattattgctaaattgcccatttcttcaactttttttgtgcatatgtctcattactttagggctctgttgttagtcgtataaatgtttataatcgttttattttcctgatgattttctcttattattataaaatgtccttctttgtcattagtaacaattgatttcttaaaatttattttctccaacattattttgtggctaaaataatgttagctctcttttatagttatgcttgcatggtgtatcttttaccatccatttatttccaacatatttgtgtgtttgaatatgatgtatatctcatatagacaacatattccaatcatcatttaaatattctccattttttgtatcaatctctaccttatgattaatttaattcacttatatttaatgtaattatagatctgacaggattcccacttgccatttttctacttctttattggagtctatttttcaatttggttatcctgggaattacaattggcaccttatttttaaacaatcaagtttgcattaatcctaactcaatttcaatcgtatacaaaagcttttgtgcaacatattttatttcttctttcctccattctatattcattacaatgcaatttacatctgtatataagcccactaatacagtttagtatgtactgctttgtgcagttagttgtcttatttgtcgagatattgttgtcatattttcctttaattctttagagatatttttatttatttatttgaacatatttatgacagctgatttaaagtctttgtctaattagttcaacatttggtcttctttaggaacagtttttgttgacttttgttctgtgtatgggccataatttcctgtttatatctagtaatgtgtttcttgaaaataggacatttcagataatataatgtggaaattctgaaatacagatacaggtttgttttctgttgtttttattgtttctgatgatgtttaattgtttactggactaatgataaaatatctgtattcatttttgtgtgtggccactgaagattctgcttaattagcattgttttcagctaactattagattacatttcttaaatgccctgaaccaataagtctttcaggctttgctgagtgtctctgacttgtgttgtaacattacttaaatgcaagcagtttacaactcctccttagctttcacatcctgcttctgcaagtccttaagattagtgggatgtaagaaactaaggtttttttggttattttctgagcatgtgcacagccctgcacatgtgcatagcccttcaggtttaccagaaatatgctgaagcttatcaaaacccttattgtcataccattccccaatttttcctttaacagttttagtcaacttcttattcccaattggcatcactgcctcaggcagatgtgatattaaacaattgtcactgaaagatttcaacaaatgctatgggaatagggctgctcccatggactgatatctgagtgagactctggaaatggagcttcttagtgagatttgagaaaggtcaaatagtaaacattctctgtagctggggcatttgaggaggctaccaaactcattctgctcccttgcatagctgttaggctactgtacttgtgagggtgttggttttcgaggctgccatggagctaagtgaagaaggaagggagcagagcaagttaaagcaccataataagccttgccattcttactgagattcagctatttttattaaagactccttggatggttaaaagcctctattattttccagacatttgaaaaagttaatttttgacaattttgaatagtgctctcattgcttttatgaaggtgtagatttttggaggcccttcctccaccatctggaagtgcttctgttactgggaagtgtggagcatctcagttcttgacattttggaagacataatatgtccggaattgattccttctggtgggttcttggtctcactgacttcaagaataaagctgcagaccctcgtggtgagtgttatagttcttaaagatggtgtgtcctgagttcgttccttcagatgttcagatgtgtccagagtttcttccttccggtgggttcacggtctcactgacttcaggagtgaagctgcagaccttcacagtgagtgttacagctcttaaaggtggcgcgtctggggtagctttttcctcccagtgggttcatggtcttgctgacttcaggaatgaagccagagaaccctgtggtgagtgttacagctcataaaggtagtgtggacctaaagagtaagcagcagcaagatttagtgtgaagagtgaaagaacaaacattccacagcatggaaggggacctgagcaggttgctgctgctggctggggtggccagcttttattcccttatttggccccgcccacatcctgctgattggtccattttacagagtgctgattggtctgtttttatagagtactgattggtgtgtttacaaacctttagctagacacagagcactgattggtgcatttttacagagtgctgactggtgcatttacaatccttcagctagacacagagtgctgattggtgcgtttttagagtgctgattggtgtgtttacaatcctttagctagacacagagtgctgattggtgtggttttacagagcgctgattggtgcatttacaatcctttagctagacacagagtgctgattggtgcgtttacaatcctctagctagacagaaaagttctccaagtccccacccaacccagaagcccacctggcttcacctctcaataattcagccgagagaccaattagtaaagtaagcagaaaggtttattaagggaataaaagtacactccaagagaggagtgggctgacctggctaaaaacacccccaagaattctgcgttgcagtttttatcatgttgggcgtttctttaagttcccacatgtcttaagtctctgcctttttgtttgtctagttttccactgttgtcttacatccccatctttgttcccatctagttcccacccaggtttgtgggatcctcccttactgtcatttggtgcacatgcctggggtccagtgatcaataggaatccaacctaatgatgacattgttcatgactgcctccccaggaaggttgcatagcagttaaaactgtactgattgtgcctgagtatgtcaggaatttcccctttatcctttctcctttcttgtcagcatgtagctggctacattctgacaatttaaccacagaatgagcaattactgggtgtcttaagcggcatttcaggacgttcctgtctacataggtatcaccccttctctctgctaatacctaactacatgtttcaggtggtctctgaggcacaagattttccagagcttcctcaccgagagcattccttttctgctcttgtctgcctgcctgctctaaaaattccagaatgtgagggtttggacctagtgtaggacttgatgctcagctttattaaatgttatgtcctatgatgggagctgactggcccaaaaaggattcccgaggtgagggtagaaaagtgggaactacagcaaatggaaccccctgttatgaaaaggagaggccaggaaaggaatgcaccatttttgtcatggcctccttctccaactctccttgggctagatatttggcttctctgtgctcttccatgctcatacttatctttattccagatccaattgcctggtagcttaactgttgcttctgcttcttcaccagaagataaattctctcaagggcaagacaaatgtctgattgcctctttgcatccttgtggcttagcacaatgcttggcatgctataggcactcaataaatgtttatgaagtaaagtcaaccacaaacacctttcatttcagaatctcaaacataggataggcagggcatagtaaactctgcaacaaacctgtttcaggcaggaaagcagaaagggaactgtcagctccacccatatcttctttattagagggatgaatggccagagtcaaagtcacagaagacaggcaggcattgacaaggcagagaggtatgcagcaacttctggtttgagaggtgcctctgtggtaagcgagataaataaaactggtaaatgatggatctcctcaaggagatgaattgagccaagagctagccttggctgctggtgcacacatcaggaaagcagtatttgagatccgggagtcttgttctttattaataggaggatctggctatgcctcctcattttcattgcattgaaagtaatcactaacatcattatcatctcatcccttctgattctgaaggactttgacatttataaaacaatcacatatggtgaccctcatagaggacagacaccctttaatctctattttacaggtgaggaaactgaggcgctttttccaaatcactaattatgataagtgacagagttgatcctagaacccaaaatgctggctaattgtcccatatcttttttttttttggagcggggagtgggggacagggtctctgtcattcaggttggagtgcagtgatgcaatcactgcagcctccggctccctggctcaagttatcctcccacctcagcctcctgagcagctgggactgcaggcaccaccatgcctggctaatttttgtaatttttgtagaaacagggtctcgacatgttgcccaggctagtctcagactcctgggctcaagtgatctgcccacctcggcctccctaagtgctgggattacaggcatgagccacctcattggcctcatatcttattacggtttgtcttgagttcaaagcaaaatgcatttctttgctaatttctttgggtacatggctgtttgtcttctcaagaagttcgagacccccgcccccacaactctgcagcagtctctgtatttccatcgattttttatcctatggataccctgttttccacctttgtttgaaggaatagaaattataacctgaccctcaaatgagtatccagaaaaaagtgtaccacttctagtcagattccctcaaaagttctttgtcagattttaatttgtttgaaggtcaaccagattcctctttatccctcaaggttcagcataaatgtcatgtactctggaaggtcttcttgaattccccaggccaggttaggttcctcctttggaagtttccatggtattcagtacttttctttacagagacattagcataaccctctgcaaccacttctcaaaacagtgcatgtactgcccctctactggtctaagtcacctaagtgagtaccatgtcaaggaaagcgaagaacaattgtccccaactgcattcctgtggcttgcccaaattctgacacacagtgggctcccagcattttccaaatcacagactctgattatttcagttctcagacctgggtcccagaagggctgccttcactttggtttctctaggccagcagcttcttgtataccaagtccaaaatctggatctcctcaggggcatattctgttggctatatttccccccacccactatgtatagggcagaatttcttctttcactgcatgtctcataaatttttgttggaaattggtcattcaatttgcaatatactatatattattgtcattcaatgtcagtttgagataatgacttcttggtctgtacatataaacattgttgtaaggatgatgctaatgatgaaagcgcatgcaatatatatttttacataatttgggtatgaaccttttttgtgggggttggctaacgtagtaatagttggtaagattaaggggatgagggctattatagtagtggaagaatacatgtttgtaacttttatttggagttgcaccaatatttttgcttcctaagaccagtggatgactctaatcctttaaaagttgagaaagctgaccgggtgcggggctcatgcctgtaatcccagcactttgggaggtcgaggtgtgtggatcacctgaggtcaggagtttgagaccagcctggccaacatagtgaaacctcatctctactaaaaaaaataaataaataaaaatacaaaaattagccgggcatggtggtgggcgcctctaatcccagccactcaggatgctaaggcaggagaatcgcttgcacctggaaggcggaggttgtagtgagctgagatcgagccactgtactccagccctagcaacagtgtgagactccatctcaaaaaaaaaaaaaaaaaaaagttgagacagccatgttgtgggcatgggggcatatattatacagataatatcttgtaacaactcttttatcagatttctccacagcccagtgttcatggctgttgctggtttgttgctgtttttcttgttgttgcgtgttcatgtagtgaccttcctgaattaattctgtctattctgttttcctgggagtttgcagcttctaagttctcttctagctcttatttgtttttatttttgtttgtttgttttcttctgttttgagacggagtttcacactgtcgctcaggccggagtgcagtgctacgatctctgctcactgcaacttccacctccctggttcaagctattcgcctgcctcagcctcctgagtagctgggactacaggtgcatgccaccatggcaggctaattttttgtatttttattagagacgggtttcaccattttagccaggatggtctcgatctcctgacctcgtgatctgcccgcctcggccttcctaattgctgggattgcaggcatgaaccaccatgccaggcccttgtttttgttttttagttcttgtttttatttttcaatcctgattcctagtgattatgtctctgtcagtataatttagtggccagccaatgagtggtcagattttaaaaaatgctttgctatgtgtcttcctccctttgccaaagggacctatgtggataccttgaacttcaagcatcttacaagacagccttagcttttacttcctgcttgtgcagggcctcaaggtcagtcataggtgagtgattggtgctctcttctttccgaggtctttttcggcatgtacacatccatgcacatgaatgcaaccttgaagattcccaggagcatgtaggagattttcagagtctctctgatcttctccaaaatttgccattaaattccacaccaagctcttctttgctccagctaaaatcgcaaccttatgcagctgagaggtcatcaacaatgtgctgtcgttttggtcatgcgctggagttagccctgcttctccccaaaccagctgaggtctgacttcaattaaataaccaccacactgtgagaacagagatttgtcagggcaacatgactttaaacaaagtgttgactgtgctctaataatggtgcttttttaatggaacgtcaaaagttctcagatctttcaattgtctgcaagactgcaggcttctggccactggaccactggaccactggactgggaagaaggggaaaaatggaaacatcaaataccccacatcttcccgaggctcagtagtttctctcgggtagacaattttcagttcttcaatggcttaggttaattgctagaactctgaaatggttgattttatttattttgcctgtatttatgttgttttagagagagagagaatctaccaggttcctcaatctgcaattctggaagaggtagtgaatgtgtagttttgaacttgtgagtgttggtgggattttgaatgaatcgtgccaccttaccagctatggaaaaggatgttggctaattagtggcacaaaaataggatacaagcaatctaggaacttaaccaaaaaaattgttttaattactctgcaaatatttacttacacgtaaacaactgcagtgatcatcacacatttttcttatctatctaaagtgaatttttaggtttgtgttgttgcagttggtggccatggtaatgagttgtgtatgtcttgtgaacacttttttggggtaaagtcaactatttttagaaactgaaagcaataattttggtgtttactcctgttaatctcaattattgaggagtacacagagtgtggctgatgtatgaatctcagctgttgggggagccgtgtgccccactctcccatatactatgtagattcttttcagactgctttgttggcccattgctggattttattttttaatgttttattctgaagtaatttcatgacttatttggcattacaggaaacaagccagtggtaagaatatttaagtggttaggtaagcaaagctgaactgtaaaacttttttttattaaaacagtttttatttcagttttttttggggagaaaaggtggtatttggtttcatggataagttttttggtggttatttatgagattttatggcacccatcacccaagcagtgtacgctgtacccaatgtgtagtcttttgtctcttacctgcctcccacccttccccttgagtccacaaagtccattgtatcattcttatgcctttgcatccttatcattgctggctttttaaataagggaatctatgaggcatttcttactaattccattgatgtttatttttctgttccgttaatcactagaaacaagggaatatttgtggctttgctcatgttaacttttatctctcactgaattctggacacgctaagttatatatgtgctgcacttcacttttctaccctcttcaagacaaaaacagaaaaaaaagttttctagtcacaaaatgttaggcaactaacgtttattgcctgactaatcattttactttattgactgagtaatcattttatctacatgatgccactgggaggtagtaatttgtgaaataccaccttggacaattcattttctttctccgcacaaggcctggggatgcttcgagccagattgtgctaaagaatgtcatgtttccaaaggataaggtttatcttccatgaaacagaccatttgcaaaattaataggtaaattagcaaagtgcaacagcccattagacccactgtcagagtttagaatctgagttggggaaaggaagtaaaagctaaatgtgtaaacagaagtaccctgaaatgacagcagctgtcattctgtggtggagggttgcagctgcttaaacaaagccagcggagtgctgttaacatgcagtcctgtcaatatctgaatatacactcacagggcaaatgcatgggctataagaccagagctaggaatcatgcttactcagtgtatgttaaaaacattatactgcagggaaagagtcagagcttatatctaccaaccatttcttcatttatttgaaaagtttctattgaacactagctgtgctgaaattttaataatccttactctataccaaagctctgggtatggccatccttttctccctggagagctgactttctcttgtaaactggaaacagctgccttgatagccaaaaggttattgactattttggcttaagcatggactttacaatcaaatggactgtttgaaagctgtgtgaccttggaaggtttttgaggctttcattgtaaagtgaggaggatcccaccttgcggagtagtcttgtgatgattaagcgagaaaaatctatgcaatactcatcatagatagctcttatttaattattagtatgtgccaggcagtgtgctaggagatctacatatagcatgccatttaattctcacaacaaactgtaaggtggcaattattatgatccacagcttacatttggggaaactgatatttaagaggtcacacaagttgtccaaggtcactgagctagtgagtggtgaaagtggacttgagatccatgacatcaggccccaaagccttgacttttaatcaccaggccttcctatgcttacagatggtagccctcaacagatgctgggttccttctttgtccttattacccacttccacccctcatgcctgccataggaattaaaactcttcaaagtacttttctagatagcctctgaggtacacaatcttcacattggttaataaaggttgttgatcttcaaaatgtaaattgcttgtgagccgagacacccctggatgaaaatcccctcggatacttcttgtaattctgactgcaaaagtgcagggggttcatttcccttttccttctcatataaattaaagaagacacattatttccattttcctgtctcagatcttgccttctccactattttggaggctgtgcagaataaatactgtaaaatggctcatttctgcttacactttatttcttagtacccacatagatcatctcaatcacctatagaaatatttgtgtcaaaggctaaggcagctgataaaatattttccttgtaggttatgcatctgagtatcccagcatctcttcattgaaagaaaaatagttacatttggtgattgtgatgacttaaggtagtgaaaatatttttactgccaacaaaagcagttttatggtgctcaatcctgaatcactaaaatctggattttcagtagagcaaattgtactgcttataactgaggttttttaaaacgaatgcaatttattatctaggcagtcttctgtggcagatttgtctatgtggttaatgcctctaaagagtctgtagacacccaatatctaaagtaagtgtgtgtgtgtgtgtgtgtgtgcgcgcgcgtgttattgagcattcctgtgatagcgagggaatgaatggcacataagctaaaatgctgagctcctaatttatgtaagattcagaagcctcatgttataattctcttgagtcctcattttttttgctgttttttccctccgctttctaagtttcttattctataattaacttttcataaatttaggtcatcttcacaattttattatgaagacctcacagttgttttgaagcaattgaggtaatagaatgttggacatagaatttaacccttggcccatctaattccagaatttcttgtcatactaccttctgtagaaattggtgaacagtctcctactcttaaatagagacagtagtgtctggggtgagtgggagaattcaattcaatcttttatttattagtggcttactttttgctcagcactcagctgtgagctggcaactggggagaggtacacagacactagatagttcagacccaattcctttccttaagaaaattatcatatattttggaggagtggagtaaagaaggcagcatgatctcaagaaagatttaaaggacaacatgacacttatttgaacagcagaattctggaagcaaattagtcttgtggaaatttagaaaactgaactgaaggggtaggaggatactttgtggtagactgtgatttaatggatgtgctaaatactccccaaagatggctcacctatagaagaaaaggacctggtaccggagagagggaaagatccagcttcccctttgttccagatgagcccagccttgtcaacagtcctttcccacatgacagacatgggagtgaagttatcttggacattccaatcccagctgccatctgactgcagaagtttgggaagctccaagaaaaactagaaaaagaacatagtcaacctgcggagttgtgaaaaataataaaatagtgctttaaagccacagcatatttggggtggtttgttatgcagcaatagatatgtggagctttgaagatttgatataatctagacaagtcgaccagaattataagcaccagaagttgtgagaaataatatgaaatttattgacttccgatacaagttttaaatacatttttaaaaatcccaagtaaattctataaagcagcactgcccaatagaacttcctgaaacggtagaaatgttcttagctacactgtccaatatggcagccactagccctgtgggtgtagagcacttgaaatgcagtcattgcgaatgatctttttgcaatccacaagttgagttgataggagagaaattaccagagtttgtggctatgttccttctaggtttggcgtgtgattagttgggtacctggggctagagttgcaacggagagaagggccatagtgccactaattctctccatgccagtgtctctcaaatcatggtatgtaagattgggatacctgttaaaaatctcccacacaagttcttctgcttgaagagcctgagcactgcattataagagggagtctggattaggtagtgcaggtgcagtctctatactcaggtcttcacttaacaaccacccaatttatctagatgactgtgggtggtgttaacagctaggccttcctgaacagttattaagcatttcattagatatgtttaacattctttaagaccttttaaatattacctgttttttctttaatctgaaatgtgctactctgcaagtttcattatggttcatgggtttccttttcacacggaattacatttttcttaacttcctctcttgagtgcttggagaatattgatgtgaaaggtggttggtaatcacaggaagcaacttctatattcagaaaggatggtacttcctgatcatggaaactatggagaaacttgtacgtggcaagtagagagatctgattgaactacaaaaagtctgtaatgaaaaatagctattttcctttagaacatactttctctcaggcaaaaaccctgattttaatgaatatagaataatcatttgtaatattagttaccatgtacataaaattagggtaataaaatgtggaggtatgttatgtgtttttaatagattaaatttgccctgttttgttatactgaggtagacatttacttatcaaattatgtattcaaaaattgaagaatttattcaagtacattttactagtactaattctgaattgatagtgttcaaatttatgaaactcctgtagtcatcaaaagcaggtgagaatcctagggtcacaccccctccagaccttgctttatttccttgtagacattgaaggaagcattgctagctataagatagtctttcctgggatttttccataaattctctactgcaaatttcatactataacttaactctgtatcaattgccaacaacaaagacggcaagattctctaattggactttgttttgttgaaatacagctatgatagattcttttggcaataatatctttggaaatgctggaataaagtttttttaaaaaaacgaatagaatcctgagggcatatggggagtctagaccttattttttccttgaagatattggaggaaacattgctatctatgagatattatttgctgggatgtttccataaatcgctaccacttgaggtattattttcataaatttgctaaagggggcaaaattcagggaaaacatcagttagtctggatgactattttagaaaaaggaaaatgcagaggagtgagtcagatagaatgacgtagaattttaggataagtcatagaatgttgggttcatgaggaagcacatgataattcaattaatacaaaaaggaagaatccattgtacgattggaaatactatgaggctgagttcactcggggacatgcagttagctagcaagtgtctggggaaggggaggaattacaaagcagagctgtgaaatatctaatcagatggaccttttaagcaataatgtattgccaaactgatgaaaagtcattacctttgaataatagcccacatctgagagttaattattacagggtgagactatgggtgcctcatgcggacaaggtcaattatcttatacctattaaaatgtattatgaataattcacaggtaaaagttagctgtaaaacacgataaaaataaaaggtgaggaaaacattgaattcagtggtaatgtattttgataatagcaggcagataattatacaaggataatgttcacacataggatatgaagaattactagtcagattggtcttcttaaatgaacacaacaacccctgccattctcctgcttcagagaactgtcatgttattgcttttaatgtcactactgtttctactttgcatgccaccacgcccagctcagtagacatttatcaaatatttactctttccttgggtttatgtcaattcctggggattcagtggtaagaccagagcactgctccttggaaactcacagtctgatgcaggagataaatcagtaaacaaataattttaaacaaattaaccattatcgggatgaagatatttgtagaggcctagccctgggaatggattcttgagagagattaggactgagcaattcttggatcttggaaggtgaatgggaattgaccaagctaagatgaggtcggaggaggcatgtggctagaaggtgaagttgggtcatcagcaaaggctctgtaacataaaatagtatctggtatttgcatgtgtgtctctgcatgtatacatgtgtatgcacacatgtgtttgcctgtccacatatatgtatatgtgtgcacgtgtgtggatatgtgtgtttatatctgtgtatatgcatgtgtgcatttatgtgcacatatgtgtatgttcagatgtgtgaatgtgcatgtgtgtttatggtgcgtgtgtgtgtttgattgggtggggcaatggaatcagaggtgagtcagtatctctgcagcataggtcaaaaaacacttcaatctctatttataatcttcataatatttttattcttagttcagttggtcttgctgtgagcagaagtacagacttctgtaagaagtaaaattagcattacttcttttctctcccattttgcctgtgtgcccaatataggacaatgagtctttatacttttgtagaacaaagggaaagggggtgttcagaaggaaattgtaagagatgccaaaaggggaagttctgttctccctcacactctttctgttttacaactctttcatcttcacttacgggaaatttttttttgtaatgaatatacattacttttataacttgagaagaaacaagggatgctttaaaaaccttatgttaagcaccagtatgaattctcacttggagtgaaaagtaaaaaaaataaaatcatctatatctattaaaaacacattaagtatcagcacaaggtctattatagaaatgtgaaactattcagttcttgaatattaaattaattatttagattcattcagagtgcattttgattcaagtggtcttactacaagtcaacatgctttgtattagttatttatttgaggactcttcctcatgcatagtttttcctctaaaccagtctccagaagcagtgtttcccctcactgagcaacatgaatatacagacaatattcaaacgaattttttccccaaatcaccaccaattcttgtctgcaatacttaatagtcttctatcagatgtccctgtttccagttctttgtttcaccaatatctgttatgcaatgttgcttaaattcttacctaccaggtaaatgatagacatctgcccaagtcactcaaggccctctgtgaccctgctccctgctggctgggatctccagcctctctcctgctattcctctacacttcccctaaccatccaagctctttctagcctcttcacattttcacactgctccctctgcctagaatacccccatgtctggtacatcacttcaacccctccttaggcattaagatttcattctaatatggtctcctcctcaaagccttccttaatgtctccaagctaaattctcctgaatatattcccatggctctttgcttattcaaaaatttatcatgtcttagtgtaaaatttatcatgttgctatacgggcaaagggaaaacttcccctttaccctcaaggtttgcagaaaatcaatgacaaaaggcagattaataggagaaaaggcaaacaaatttacttgatcatacttttacacaatacagaagccttcagcgtgaaggcccaaaggtacaggggaaactccatttttatatttaggctcaacacaatatgaacaactgtgcagaaagatgattggacgagaaggctatgatctaatgcaaacagactgagttggaaaactcagaaaagcctgtctgttggcttttcagaagggtaagaatttaagcaacatttttcttggcttctctgcgtagcattcttccttctgggtgtaggggttttatgacctataatcatacaaggtaggtcagatcatttctttatggccagtttttatacaaaaagttggtgggtaaagttagagtaatgcttttaggttttatggctggctttggagaaaagggattctgatttctattgtctgccttgaggaagagggattctagtttctatgcctagccttaggggagaataagaggccagaaacagcagggcaggagatggtcacaggacaatgttggctttctgaggacttcatttcatttagggatatcgttttctgatcctcagtattgttgaaattattttgtttcaggctcatttatctcatattgtcttgtaaattcaaagaggaagatgcttctgtgtttgtaaccctggcaccatagcacagtcgctggcacctattgaaaactcagtcagcgtttcatgggtgaattaatcattccatgcgctcagtggtcccagttttcttcaattagaccatgaacttctgtgatctggaacttctgcacacactattgtactagataaaacatgtgatgtgataaatgcaatgaggggttgtctgtgaggatgtccaccagcaattccttccatccctgtctgtgcactctgctcttcttattaagagacaaaatcgttttccttccccatgagcctaggctgccttgccactatgatttgctttgaacacgtagctctgggccagtcctctgtcttggcattaggagatatatcggcttttacttttgtgctcttggtatctaacagccatgtaaagaagcacgaattagattattggatgataagagaccacatgggcaaagaaaggatgaaaaagttctcagttcttccaactaccctagttgaggtgccagacacatgagtgaagccctttggggatgttccagcaccagatgagtgtggtcacagtgaatatcacattagaaagcaacagcccaggaaattctgagaaatagttaactattttcaaccagaggtcagcaaacaatagctcatgtggcccactgtttgtttttgtaaataaaggtttattggaatacagctaagtgtattcagttacatattgactatagctacttttgcactactgaggggagttgagtagttgtgtctgagaccatatggcttgcaaagcttaaaatatatacaatctggccttttacagaaaaatgtatggactctgttttaaggcactaagtttgatcaagtttgttaaacagcaaaagatcactgaaacaactgctctcagatttcagcttatccatggaggttggaagggggaaggaaagatgtcacaagtgatatgaggtcaggccttaatgtgcatgcactgatgagagtccaggacatgaaggttggtacaaacagaaatcgatctctttttagctccagattttttctccccctttcttactaattttgagaaagaaaatactagcacagactaagcaaagttaagtaaaacatattccccaattatatgcagatgatgggattagagttgctgaaggtattatcttccctcattaccaaaagaaactgcacagtgaactgttgaaaggccaggagaatgagcgccaatggtctctgggggaaggtcctggctgatgagttggcctcttcttgttcagcttctttaactccctcccagcttgtgattccccaaagggcacatccatctgttcttcagaaatcaaagaattctttgtgttttttttcctgtgacatatgaatcttttctggtaaattctgaaatttttttacccacaaatttcagttaatagaaaggtggcagcatggcttggtagcaagagtgtgagtttcagagacacacagatacgggttcaaatcttggcttcactatttttttttccccgtttgggcctggaccaagtgctttaaccttcctgtgcaccactttccacaaagtgtggacaaaaatggaaacatagttggcacagaataaatgcctttttgttatttttataatcaaaatgtattctttgactatgctctgagatgatctcattcaatgttcaaaataaaaatcccaggaatatcactgcttacccagaagagtttaacagtaatcaccatttgtttgggaacataatgtgtccaagacattgtgcaaagttctgaaataacaaagatgaatatcataagtcatagaaacctctttagtatgaggattcagaggtgttaacagtcagacctactgggatagagggctaggctgagttttattcgtttttctgaaattagaatggtaaccattgatatccattaagtgcttaccatgtgcctaattttaagtactttacacgtgttagttactctgttcctgacgcccctgtggaggccgtggctgagacacagatgtaccataatgagctgtcctttccctactgggctccactgccctactttaacatcgcaggcatgggccagtttatttttcaatagagtggaaatgtgaagatgtttaagcctatatcatattaaatggtgtcataaggcaaaataaaacaaaagaaaaaacaaaagaaagcaaaaaaaaaaggcaaaaaaaaaaaaaaccaaccaaccagcttgactgttgtgtttcttcacagctggctctaaccagcacaagctgacaaggggcagtgagctttgaatgtccattatctgacctagctgaagacacttgcctgacccatgaacaatgggatttcgtataaacaacaatgggatttcgtataaacaactgtgtacacacttatgggctcattctgttttgtctgagtgctggtgttcattgctgagttggcacagctccatgacctcccacttctaactttaaaactcctgagcttccccctctttagtgacctactcagtaagtttcttcaaatgaatgctttcaggcctaggtagtaaacaaacttgacattttaattatttaaaaaaatagttttgtcttatttttaaactctagtcatttttatttagttctttgatgaggcatagagtgaataagtaatttgctgactccagcttgtagttggcaaagctgacatttgaacccaagcaggctgtccctagaacctgcattcctgccatcttatgctgctcgcctgcatagagtcaaatactgagcaccaggctcttttctatagtgaaatatcaggtgcttaaacatagtctgaaatgatcttcatagctgtgtggtttggcagaatattggtaaagaccttaatgatataaaaaataaaaatcactgattataatacatgtaaacacataggcacaggtttttagtgtccctagtgttttaatggtaatgtttaataacaaggtctccaaaaaaatgtgaatgtgtctagatacaagcttattataaatttactggcatagaggatgcagagcaatttacaaataatagtaaaaatgcatgctattcttactgtacattccacatgggcattttattctcacagaatgtattcattgattttttttccaaatcctggcattcatagtcaacctacagttaacaattgttgaaagcatataaacacaagtaccagtcagtattttcatttacatcagtgagtaagacaaaagtgaaacaatgaaggcatatgctaaagctttgcttgtttgtcaatgatggaagctgcttctttggcgagtcaaataatagctttagaatactagtagaatatttcctaaattgtgtgtgtgtgtgtgtgtgtgtgtgtgttacaatgtaatggaagcaacatgacacacttttaagtttaaatctatattactagtattttctccatcgctttcttcagtccagagaatcgataaaacaatacatcaggccatgatttgtataataacagtgtatagtttctgtggtgtgaataatcgcaccatggccaatcttaccgtaccaccatgcagttcctgaaggtggacctgagcagaagtgtgcagtagcacagcacttgcagttacaatagatataaacaatctcaagatcacagacatttgtgaaatgcagtcaaaggacagaaaatcatgagttgagtattgtctttgtttttaatatgattcatcagttgtaagtttgtgtaatttatcttttaataacaactatgtttcacagccaattcacaaaatttctgaatatttagcaagcagctcccctgaactagtataagctgtctgcagaacaccaatgggtgtacatgaagaatttgtgtacagggaaaatacaatcactgttttgagttagacttcaaaatatgcacctaaactctcagacattttcatatcatttataatagaggaaatgtcttccaaacttaagtgggatgcaaagggtatgttaacatatctcaagaaagtctgtgttaatcgaaaggaatctggtcagctgaagcagcagcaatctacattgggtccagatggagggagctaggactgatagacagctcataccgatgtccccattgcccaggctgtcctcatacagcaggtggagagaagcatcactctgttgtcttctgggtgatcattgcagagtgaagagtgctcggcacctgtcccaggttccttgtgcatatttttgcttgtaattgttaaaacaaatttcccctaggtagtagcattgcttctagttttaaaaccatgaaactgaggttgaagacttgtgaagtaattttctcaaaatcacttgtctgttaagaggtggagtcagaatgtcaacctggagaagaaccccaaagctttccctcttttatcctgaagattcaaataaataaaaaatacttagagctgagaatcacctcggatgttggtaaaggtcatgatgctgctggaggttgttcagaggatccagacaatgatggctggaatgattcctattaaaagtgaagaaatgttactggagtgaagtttggaatatttcagagcatatgttttcccccagtagcaagaattcttttgctggtaagttaaagaggcaggaaacaatgcagtgatattttctgctttcccttatgccttctgcacttttatcccagaacttcaagtgcaaattaaataaaaaggcttgtgatcttttctatcctagagaaataactccttaaacatccattctcttagttttacttatcttttcttaccttctgcctctcagtgagaagtagtctttaaatgaccagtgaaaggctgattcctgtctagtggccatagtcagccctgccttctctccctggagctactcggtgcctgtctaagtcactgagtcatatgtccctgaaaaggaacaaggaagttatgttcatttaataatctcttaaaatatggccttcgtcaaataaatcaatgaacttaagaaaacccagaactcagggcgacttgccttctgactgtgtgacttttgaagcatctaaggtgagcgtgtcaaataatacatgacgatcttcaattctcaaacgtatgcccagtcctgacaccatcaccactaaacacacattcacacacacacatacgtatccataagtacatttttcttgtaacttccaggttaagatttggttcaataaagcagatctggtatagctagtgtatcacttatggattggggcttttatttctctttttaaattcatggaattttataactttgtgggaaagtaagttttgtttctttcagccttttcattgcatgagaatacagtgtctcaggaaggttaattgacttcatttgagtcatacaaacatggatccacttaataataaatctgcttatacaactcagatgccttgatttttttaaaaaaaatctttatttgttttagaattttttaaatttacggaaatactgagacaatactatggagttcccatatacactgtacccagtttcttcattattcacattgtacatttgtgtggtgcacttattgcaattaatgggcccatattgataaatggtcattaactgaagtccagagttacttggattaccttagttcctacccaatgtcttttttctcttctgagattccatccaggatgccatgttacagttacatgtcatgcctccttaggctcctcttggctctgacagtttcttagacattcctcgttgaaaaccttgacagctttgaggagcactggtcacatgttttgtagaatgatcccctcatttttaatccagtgttatctctctgtttattcaatacttgactttttttctctaggaacttcaacaaggccttatcttaccttaagtgagcaatgtgaatgagtaatttgatgaaaagatctgaaaggacatcccttagtttgaaaaaaaaaaaaaaaaagctgtacccttccagaagcctggcataaggccagcacatccttcactagagacttcttcatgcaggagtgccctccggagtgcagacgctgcctgagcagaagcaacacaccaatgcttcatcatctgttaatatccttgcacaattactttatatatatatttgcaaacatctacctgctatatactaggcactgttctatgaacttgcattaattaattattacattatttcagcacccttatcagatagattctattattatcctcattttgtataagaaaaccaaggtacacaattaggatgtaatgtgcaccaagacccagaggggagacagaggatggactcatagaaaagtagaagacattttagcatgaagaggtgtgagtggtatatgatggggccacatcctggaagccctttttggccatgctaagaccatagattttttccccaaataatgatataatacagaaagattataaaaaggggtatgatctgctcagattcatattttaagggaattcctttcctgcagcatgcaaaatgggtttgaggtggactagactggatcagagaggctgttagatcttatgggtgagagagataatctgcataaaggctgaggaaaggggaatatttcttggtctctgaaattttgcttcaaacaggcctcattctctgcagatactcagagatgcaactgcaaaactcaagattttaatatgcccaagtagacgagaggatacacacacacacacacacacacacacacacacgtttgcttatttatatgtatatatttagttatttatcataaattgattggtagcaggtactaaatcttttttcttaaacttttgtaagcaagaaatagaacatttttgtattttgttcctatcaaattgaatctgaatctgagctgagatgcaatcttggtgatgattgggtcattctacctgggcatgaggactctggaaggctcacatagtaccctgaactgggggaggtcttctatgcttctgctcatcatggtcgacactggcattcccattgtccaggcaggtgctttccactgctgactcctgagagatgtaggccaaagcccttgtctctgccccaagtgccaaggtgtgtggttggccatcctagcccctggggagcctcccactctgaggatttcccaccccctaggccattagaaaacctgcatgagagactcactctgccctctttccacagagggacacttcctctcttttcctcagtgtctctgcctctgatccttcgaagagtggcagcccagtgtgaggaatggaattctgtatgatgatggacatgttctattctgcattttccagaattgtagccactaaccatcatttgaaatatggctagtgcaaatgagcgatttaatatttaattttatgtaatttaaattgaagtttaaatagcctctatggctgacagctacaatactgtatagtgagagagagggagaagccaggaaggaagttgatttaagcagctgtgctttctgccttgcaatgcaaatcacccctaagaagattacgtgcacaggggctttgtggtctgcttagaatggggagggaaatatacagaaattcttatctcaatacatcatcctgacacagatacattcactttcatgcttatatgctttggatgcgttgcctgtttgtaggttgcagggaggggctcagattggtaattgaagcaatactggaaaactcccccagaatattttctgctttcctttctcaccctacagtctacccattggaagcatggccaaagtcagggaggttcaggacattcaatgctgagcgaggtcagcttcagccttgcttcactcagcagagtcaagtgaacaggctgtgctgggaaatgggatttctcagactctcaaggttgtgcggatgtgccaccacccaccaacctctcccttggctgtccctcactgcttcagtaacccatacttagaaagcacattcaccatgaatgctcttagcaatcctgggaggttaattgatggaggtggtcaagacaaagaggcatttggtcatgcctagaagtcactgccaggctctcccacaattctcagtttcagagtcctataatttgttctttctcctttctttcttttctttctttctttctctttctttctttctttccttctctttctttcttctcttcttagatataattcatatatcataaaattcatcgttttaaagtgtttgtttcagtggttcttagtatattcacaaggttgtacaactatcaccactatgtgatcttaaatacgttcatcaacccaaaatgaaaccctgtacttgttagcaacttctctccattctcttctcctctaagcctttggcaaccattaacactaatctattaactttctgtctttatggatttgcctattctggatcatttatatgaataaaaccactcaataaatggtcatttgtttctggcttcttccacttaatagaatgttttcatgatttgtccatgttgtagtatatttcagtacttccttcctttttaaggctgagtaatattccattgtgtatacatatcacattttgtttacccgttcctcaattaacaaacatttggattatttatactatttggatcttatgaataatgctgctatgaatatcactacaagtttttgtaaatatgtttttaattttcttgagtgcatacctaggagtggaatggctggatcatatggtaattctatgtttacatttttaagaatcaccaaacttttttccatagaagctgcaccattttacatttttattaggagtacttgaagagtctaatttctccacaaccttgccaacacttgtcattgtctttttattatagttatcctagtgggtgtgaaatggcatctcattactgtttgatttgcattttcctcctcaccaatggcattgaacatcctttcatggtaaaggatttgtcattttatttaaattgcattacttttctttgtgttgttgatttgcaagaggtttttttatgtaatctatatactaggcccttgtctgatatatcatttgaaaatatgttcttcaattctatgagttttcttttttgtatttttacaatatatttaatagtatatatttaaggtatacaaaacatgatattatgagatacatatagatattaggttggtgcaaatgcaattgcgttttttgccactatttttaatggcaaaaaccacaaatacatttgcaccaacctaatagtaaaaaggttattatactgaggcaaattaacgtatctatcatctcacatagttacgcattttttttgtttgtttttgtggcaagagcagccaaatctactagtttagcatgaatcccatacacagtacgctcttattacctgtatggtcctcataatgtaccttagatctctagacttggtcctcctgcatggctgctgctttgtgtcctctgacctatatattcccatttcctatgcattttctaccctcctctgtcaaccctggtaaccaatgtgttgttctcgatctctgtatatttgaattattattttttaggatctacctataagtgagatcatgcaatagtttcttttctgtgtctggctcatttcacttaccctcgtgtcctccatgctcatctatgttgtgacaaatggcaagatctcactcagttttagggctgaataatattccattgtatatatgtacctcagtttctttattcatgccttcaatgatggatgcttacgttgttttcatatattgggtattgtgaataatgctgctgtaagcatgggagatcagacatctttatgagatggtgattccatttcttttgggggtatgcattgaatagggatcactaggttgtatggtagttttatttttaatttcttcataattccccatactgctttctagaacaatctacattcctgtgaacaaggtacaagagttcccttctatccacacccttgccaacatttgttattttttgacttcttgataatagtcatcttaaatatgaagtgatatctcatagtggttttgatttgcatttccttgatgatgaatgatgctgagcacctttacatatgcctgctggcctttttatgtcttctttggtgaagaaatgtctatttacatgtttttgcccatattttaattgagttatttgttttttcttttactttctcttatgattgacctaagggggattttttgtcttatttttttcccaacattttactggaaaattttcaaatatatataaaatttaaaaattgtgtagtgaacgtcaatatactcattacctaattctacaattaatattttctctttatgacttatcagatatctatttttattttccttcaacttttctgagtatttctggtgcaacctccttctccttaaacttcaaaaattctttttctcatcacctaccaaggctttgatccattcagggctagcggaaaaagaataacacaacaaaaccaaattcttctgcccaaaatgaggatctttatatggaacatctgtatttgagtggtcaaatttgttgtcatccgatttacattaagcataagtacttctgttctgcaaatcatttaaaatgaagaattatgatgtccttctgtgaaactatgaacacttttttttttttttttttttttttttttttttttttttttttttttttttgctagtgaagaacttcaaggaggacaaatgcctttaatgccactctcaacttggtgtgtcctcaatagatatagtaatcctttagggatgtggacattgctttccccctaagacttagtgagtgagaggttatcttctctattgccttattttatgtccctgagtttaatagtgccaattccatggctgttgagtttacctgctttatttgctctaaagagaaagttcagcagaatttcagaaggggctggagaattgcatgccaagcagtgtctgccctatatcaattttgtacagcacgaggaaaagagaattgaaaccaaatttcccattatgtaaaagtagctattaaaaagatacaactgaatttaagatgattgtcaacagagtgggatacagcattaaagggaggtagggacacagttaaaggatttatttgcccttttctctcattttctgttcctcattttgtcatttacttcagaggacatcaaaaagtactattttaagaccaatctgaatttctggaacataaccatctgatatgcttatttcaacacatgaacatgaacagatgtttactttataatgttaaatgtgccagctgttctcatgtcagaataagcatctaggcattttgtttaaaagtgaaacaaagattttaaacctctgttcataaacctccatatgaattcagctttccttccttccttcctccctccctccctccctgtctccctccctcccttctttcctccctttcttcctttagccctttcttcctcctctccttctttccttccttccttctccctctctttcttcttccttccttcctcctccctttctttcttcttccttcctgccttcctgtctgccttccttccttattttgaaagaatcattggtttttagaacaatatttgctatttctggatgtatcatagcatgaatatcatatatattttattggctaatatcttcatgtcatatattacaggtctatacttgctcagcttgcatatcttctactttttaacctctgatccaatagtgatactttaacaatgaagaaagtacgagtatcataaaagaagtagcataaaaatctaggcaaagttttttatgttcaaacacctagatgctgcctagctttgtaattaattaagtcaacccttagcacatcgcacttaactacctggtcaccttgtgcgatggctagtttgaatataccataggcatttggtatattcaaaccatttggcttcttccctctaactactgatcttcccaggcaaagggaggctttaagacatcattctgcccaggtctcatctcttctacctgcattgcagctgctgagccccaaagacgataatcatagaaggtcaatgcctgatgacatcagagaagtcagtgaatgaagatcataatcatagaaggtcaatgcctgatgacatcagccaagtcagtgaatgacacactcttatcattgagcacaggactaaatggggtttaaagaaagtgtcctagatttagatatgagtttttaaatttccatccacagatgtaagaggctggctacattccttttggcaaacatccatgaattttggtagctgtcaccattcgaacagcattgcctattaggctttttattttttcctgttgtggcacaaaaacacagaaggtcaaggatttcccacattaaattgctttagttctgtattctttatgaagataacataccggatttaaatctgtactccaaagattgcactgggagtggggcgacctaacccacaaagatagaactggtggcctcagcttagacttttctctattgttgcaagcacaggtgctccccagggggcccgcagaggggctttgccatctggacaagtagatcagccttgaaaaaatcattaacacctaagtgaagtgttcttttttttctttcttctgattttttaaaagagattaaacaaacataataaaagagtgtttggacataaggtgtgaaactcgttatatcactattccaggaacatgccaggaactatatctgtttacttattcctgtccattggaaggaaaaatagaatagtatgcagtccttaaatatgtttatgcagaatgtgttatatcatagggaagtgattttaaaatatcattaattgatgagacagagtacttcttatatgtttaatgttatatcaactctttaaaaatgtttgcctatgtataaaaagaaaaaataattctggaggaaaaatgccagaatgtttacagctatttcctggttacagtggtctttgcaggagcctgtaaatcctgacatcatccggctgccagtctccctacccccaacttctaccacctcacctccccctacaccccagttaaaccatgtgctttctattccccatctctcagcttagcatctttgtgccagctgatgccactgcctttccctgtattcaactgcttagttaattcccttaccccttcaagtttgactaaaataccactttttctaggaggcctgtgctcatggagacactcctatgtagtcttgctgctgcctattcctttccccatgcccaatctccctcagtgtctcctatttttgctttttttcttagtactttccacttaattgtgtactttataatcatattatgcaacatatatatagttaaatgtatacatatagttatgtattacacacacactttttttaatagagtgtagcgtatgtacaagcacatgtgtctgtgtaactctcctttccataatgtaaattccatgagggcaaattacatttgctgtatttaaatccaatgcttggccaggtgaggtggctcacacctgtaatcccagcactttgggaggccgaggcagggggatcacctgaggtcaggagttcgagaccagcctggccaacctgatgagacctcgtctctactaaaaataaaataattaggcgggtgtggtggcatgtgcctgtaatcccagctactagggagactgaggcaggagaattgcttgaacccgggaggcggaggttgcagtgaaccaagattataccactgcactacagcctgagtgacagagagagactccatctcaaaaaaataaaaataataaataaataaacaaatccaatgcttacaatagtatcttgcatatagtaggcactttaaataaatgttgaattaatgggggttgacattatggatgatttataataagaagaacataatacaattccataaaacaaatgattttttaatagcaaagagagtatgaatagcataaaaatgagtagcgtaaaaatctgagcaaagtattttagcaccataggaaaagtaaaaaaaaaaaaaaatctgaataaagttttaagatgttcaaatacctagacactgaatggtcttgaaattaataaagcaaactgttaaatttcaggttaacccttggttcatcatgctttaccacctggtcaccttgtgtgatgtttagtttgaaaataactgtggacatccactgtttctccttcactctaggcctctgatcatcacaggcaaagggaaaacctaacagctcattctgcccaggtctcatctctcctacctgaattgctgttgttgggtccagaagaaactaatgaatctatgcagatttgaccttggcactagagaattatgaagtagcagctctgattctaggttactgctccacaccatctccagcaaagggacttacccaaaagacgagtgttccctttccaaatgttagaaataattagttttgtaaggcttggggtcaatgtccattggtttgaaaagaaaaaaaaagacagaatttaaagatttctgcagtgtcaactcttttgtgtcttgcagccacagctaaagcatgatgcaaaatattaattcagggaaattttattttggaaaattttacattgatgtgaatttctgataatatgtgtattttctcccaaaacatttcttattagttcattgcttatttgtcatgatttctgtgtccctcagtgtatcctgaggctgggcatggtggctcgtgcctctaatcccagaactttgggaggccgaggcaggtgaatcacttgaggtcaggagttcaagaccagcttggccaaagtggtgaaaccccatctctataaaatatacaaaaattagcggctcatggtggtacatgcctgtagtcccagctactcaggaggctgaggcaggagaatgacttgaacctgggaggtggaggttgcagtgagctgagattataccactacattccaccctgagtgacagagtgagactctgtttcaagaagaagaagaagaagaagaagaagaagaagaagaagaagaagaagaaggaggaggaggaggaggaggaggaggaggaagaggaggagggggaggaaggaggaggaggagaaggagaaggggaaagggaagaagaagaggaagaggaagaagaaggaggaggaggaggagaagaagaagaagaagaagaagaaggaggaggaggaggaggaggaggagaagaggaagagtaagaaggagaaggagaagaggaagaagaaggaggaggaggagaagaagaagaagaagaagaaggaggaggaggaggaggaggagaggaagaggaagaagaagaagaggaagaagaagaagaggaagaagaagaggaagaagaagaaagaagaagaagaagaggaagaagaagaagaagaagaagaagaagaagaagaagaagaagaagaagaagaagaagaagaagaataaacaacttgggatcattcactgacactgaggagagggcgagagtccctgctcagaggtaatgcccagggtcacctggaggtctggcaagagagaaaagatgaggcatggactttgattccttcaaaaatttccattagaacttgaaattgagttttttgtttgtttatttgtgcaactggcattttcccaagtaagtgggaataaaaatacctctagaaagtgtggtacattttttgaactacatcacattatttcattatctaaataaatccagagtgcaataaatgttaataaagttttaaggaaaaaaaatccttcacatactccacccatcgcatcattgtcatgtcttagccatttaagagatcaatatcccaaacaaaataatcacattcctcgatggccagaaattgctagattaggagggatttgaaggtgggagcctgaattctaagtccagttctgcagtggctcaacccatgacatctaacaaacctaacacctctctacctcactttctatttctgtaaaatgggcatctcttcctttatttttctggattcaaaaagaattggttgttaaaggaaaatttttgtcatcagcctcaagtatcgtaaatttcctttcagtgcaagctgaattacatacaattattattccaatttggacatcttacagtaaaagtgacgacaaataacttcatatatacaagcaatgcttccaggataaaacttttaaaaaaaatcactatcaatgatgtaacagaaactgctgaagtgaatacagggaattaatatgtcaagtaactagttggacctacatgatggtgttttgttcactgttgctttctaaatcatttgagtatttacaactaggcttatgatgttctttgagttttaattaataggctaaaaactcaagtgaactttttttcacatttattactgcataaaccagactttaactcaaatagtcaaaatggagaggctttactgatgaactgcttacgaaggtgtcagtaggaatggaggtatccacaggcaaaatgaaggcacctggatgctagcaaaagtgggaagtcatcactaagcctggtactgaggaggaaatagagctggagcagtggaagagaagtgcccagtggaagctagagtcaatgaaggagctcaatcattggtagttctcaaaagcagagaggaatccagaaggaaatgtcatgatctcgctgtcatctccatttcctgctggtgcttctattggcgggcggacatgggaacctggcagtgcaatctgcagggacaaagaagccaaacaaaggcggaaaatgtatctcgggattggaggtacaaggaaaacactgagcacagagggatggaaattacaatgccgtttagtgttgtgacagacattggcatttatgtgtctttgctggagctgcagttctggaattccagagtaaggatgctacaaagagtttccttgctactacctttatcctaagaatgagtctgactatgtttttggtggcggtggattcccccatcatcacttagtggtcattaattgtgggcactaattgctgagttctctaagccagaattgctcagcagttgataactgtggtgaatcagcaattgtttatgtccatgctatctttggtgaaatcttacctgactacagagaagcttgagaaatgtgttttttctcctctgcaacctgggcagagggcccagcttacagcacccttctgtgaacactaaatcacagtgcaaactcactcaccgtgcgctgtgcttcattccacagaatatggagcagagcctctctgggcaaaactgtgcagtgggcagtatctagcaccatttgtattccatattttttcctgcctcgggcccataaaagtagcaagtttctttggacaatctctgctgcaatcagaactctcattcaaactgaaatgtgagataacagttgaagaggaactgcaagcttcctgggggagggagggtgtgtgtgtgtgtgcgtgtgtgtgtgtgtgtgtgtgtgtgtgctctttttaatagacttataaataaaaatgtctatgagggccaagcagtcacataaatgaagacattatttctacaaagacccatcttgtctaagcaataaatattaaggaaaactgccttcctgaaagatgttaaattacaaattttataaagttgaaaaaatgagtcttacataaatatagaatgaatacaagtagaaaatttgtataaccaattgaagagggaaccattaatgagttatataagtaaagttggttcaaatgggaagtaaagttggttcaaagaatgcttgaggaacagagatttgtgtagtcagtcaggacagcaatctgctcagagacaaaatagttaatatcttataagactatgaatcataatttttggagttaaaattatttttatccccactggacaaaatctacaagttaatacgtggtcctaatcaatagtaaagtgcacatcaaacaaagataaatcctctaaagggataattaatccaccagataattaaataatcttctagaaaattaaattaaatattgaatagatctgttcaacaatgcttcatatgacattgaaagggtatcagtcattcctttgtcctattcccaatcttcagctaacttttcttaagaaaataatatagtagcttctatttttctcagagtacaccatggttttcttaggtttctcaatgttgatagatttaaatgtaaaaaagtaattactttaaaaaatttcctacaaaattacaaaaaaagtggtcccgggtcttactttttgccatctgtagtgactgagtagatggtcatcgaagctggaattcagagtttgacaatgttgtgtttatgccgagatgatggtgagcagtgaagagaaaacccaagggaccccttacaggagcagctggttagtgggaatgtgggacccagtgttgccaagacttctgactttctagaaagccccaagaaactctttataataaatctcttgatttttaaatattgacaaattaattcagaagattaaaagcactgtatgggcaacaatttcaggctacctctggtcagagagtttccatcttgcaaatttcttcataagcaaaataaaacaagctttggtagggaaattctagtttctcagatgcttttgtacgcaacctgtaatagaaaaccaatagattttctctatataaatttggatcctagagcctagaatgtttaagtcttctcagttcaacaagagaacctatcatccattgtcggtgaacccatcagtcaatccaccactccatccagcaaatgtctgcagagtgtagacaatacaccatgtgtggtgctgaagatatggcaatttgcttccatctttcctggacattttgcagccaaatttcccagtctccagcttttgatcccaggctgactccttaattcactgcagactgactcctcccttcaaaacttttctgaaattactgttttcagagcaatccaggatcacttcattgtttaattcagcaaacatgtcttaatcgttatccagcctgacttttctgtgacagtgaaatctgttctgattttcctgaaaacctctctttgggtgttctggaaagttttccactgcttctctccttgccattactgtgcattcatgttgtagtagattcttctttcttcacttcttgattttttgaatttatcatcccttcattttacaatctttctcctataagctgggcacggtggctcacgcctgtaatccccgcactttgggaggcagaggcgggtggattacgaggtcaggagttgaagaccagcctggccaacatggtgaaaccccatctctactcaaaatacacaaattagccaggtgtggtggcacgcacctgtaatcccagctattcgggaggctgagacaggagaacagcttgaacctgggaggcggaggttgtggtgaacagagttcacaccactgcactccaggctgggcgatagagtgagatcccatctcaaaaataaaaaataataataataaaattaaaaaaatatatatttctcctataaaactcatcagagggaatggcacccacacacactgttccatctctccatgcccccaacatccaactagtcactgactcctttatatgctacttccataatagacttcaaatgatttccttctccctgtctctatctgctttagttcaggctcttcttattttgtactaaatgtaacagtgaagatgctttcgaccataagtaacagcaaacaggcaacatggcttaagcgatatggatatttattaacaaaaataatttgtatttgaggctgaagcaggtggatcatgaggtcaggagattgaggccatcttggctaacacggtgaaaccccgtctctactaaaaacaaacaaacaaacaaacaaaaaattagccaggcagggtggcacgtgcctgtagtcccagctacttgggaggctgagacaggagaatcccttgaaccagggaggtggaggttgcagtgagccaagatagtgtcactgcgctccagcatggacagcagagcaatactctgtctcaaaaaaaacaataacaataatttatatttggacagttctagtattgtttaattcagcacctcatcacagataagtaatttctattttttactattttccttaagcctgaccctagacacgtgcagaagatccagcatctcaacagaaagaattacatccattagcagaaggaagccttctttacaactcactttaagttcttggcctgatatccttttatgtcttattggccaggagtgtgtgatatgtctgtctaaaacaatcactgcaagagaaatttaagcacgttcattaatttagaccagttatgatttacttttcttctgggacttacctcccttcagactcatgttgggtggatacatgaatcaattagtagcagtagtgtaatcataataataactacaaataaggctaaatctgagcaggccagatgctgttctaagcatttacttgtattgcctcatttaatcctcacaacaaccatatttgctagacagcataattattctcattttacagcaatgaaaatgaaaggttagaatggttcaggattttgacaaaggtaacacagctgccaggactcatatccaagctgcctgatttggagctctgctcttgcccactgatgttctacctaacatgggttttattagcatgacagaagtatgtggagaaggagctgctgctggtgtgtcagacaattcaggctgctacaataaaatatcatagattggatggcttaaaaataacggaaattaatttctcacagttttagaggctgggaagtccaagatcaagttgtcagaaggttcaatgtacagtgagggctctctttctggttcactaacagtgccttcttgctgcgtcctcacatggtggaagaggccagagcactctcagccttttttttttttctttttaagagacagggtcttgctctgtcacccaggctggagtgcaataatgcaattgtagctcactgaagcctcgaattcctgactcaaaggatcttcctgcctcagcctcccaaagctctgggattaaaggtgtgagctgttgagtctgtccttcaggcctcttttataaagggcactgatcccattatgaagcctctgttctcaggacctaatcacctcccaaagggaaacctcctaataccatcatcttggaggtaaggatttcaacatatgaatttagagaagtggaggtcacacacatttagaccacagcatttggctaccaagcatctgctgaatttctactactatgggactgtaacaatgtcttcctttcttccttccttccttccttcctccctccctccctctctcttttcctccttccttccttcctccctcccttcctttctttctctgtttctttctttctttctttctttctctttctttctttctttctttctttctttctttctttctttctttctttctttctttcttctttctctttctttcctttctttctttctttctttctttctttctttctttctttctttctttctttctttctttcttctccctctttttttgagatagagtcttgctctgtcacccaggctacagtgcagtgatgccatctcggctcactgaaacctccacctctccggttcaagtgattctcctgcctcagcctccctagtagttgggattacaagtgcatcaccaggcttttctaatttttgtatttttagtagagacagggtttcactatgtcggctagggtggtcttgaactcctgacctcaagtgatccacccgcattggtttcctaaagtgctgggattacaggcgtgagccaccacgctgggccataacgtgtttcttatttccatccttgctccttttctcacctccctctcaaaccagcttccatactgctaccagaaggtccattccaaaacagaaacctgatcttctcttgtgctaatcgcccaatgcctcacagttacctttaggagcaatcccaacttctttatcaaggagcatgaggctcatcaacacctgactccccatctctcctccctagttcagcaaacatctttccttgttctctgtacttcaacgttgcctaatgaattacagcctccagataataccatattcccccatactctcttgactttgcacatgtggttattattattatttggccaagaatgtctttaggctctttttttccccccaaacatagtatgacatttcctctaggttttcttcactgacatcattctgagtttgctgagcttcatttttgctcccatggtgttccatgcattatgaaatacttgtttgccttctcaagagtcgcttgagtgtaagggccttgtaagctgcttgagaacagtcattgtgatttttttcacctctatctgctcaatgaatcttggtataaacactgaaaaaatacgcagaatgaccctcaaggagctcagaaattagtgatgtaaaacaaatatttgaaattaggtatttgtagttcagaaaatgttataatagataattggctcaaagagagaccctcatcacagctaaatacaacctcttaatttatgatgagttttatttgctatgaaaactagcccttcagttttgagtattgtagtggtttttaggtgaggttccatgtgtctcatagtgttacttcaaaggcaaaggcattaccttcaagttgttatccattatccaccattccctaatatttatggaaagcctttgtctgttcagagtaagcccagagtagctcctagttagggaattctaaatgcaacactgctagtgagttcaataaatatatattttataataatacataacacgtgaattatatattgtactttatactatatattgtataataatatttatggatatatttatatggagctacctacatattaaatatataatctatattttactggggccacatacatatacattttttacttgctaaacacaactaggaatccagagtccagagataatctggaaaaacctctggtctatcaagacagatttgcaaagtcatgtttttgacttgtagaaaatactctattgatcttttcagcagaactccagcaattttgttaattacctctaagacaaattagaaagtacaatttcacataagggatgagggaagacaggactaccatgaataagaaaacaagacagtaggacattgcaataagaggcaaaagtaatgctattgcttggatcccagtaatgcggagtgtgtttaatccttggttagttacacaaggcagctgaactgagtgggcatttcactgaagagaatgccatctgggcaccaagccttctgcttcaactattcaagcacttactatgtgtcaagcattgggctaaccattgaggatatagaaataagtaagatattagacatggctttcctgacatttagatcttgttacttagaaaacccatttgacggcttagagtcaaaatagcaacatcttgaacaccatatatttatgcctctcacatgatgtttttgggttattttggttcagactcctcactcattgctctctgtcatccccccaaagctaaatttattatgatcctgaatgtcttaccaccatgttcccactgaggctggaataccaaagaaaaaaggagggtggaatttttatttttttctttatactttaagttctagggtacatgtgcacaatgtgcaggtttgttacatatgtatacatgtgccatgttggtatgctgcacccattaactcgtcatttaagaagggtggtatttttctttaaggaacatgtatcatttccatttatataccattgatgagaacttagtcacacggctttaacttgctacaaagaagccttggaaatgcaatcttcatctgggtgacaatactctcccgaaaatgccgttgctatagaaagaaggagattggatatgggggaacagctactagtctgccacctcgtctaatagaagatggatgcttgaataaataagcagacaaataaaatgactaccaagtccccttctcaaaatagagattttataagcttaattcttctcaaggtgaccctcccattgaaatataccaaaaagcgagtgtacaactcctctaaaactaattctactgaggtatatgtttacataagtcagaatacaggtgaagcttcaagcccaggtgcaccttgattaagttacttttttatttcttaactttttaaagcctggattgcatttttttccaaatggacaattatcttaaaattatttttatatttttgccaagccccctacaaggccactatcaatatgaaaaaatgattcgtgcaaagtaaaacaaaaagttgaaataactccaaatatttaaataaacactggcacatacaatttttctcatggtaataaccctaaatgtgtggcaccatcatccatttaaggaagctgaggactgtttaaaaattgccatcaacatatatcgttatccttatttttctcaaaatgcatgatgaaaaatccacatgtactatttggaagatttatttatagaacacctgcttctgtgaaactgctggataaataaagcatagcagtagtaatagtacaagctataacttatataatactttttatataattatattaaaaattctaaatatctttaatagaatattatcaatgtttattgtttttaaacattttgcattacactgtaaacaatataagggcattgaaaaactttatatttctctatactccttccatacttaacaacaaccaaacacctaccatgagtaaagattcatgcttgatatcgaggatgcctaagagaatagaagacaaaaacacatatttttagaataggcaactgctagatgaagagtaaatagaaattgattaggtgatagatttttctggcatggtacctgcttaggatgagagaaaataaaattaggctgttgttccctttgcagtttccaacaacctgtggaaatacccatctcttgggaaatcatcctgccataacatcgggctggtctggcaaaacttctgtggtattcaatgcaagtgattctttgcctaatttcttcccattactcataatttccctctgcctaaatatcccgggtgcttatcctcttgaatatcattcttaatctctggatgatcatcccccgcactttattttcatttggccatgctcccactatataattattttaatcaggagcaccatcttttttaactgtgatagcaaatgatgccatttccagagtagggtggaaaattaaaattgttagaattgaatttgatttgctttgtgatggtgattcagaggtgacggaggagcaggggagtgtaggctgtgttgggccatgatgaagatcagaggctgcgtgctgccagattggcatcctttccaccctatgaacggttttcatttcagaatggaattgtggaatttgtatcagtttaatgttcagggaatacttgagaattgaatgttgcactttagtgcatataaccatagcactttagtgcatataaccatagcacctgcctagaggcattcaataaatattggtttaaatagattgaaacacagacaattttaaaagcattgacttgacatcagtgttcccccaaaccctggtgtgcctacaagtcatttgaagagtttgctgaaatgttgatttctaagccctatttctagaaactccgatttagtccatgtgacataaggacctggaatccacaatttaaagaattgaacgatgcatcacacatgattctgttgctgctggtatgtggatgtcaactaggcagaatattgggaaatctgacataaatggtgtaagctatattggcctgaacgatgtttgaaagttaagggaattgaggatggaatttttatggattgctctaccttcaatagaggtagtctattcatttctcattaaattcatatttgtttaactgacagatacaaacacaaatatattaataaaatgttcaaaggagtcaataaagatgaacttttccacaataaaaactagatacctattatgggcaaggacacctgaagtccaaattgcttgctcactcctgaaaacaatattaaggttttattgtaagtttattcatgtctatgttacattaattacaagatgctattatactctacccacaccagttcttacatttctttctagaaaataaatgagaagactaacaaatgtaaagaggatgactgtttgattgattttgcctacatgtccaactttctactccattcttaccaaatgagatgtgggacataaaagctttgaattataaaaaatataaaaatacaaagataaagtattattattcattaattacctcctctttgcttaagaaagctgttctatctgggtagagggcaatgaagaaagataaaggttcctatttctgtttcattagtccacttttccacctcgtaaacagtgtaaaaactcaatccaacaaactccatttttcagtaaagcctatcatcagttaatgtccctgacctttatttttcctatttctcttctgtggcattttgtaagtgtttcgtgttgtgtcaggttataaaccatggaaggaaaaaatggaagagcccaaactgcccatttattggaaaacaatcaaataaacccactattgcctttaaatatgctactgctgttgctgcaacagtgttggtgattatgtatgtggaactgtttctcttaggtgtgatgggttttaaaatcctgtctctttagtgaccagatacttagtgaccactggccacattaagaatgggaagtaaggccgggccaaagcgagcagatcacgaggtcaggagatcaagatcatcctggccaatatgtcgaaaccccgtctctactaaaaaaacacaaaaaattagtcagatgtggtggcgcatgcctgtagtcccagctactcgggatgctgaggcaggggaatctcttgaacctgggaggcagtggttgcagtgagccgggattatgccactgcactccagcctgggcaacagagcaagactccatctaaaaaaaaaaaaaagaacgggaaataagaccagtgcctaagtgaatgccatagactcatttaaggtcaagccaagccagtgactttactaaatgcagaacactgagtgcctcttcaatggaagaggcagtgccttgtcatggatcaaagtataagtagtctgtcaaggccaggtttaaatttaacttattttccttatactttgtattaattgtgcaaccctcttgggtttcactctctccagctataaaatggcataataaaactctcttcatgggatattgaaaggactaaataaaagtgcatatctacatcacctcctacaacgaccagcaaataattcatgtttaagaaatgtttaattcctcattgtctcttgtagtatgcacacaaagatttttaattctgtggctgacatactgtttggaaaatgaatgaaatcaaagttcccgtctctggctgcttacaatctaaaaataaataaaaggcacacaaataaagaacagctgaaccgagtagtaagtttatcacaggatcgggaaggaagagattattcattctgagatctggtgtataaaaaaaggggttttaaaatgatgcctacttttaattttctttctgattttcaacttcaccatataaatttgaaaacctccttgcacagagatttccactggctacgtaatagtttctcttgtggtcctgtgactattttatactttctctgttgaaggcacttaaactatatccccattttttttaactctcaataatactgtaattaatcttttttattatgaaatcttaagaaacatctttataagaggaattttaagacttttaataaggccaaatgcctctcgagaaactttgccttaacatttgtatcaagagtgtagcagagtgcatggctaatattttaatgtgatgtaatgagattggtctttgaagcaagggctcagtggtcctagtcttggtagtagatgatttattttgcctaaaacagatgatttccgtggggaaagccatggagaaagaaaaaagtgtggataatctggctaccaagattctctcagaattgaactaagaattagggacagccaagccagccagtatgaatgagacagaagcgagactctgagctccaggacagttttgaatgaccttttagcttaatattgccttggtccctccatcatcccagcatctgaattctcacggtgaccccacactgtgagaccattcccataaactgggcttcaattccttcatctataagaaagggttttgtatagcctgtatttttgctgttgactaattttattagttgttttcggtatgtaactgaagtatttgagctgccaaatattgtcattaaaactgttgaaaaatctagtggcttccccctttgactattttctgaaaacatgtgttccctttttcccagttgaagctgtagacacgtctggttgcttctctcacttcccattctgctctgatgagtttaaagtgtacaattgatttaaccagaaataacttagcagctgatcatatttccaaaaagaaccttctttgcatcccaagaaaaaaaaatgactcagaaaatcactttttaaatttgattttaaattttcaggtgactctactgcgttaaaagctattttagtagagttaggcatggagtgagaaaaggtagagccaggaatttcatttcctctgaatgagccttgctgagatcctgagaataaaaaccacaacactcagaaattaaaatgtcaactttgaatcaatttgctatagcaaagacagttgtacttttgaaaatttaaaatgacaaattgattattagtgtacctataaccctttagctatgaaatggagtgctacatttctttaaaggctgataattagtttatatttcattggatcagacggagaatataatttatggccccttaatttttttcttctttagtatactttaagatggtaaaattgttttctttactatgaacctaaataatgctggtccatgctctttggcacattcctctgcttctgtttccatctttcccgtacctcctgaagtgtggaaagggcaaatcccattaatcagacagaggaagatagtgtaaaccaacactcacctttgcctctgtccagctccctcactacactagatacagggcagatcttacagtactcagaactgaccagcagatttgcaccttgtttatttacaagaattaaatgcggctgggcactgaggcttatgcctgtaatccctacagtttgggaggccgaggcacgtggatcacttgagttcaggagtttgtaaccagcctgaccaacatggtgaaaccccatctctccaaaaatacaaaaactagccaggcgtggtggcactcacatgtaatcccagctacttgggaggctgaggcaggagaatcaattgcttgaacccggacggcggaggttgcagtgagccaagatcatgccactgcactccagcctgggtgacagagtgagactccatctcaaaataaataaataaataaataaataaatacataaataaatattaaaaaaacaaaaaagaaaaaaaattaaatatagggtgtcagaagcagacaaatagacatacaaaaatctcaggagacattaaggtcagcaggttctgaaaacaaaccagcaaatgtattaccctatttattttcacaaatactacttttccccttaataattaagggaaagtatggttttccttcaaagtgttggggattttaaaattcaaaattctgatatatcaggaggaatcctaaacagtactgatttagtttgctagggttgccataacaaaatgccacagattgagtggcttaaagaacaaaattttattctctcacaggtctccaggctagcagtgcacaagcaaggtgctggcagaaatgttttttttccaacacctgtcccctgagtgtgcagatgcctgccttcctgctgagccctcacacagcctttcttctctgcttgcacacccctagtttatcttctgaagatgaggccttataaggacaccagtctcattggatttgggccccacataaacagtcctgttttaccttcattttttaaaagaccttatatcttaatagagacacattctgaggtcttcagggttagacagcaacataagaatttgggaagaacacaattcagttcataacattctgctctttggacccctcaaattgctacacttcttacatgcaaaatacaatcactccatcccaacagctcaaaagtcttaacccatttcagcaccaactctaaggcccaaatctcattaaaatatcatttaaactaagtgtgagatccaaagtatgattcatcctgctgcagaatttttctccagctgtaaacctgggggagcagacaagctatctgcttccaaaatataatggcagacaatcaccagatagacattctcctgccaaaaaggagaaattgagaagaagatggtgtcataggtcccaagcaagaccaaatcctagtatggcaaattttattagattttaaggctccagactaattctttttggcttcatgctcatcctccaggcctgctggtaggtatggtggccttatattcaaggcccactgaagtggcagcattacctcctgagttcctgggtggtagccccatccataggagttgggtaatggcagctgggctgctgagattaagggggtagcctcaacctcagaaaatgaattggaggcagccttgacccctgagcctgtgtcctccaggacagtggccgcagtgacagcccttgcaatctttgagtcacctttgagtccttcttccctttccttgaatgaaaacatgtgcttgcagctagatagctctattttcccatcctgccacatcccagaagtctgacagtcttccttcctattgtcttctctctgtcaccttcagtcaaggatggcagtgtgtctcccatttctctctattcatagcttcctgggaggtggctgattagatccaggagccacatctataatctctttaccaaataattttccagccatacttactgtgttctctccagaacccactttctactttttggcaatatggacaggctgatacttttacaaatcatgaagttcttgtttctttttgcttgacagttgctttaatgtatctcttccaatgacatttttctataaacagtcaaaaaatctaggccatagctttgacagtttgtgtagaattttctttgctaaatattcaagttcatcacatacaatatgcactttccacaaaacactagaatacaattcagcctcttttttttacttttataacaaagatcatgttccttcaatttccagtaacatgctcctcatctctgtctgagacctcaaaaatcgcatttaacattcattgtattcctaccaaaagtctcttcaagacagtgtaagatctttctaacatgtatttcaaaacttgtctagcctttgcatattacccaattccaaagctgctccacatttttaggtatttgttacagctgcaccacacttccctgtatcaaatctggtttcctttgctaggactgccttaacaaaataccatagactgagtgacttgatcagcagtttattctctcacagttcttaaagttagaggtccaggatcaaggtgtcagcagggttggttttactctgaggcttcaattttgacttgcagatggccaccttcttgatatgtccccacagagtgcttcttctgtgtgttcccatgcccagttcatcttccattcttacaaggacacgagccaaattggatttgaacccgcccaaacagcgtcattttagcttaatcacctcttttaagatcttatctttaggccgggtgcagtgtctcatgcctgtaatcccagcactttgggaggctgaggtgggtggatcacaagggcaggagattgaggccatcctggcaaaacatggtgaaatcccatctctgttaaaaatataaaaattagctgagtgtgatggcacgtgcctgtaatcccagctactcgggaggctgagccatgagaatcccttgaacctgggaggtggaggttgcagtgagctgagattgcaccactgccctccagcctggtgacagagggagactccatctcaaataataataataataataataataataataatgatgatacagatcttatctctaattcagaggcattctgaggtgctgcatgttggcacttcaacattttttttgttgttttgttgttttgtttaaccatgtggttgattataaagaatactgcaaaggatacagattaagagatgtgtagggtgaagtacaggtgaaggaccatggaggttccacaccctcgccaggggcatcaccctccaggaacctccacgtattcaggtgtctggaaactggcacttcaacataattgtggtggcaaggcgcacaagtcagcccatagaagataccaagttaaagataaatatacatgtgatcaattaattcaccaatattttctgatagcctatgctcaaatcaccataatagtaatgtgtgtggagatctaaaagtctgaagacacagttgagtccagctttctccctctctccctggccctgcttgaatacattggatggacagctgcatccttatctcttctgtaaagcatttgaccataattccaagcagcatcccacatcacatgcccttaatgtgctctctatcaagaactcacccaaagcccagctcaaaaaagtagtattagtgggagggagggtcatgggaagacaatgctactcatctgttctgaattttagtctttacattaagccagcaattcgaaggcaactcctttactgtggtacattaatccctcagcttcaatccctcagcttttttcaagggaaattcccttagctttttttttttttttttttttaaaggagattccactatatgaatttctctaagaaattcttccccatgaaattcaacgtactgactttttggagggtagtctattgaggacattttccggcaaactgctctgtgttcttctgtacagggtctcacatacacataaatttattttccaactcaatgtttaaaaaatcatttacttctcactgatttgtaaaatctatttctgtgtgtaagaaatgtgtgatgatgatttttttcttttattgccaaaattgaattaaaaatatttccataattttattttttgtttttactaggacagtcttcatttatactttataacagatgcagggattgttatttttttccagctttattgaagaataattgacaaaaattgtatatatatggtatacatgatgttttgatacagttatacattatgagatgattaccacaatgaagttaactaacatatccatgacctcacatagtttccctccctttactccccttccccttccccttcctcttccccttccccttcctccttcccccttcctttcctctcctctcctctcctttcctcttctctcctcttgtttccttcctctctctctcactctttctttttctgtgtgtggtgagaacacttaagatttactcttttggcacatttaaagtatgcagtacagtagtatcaactatagttatcatgccacatattaggtctccagaccttattctgcataactgaaactttgtactcttcgaacgacatgtctctactttccctactccccagcccctggaaactaccattctactctctgcttctgtgaattcaaatttttaggttcctcatgtaagtgagatcataaggtatttgtctttctgtgtttggcttttttcactagcataatgtcctccagattcattcatgtcattggaaatggcaagaattactttttaaaagctgaataacatttcattatgtattgtgtatgtgtgtgggtgcatggtatatatgcgtgtgtgtatatatatatgatatatgatatatatgtatgtgtatatatatgatagttccatttaaattattttgtggaacctccatactgttttctgtaatgacaataccaatttacattcccaccaagagtgtacaagtgttccattttctccatgtcttcaccaatgcttgttaaattttcccttttaattacagccattcagacaggtctgaggtgatagctcatgtagttatggtttgcatttttctgattattagtgatatggtttggctctgtgtccccacccaaattgcatctcaagttgtaatccccgtgtgtcaagagaaggacctggtaagaggtgattggatcatggagggagtttcccctatgctgttgtcaagatagtgagttagttctcacaatatctaatggtttaaaagtgtttggcagttccccccttttgttttctctcccctgtcaccatgtaagatgtgccttgcttcccatttgctttcccctaagattgttagtttcctaagttctccccagccatgaggaactgtgagtcaattaaatctttctttataaattatccagtctcaagtagttttcttatagcagtgtgaaaacagactaatacaattagtgattttgaatagcttttcatatacttgttagccatttgtacgtcttcttcaaaaaaaagtctattcatttcttttaaaatattatttatttatttattgctattgagttgtttcagtttcttatggattttgatgattaaccccttatcagatgtatagtttgcaaacatttcctcccctgtattccataggatattttttcactctcgattgttgattttttttaatttaagcatatttttattttgatacagtccctctggtttatttttacttttgttgtctgtgcttttggggtcatgctaaaaaaatgttgttcagactaacatcatgaagattttatccagtgttttcttctgttatttttacaggtacaggtcttttgtttaaatttttaatcaatttttagttgatttttacatattgcatgagataagggtccagttttatttttctgcatgtggatacacagttttctcaaacatctttattgaaaagactgacctttcaccatgttttgtcctttgtactcttgccaaaggtagttgactctaagtgcctggattcattttgaggttatttattctgtcctgttggcctatatgtctgcttttatgatagtaccatattattatgactactgtagctttatatttgaaataaggaagtgtgatgtctccagttttattcttgttgaggattgatttgactattcagggtcttttgtggttccttataaattgtagaatcattttttccttttttgtgtgaaaaataccattaaaattatgataatgattgcattgaactttgggtagtatggtcattttagcaatattaactcattgaatccatgaaatggcctatttctctatttatttgtgtctttcaccatttcgtttatcaatgttttatagtattcagtgtacaggtcttacgcttccatggttacatttatttctaagtaaattcattcatttttgttgctattgtaatgagattgtcttatttatttttcagacaattcattgttcgtatatagaagcactactaaattgtaaatgttgatttcattttctgcaactttaccgaattcatctattctaacagtttttggcatcatctttagggttttctatgtataagattatgtcatctgcagagacaattttacttattttttccattttggatgtttttatttctttctttattttatataattgctctggccaggactttaagtactatgttgaatagaagtggtcagaatgggcatcctttccttgttcctaatcttagaggaaaatctttcaactttaaagattgagtatgacgttagctgtaggttagtcatatatgacctttattgtattgaggtacattccttctacttaatttgtggagagtctttatcatgaagcaatgttgaattttgcaaatatttttttctgcatatatttagatgataaaaaggttttcattcttattctgctaatgtggtgtatcacatttattgatttgtatatgttgaacaatccttttatctcacttgatcatggtgtgtaattctcttgatgtgcttttgaatttcatttactagtattctatcgaggattcttttacatctgtgttcatcagcgatgttggctgcaattttctttgcccttgtctggctttgatattagggcaatgctggccttttaaaatgagttaagaaatgctccttgctcttcaatttacggaagtaagagtttgagaaggattgacactagttctttaaatattgcttagaattcaccagtgaagccacatgatgctaggcttttctttattgggtggtttttgattactgatgcaatattcatactcattattgatctgttcagatttattgatcatgttctcattgaaaaccccctgaaatcaaagaaatgaacagacacaagtaatgttgttctttatttcaatgaatgtaaaatatctttaaatattttaatacatatgcattattttaatgtaatacatatacattattttcaaaaaagcctgaagtaatagttattcatagctgatttgatcaaaaatgcttcatgggagaggtaatatttgtaataaatatggaatgaggcatggaaaaattggcttaaaacctttaataaaattctgaggattttttgcctttttctgaatgacactattctaaaatctggcaactccacaaataagatttgaatgagtcttcataatccaatttgtaaactaaactcaattctaatttataatcaaatatataagctagactattttctattatctgatgtgaatttccaaatgtgaatttccaaatatgcttaaagtcttataaaggccctctcactttgttggctggtatgcagagagagacagtattttaggctctcaggatgtaatcaacaagggcctttcatggaattataatccaagaactactggaccttaccaggccttttagtatcccacctgagaagtcatgtaatgtcacatcaatcctgatctactggctgcaggagtcagcccactcagattcaagaggagacacaaaccttatctcccaatgagaggaatatcagagaatttcaggacctcctttgaaatgattccatgtatatgcatttcttagttgagaactctaatcttcaaatatttttattaatgtaatacaatgaaatacttgtaataatgtctaatttttgcaaaaaagtagttattgttcataagaaaatattaatagaataataatgaattttttattattgttttctttgttaggcatcattctttatccttgtcatatgttcaataaacaattctgagcaatttttctgactaggtaaaaagcattaatttcagatgcaatgaattataagaagtttatatgtgtaaatacagtcaaacgctaattttgttttacatttttgatatctctgaaattgaaatgaatcttagaatcaatggggtaagattgttgaactggcagcagttttccttcttagcaatacaaaaataatggtacgaccaattatcaatgatgacctattttatcatctttgatgaaatatgatagttgttactcaaagttctggagtaaccagatactcaagataaaataaccacaccctctattttgagatattttctctataaccagaaatgagtcctaaatcttagatactgcttgaattacactatccaaaaaacctgttcacattcatttttttataatgtgcttatttttctaatttgattctagacttctaagagagcagccaacaatgcattaactatttctgtcagctgaaaggccctttaattgacttgttcgtattgactgagatcctagaaggcagcctctgttaatggtgtatcctgatgagagacaaggaataggtttgctagcatcagacttgagtgctaatgtagtatatcatgttatttccaatcacttagctttttctcgtgatagcaacaaaatgacttcttgaaaaatgaagacttgcaccatgttatctgaaaaaatgcatagctgtctttgaccaatatagctacaagtttttcaataaaaatcctgtcttaaatcttaggtaaaaaatgtgtctttagggaaactgtattgcagttattattaagagtgtttgtatcagtacatcttttaatgagaatggtgtttcgtgtagtatacaggtgtgcgcgtgtgtgtgtggacatgtgtacagatatatatatatatatatctgcaaacagatatgtatttattcattcaattattatttaaagaattactgaacttataaaatatgctggcatgtaatgactaccaatcatccctgcccttaagtagattacagtcaacctctcataaattcaattcttcttctctaccttttatgatgtggaaacatagcaactagtatgttgtaagtcttgtgtaaacactagccaatgttttcagtatttttatttagaaaataactttattttgatttcatctgttttttgttttgattttatctagttttataagacacaaagtatatttttaaatggtacatttttgcccagaaaccaaaattgccaatttcatatattttatgattgtagaatatctttcagaataattaaatgacctttgtggggtattatggaatagaaaatcctcaaaggcaagaaatccatagccttattttattttttgttatataccctgtaaataatcataaacaggagagtggttaatattcttcagatatggggctgtgaaataggagatacaggcatgaaatcctatttttattactatcgttatgctgatgatcctctggccacttctttctagtctgtgtaattgcaaagttcttcatattttattcattagaagagctgctctgtgcccattcttcttatgttgctgcctcgtgccgtttccagcacttcctaatgggtgtgatcgctgggctccatcaactttctgtctatgccttgctcagacctctaatgaatattagacttgcagccatcagtcatgtttcaagtgcagacatacatgaatagagaatttttgtttgttcattagcattgtgaaaagcaaactcattttgtctccttcctgttctctttgatgtatttgcccacctactataatgaatttgaagggaaacttgatgcatgtaggtatttatttaaaaggttcttgctggctcttttctcaccttttttcacttcttttttttttcttttaccgtaagcagataatgcttattaaccatcaacaataaaatactgtagataggattgtgataaattcttgtcgaatcgattgtgctaaggcgtttaaaaaggttgcctttcaggaggggatcaaaggaaggaatatggggagatcagagggaacaagaaaggtaaaaataatttggggagaggaggaggagaaagggagcaagaaagaaagaaaggaaggagggagagagagacaaatgcagagacagagagaaaaaggagaaccaggaaagaaagaaaaaagaaataagaaagagcaaagggcaatcttgggtaagaaaaatcatataggtgtttatgtgtaagaatgtgtgtatgggtgtgcatgtatttgtgtgtgtatgtgtatatgagtgtgtgtttctgggtgtatgagtgtgagtgtgtttatgagtgtatgtgtgagtgtgcatgtatgagggtgtatatgagtgtaagtgtgtgtatgagtgtgagtgtatgtgtgtgtgtgtacatgtgtgttgaaaggaatgcaatacttaattgggtaagacaattcaagagtttattatataaacacagcataccctccttccatttaggtctctttgttcatcatttgggtgaaaatttattcttttactcggagcaagtttagtttttcatcttagtatattttacttagacaaagaaatttttaaaaatgtattacaatgcaaaatagcagcttgtcagggatcagtgttatagcttttttgagtgcactgctggaaatctgattcttttttgttttataatgagtgagctcaagataaaatgttgatagagactagataattttgaagagaaaatacataattgagtctcagttgctcaacttattttattccatacttcttgtttcttttcagcaaccaggttctcttagaaaattttaatggatcaataaaattctgtcatattcctatggtatgaatatttttattcctccaaaattcatacattgaaacgtaatcaccagtgtgatggcataagaaggtggagcctttggtgagggatcagaccatgaggataaagttctcacgcataggattaatgcccttagaaaacaggcccaagggagaccctaagcccttctacctcgcaaggacacatcaacaaggcagtttccctgatccagaaagtgagctcccggtagacatgggaattgccttcattttggacttcccagcatccagaattgtaagacatcaatttctgttgtttataagctatccagtttatggaattttgttatagccggccaaatagaccaaaatgcataccaaatttatttttcataagaaaaatgcactgaatttcacattttcaactaaagagtacttatttcaaactttaatttatagtaaatgtgtattaattagttgatgaagctatagaaaataccgagttccttacataagagttctcaccctttgtgacatgttttcaaacacaaaaattccataaaatatgccatcaccatgagggatttccactttgattaaaagactcagaatataaacaacagtggattagttgttgtcttgataaatgaaacagtgacttggaggtgggtctattcacatgaataattgcaatggcattttgattagcaatgcaacatttactccctgttcactttatttaacacaaaattattgatttattgaacaccttatttaagaaaagattaggagcttttgggggaaatgttaatacctccatgtgtatattctaaacacacacacacacacatagcacagtaggtaataaatattcttcaaactttgtaaagaagtatctggaaaatggaatattatacatataattagtcttgatattgtataaagaaattgcaatttgttaaggaatttaagagaaatagcccgatataagatagtatgcagtcagtcaataattttcattttttttcaaagtgctatacaattgagaagaggaaatgctttcaaataaaattgttagagaagacttcttatgggaaaaagcatttaaaaagggctttgaaaaagaagggaagtagaatttacatatgtcaaaatgtggaagggtggaagtcaactattcctgcaggaaagaattatgttagcagaaattcaaactaaacgaacaagattttttttttaataaaaaagagtaacaacccaatttgattgaggaagaacatctgtctaggaaagtagaccaatatgaaaagtagcttgggggctagggagtagaggtattgaagagcagattgctagttttttgtttctttaaattcatttgcaaatgagatactattgaatgttttgctggcagaaagcattgtaatcgaatagttagtttaagaaaactagttgagtgcatgtgtgcagagtagattgcagtgatgtgcaggcaggacacagtgagcccacactgcagatttggaaagaaatctgcaaagaaagctttgatgggggagagtgttaatacgacatgcacaggctttgctgtcttgatagttaagagactagtgtttgttgaatagagtattaaacttctcaacctaaggctgcaaaaaatgggaaaacatgtgtgaagcctgagtaggaagaaggacacaccacatagcaatgtgctactcgtttgaggtactcatggagcagctctccatcaaacagctcagaaaagcatgcagagctggagaaccaagactttttaggcatttgtgtataagcaatagataaaatatctatgacaaaggacagagaaaaacaccccacatctccaaagtcctggtctgctgaagggtggtgggatgggaggaaggctggtaaaccccgctacatggagacacaaatgaacacagagagagagagagagaatgaagagaggaaaaatgttatcatcttcccatggaaacaaatgaaaagtgagcatgagagaacgtttgacacaggaattgggacctagtgactttgtgtgtgtgtgtgaagcagggtaaacaaaaatcacaagaaatctaactgaacctcactgatattttcaaatgatggaacagagtttgctgcagaaatgaagcaaaagggaatgggaatgggggctagcgaagaaagagtaactgtgggagatgttcttttgggactcttgtagcaaatttgtgagaaaagtagcatcatcacatgcacactagatttatagttgaccaagacaaaagcaaagcaactgcctgtttttaattctaataagaataaccagaaatttggtgaccttctctcatttccaagttaacctttattttttctctgtattttatttgtctccacttatcatcctacctttctttagatggatctgctgtaacctaacgcatgcgatttggtaagagtaaaacctaaaactaagtagctcattagtgtttagcaatccgtggtgtcatcgaacaagaattcctcataaaagagaggggatagaggcctgaaaattttaaataaagttcaaaccttgtaattagtgattctaaaatttaggtgtgtaaacttgagtaaagttttagtgtcacctgataagtgtgaagtaaatgaagaatcttgggctgtactctccaagtgtctgggaagttttcaaaaacccatatcctgggtaaaatgcattaatgtatggctgtgtgatatccattttaatgttgttgacagctttgggcagagaattctagctttcccctctctatatatgtaccccctttcctccacaataattaatttttagttgaatcaatgactgcccatccaaaaaacaaacaaacaaacaaataaaacatgtccgtaagacatcccagatcattctgattcaagtggccagaggctatactttgagagatgctgatataagacttctaaggaaaaatttcagctgattcccagttacatgattagcctatcactcctaggtagctactgagaaaaaatatagaggtttaggccaattagacttcatagaaaccatgatacttattagaacaattatttctacaagacttttttttttttgcttttctgttaatttgttttttagataaatcaatagatagactaatacagttggaaagacaatatatttgggaatatccccaagagggttgaggatacatactcaataatgatctgtagttttaccaatgtaatgattatttgatttatactattttaatattgattcaagaacaagtgctgtgaaaatatatagtactcttttattcccttctctaataggaccaggtttcacataatatgtaaaaatattgggatttggagccataagatctaaattcaagatcctttttattttctgtgtgattttggggaatttgctaatccattgttagctaccattttttatctgtaagatgagaatgagtatcttcacagctttgttgagagggttgaatgagttatgtgatgtgaacctcgtttcgaatgttagtgttacggatatccaactttcctcactggtttgtaaactgaaatggcaggtgtattcataaaataaatgactttatgctgggcacggtggctcacgcctgtaatcacagcactttgggaggctgaggcgggcagatcacctgaggtcaggagttcgataccaccctggccaacatggtgaaactctgtctctacaaaaatacaaaaattagctgggcatgatgacgggtgcctgtaatcccagctattcgagagactgaggtgggagaatcactagaaccagggaggtggaggttgcagtgagcagagatcacgccattgcactccagactgtgcaacagagaaagactctgtctaaacaaaaggaaacaaaacaaaacaaaacaaaaaatgactttagatttttcccctgacactgtactctccactaaatagccatttttcttccttttgctttccacatattgcttaatattgtacgtcaaatttatttcattctaaattgaattaaaaataatgtttaacattttctttcccttatcctttcattgtgaagaacttgatggcaggattcataagtgttttgccttttatactaaccaggttcaatcagacaagagtcttgaccattgcagatgttttatatcggtttgtttaatccatgaatgaactgatatgtgaaaaccttactgtatggtggtctcattctatgccacacttataggaagcatttattcaaaggcttaatagatgtctctttttggagatgtgactaaaatggaaaaaaagcacttgatttcttcaatgataacctaaaatggcaaagatgaatgcacctatatagaagctaaaggcatcataatcatatatatttctgcaaaacacattttttaatgtcatctatagaaaatctttctgggttgtttcttttttttggcatttggtcatttgttcattcagcaaatatgtagttagttcttagtgcaagcaaggcaccattctctatgttggatatacagtcatgaacaagccataaaatgcccttttcctaattccaatggggaatacattatacaaacaaagaaaaataaacaaaaataatgatttcaggttgtagtcagtactcttaagaacaataggctgggagcagtggctcacacctgtaatctcagtactttgggaggctgaggcaggtagatcatgaggtcaggagtttgagaccagcctgaccaacatagagaaaccctatctcttctaaaaatacaaaaattagccagacgtgattgtatgctcttgtaatcccaactactcaggaggctgaggcaggagaattgcttgaacctgggaggcggaggttgcagtgagctgagatcacaataatgcactccagcctgggcgacagagcgagactccatctcaaaaaaaaaaaaaaaattgggaacgatagcgtgatgttggagtgctttggatagggttaactggaaataattaaatggttaatttcaggacccagtgaaagacatcagcctctatgaagacccatgggaggacgggttcaggcagagagcagcaagcatcaaagagcatgtgcgagggctggcaaggaggccagtacagctggagggcagggcacaggctggattgtggaataagacgtaaggctgagaaatctgcaggaccacatgcacagggtttcatgggccatggcgagaaggtgggatttgtttcttgttgcaatagggaactattgggaaatttcaatcagaggtaaatcaagtgatccttactttaaaagtcccttttggatgctacaaaaataacttttggaggatggaacaaaaatggaggcaagcattttacttttgagtctattgtaattacccacggaagagatcgttatggctgtggctagggtctgtcgtcgactagctgagttactagcaggtaattttacctctatctatgcctttgttttctcatctgcaaaggggaaataaaggtatttacctcatagtgttgttgtggagagtaaataagctagaacattaaaaaaaagcatgaatctgcttggaatattttaaatgctcaattaattctggatgtttttattagtatcatgagtctaaatatacacaatggctttagtagccagatttattgcaattcttagtttctagattgtgtgtacatatcagatattttacttttccaactctgcttttcattcattattttttttactgtgtgaatcggtataagttaaactatgctgaggtcatgaacatgccccacactaaatctctgaggcttaacacaatagaggtttctttattacatcacagcttgatgaagagttgagagtcctccctctttcttttcactctgcatttgaaaactaatgcttttgtcgtatcagggaaattgtgtagtaaactgaagatcttactccaatgctgagttgttcctttattgttatcagttcctaaagatttataagagtgtctcaaaatgttcatttttatctgtaagtctcgtgttatttcatgatgtttccagcacattggaaagtatcaaggtctgccgggcaaggtggctcacacctgtaatctcagcactttgggaggttgaggcaggcagatcaactgaggtcaggagttcaagaccaggctggccaacatggtgaaaccccgtcctactaaaaataaaaaattagccgggtgtggcggcacacgcctgtagtcccagctactctagaggctgtggcaggagaatcccttgaacctggcaggcagaggttgcagtgagccgagattatgccactgtactctagcctgggagacagagtgagactccatcaaaaaaaaaaaaagaaagaaagaaagaaaaaagaaagtatcaaggtctgggagtctttgtgaaggtggatgttcaggacaggagctatgcaggttctcagatgtctggagcctgtagcccacattttgctcagtcatcgtgttactctgtcatttaaccttactgggatccttcaatgaggcacttagcaaaaaattgtacaataaacaaaagtatttttatattctcctacaaaaactcacacaatgcccaaagaatcatttaagttaatcacgttgtccatctctttgtctaaccatgaaggatccccatagtccattctagagagctttgcctagtccagcttgaaatgatcccatcaaaatgacttttatcatttgttttgagaggcggtaccattaatcttttctgtttccccctctctctttctggctcacttcaattcaacaggcagggagaagagaacattgaacaacattataaaaatgttaattcctaatgtcacggactagcccttaatcacactattagacatatgttctgaattaacgatcttgaccagcaagcaggaagacgaagattgactttgatgagtgcctgccattattttcaaagatggatgaagttgtttttctttctgactaaatgttttctcagaaacggtattctatttagaaagaaagagcatataaaacactttcttttgttggcagagtcttcttttctaaatcagcattttgatggtgtgtgttttgttcatatagtgagacatgtgctgcaatcactggtaatctcttggccttataactttggtggcctcgttctctagatttattttttaagcccccagcgcttaactgcaagcaatgaaataaagcatgtttagtatgtacagaaatctcattatcccaaacagtcatttcctaaagacgactgcggtgaaaatcagatctccttttctttgtgatctttacctgcacaaattctttctccacggcacactttgtcgaagtcctcctcaacaccaagtctctgagcctctgctcaaatgccatcatttgcataaaactgttcccacgacccctggtgagaagtcatattttcttactctgggcttttctagaattttattaactgctctctttggcactgatctcactctgacttccattactcttagctgtgtgcgggacctccttcctataaatgttatgagctcttttagggtagcaaaagttcattaaagtttatatcactcacgtattacaccatgacctttcacaggatacagttaaaccattgaatataatatatgcaattcacatcattacatttaattatataattttatgaattatatatttaatttatatataaattagtaattttatacaatatgaatataatatttaatttacatataattatatatgtgtgtatacacatgcacatacacacacacaaaacttgcaactttgcatcattctatgggcagaggctatgagaaaactgtacaagatctggtttcattaggttacagttaagtgaccagttgtgagaatagtttcttcaaagttctatgaagagtttttaactgaatgcatgggtaagtggcatcgagacttaaaaagatgaggcaggaccattactatcatggaaaactgctatctgcattgcagtgacagccaagcaccgtgtttgaaggggacaaaggcatggaagtcaggttacactgccaatcattggggctgggttggcacagactccaggtgaacccagattgggtttatataaatcacatgtgggacggaagaagggcagatgggaaagacactagcggtttctaaccatattgcaaacaccttgaaattagagccatcattgatctttctatgtacttctttataacccctacagaatttattttcacgtgatttatacctaatttgtattttatcagttattattgcaaaaatgctatataaccagttgccaaagctcagtgacatacaacatgcagtccttattctcacactcactcatctgtgcatccactgggtaactgtgcttcctgagttacattctggggccgtggctggagaggtcatgacctgctggggcatgttcccagggtcatgtcaaggaagctctggaagggcaggtggaaacatgcatgcctcttgaggtctacactggaactgaaccatcatcatttctgcacacattccatggagctacacaagtagcaaggccaagcctcacatcaagtggggcagtgggtttactccacccctaaacccactgccacatgtatttgctcatcagtgcagcaaatttcttttactcctgcaacttcaaacattgtatgaataaaagaaatgagaactaaaactcttcttgttggcatactgagtttgccagaatctaaggctatgagaatacattacatctaaacttagaaaaatgtaaagagaaacaataaccacaaaggcaacaacagctcaacagagcacagtctgtatacatctatggaactttctagctccattctgatattgtctggaattttgcttggactgttcatagcaacgggaagaggccagattctcttggccgtagctgcagttatcaccaggaagctgttgtgtttactgtttcccagttgtcaaaactttaattgaaacaattgcaagattacagagagatctccagtttgaattatgttcaacagctcccaatgattaagccatacaattgtgcaactaacctgtttgaattctcttcaatttcttacaatataaaaatcatcatttgaactaatcatgtacaaattagatttgtgtttaggtcttctataaaacatatatattttctctgtctttgaaccatttctctgcatataatatatacatattctacttgaggaaactttatggtcaggatagtgtggttattcactcattagcaaaatccctagacttgatctgctggaatgatttaaattcaagtataggagtctatataggctgaaatctctgatttaacaaatgaagatgcaatattgtttcccgcttttacttcctctccctcctcctccttattctctctctttctttctctcacacatacattccctccccaaacttacactctctttataagacattctagaatatgcaactttattttttatttctgtctttttgtggctcaattgagataattcttttccaagtttatgatgcattatcctgtttaggataattagaaaaatagaaacctgcagctggcaatctaaattggaggtaaaacacacctagaaatttctgcagtggagaaacagtgaagatatttggactttacatctacactgattaagaggggaagaggctcactgtgttgaaatgactgggggaagttcactggcaaggagttttataggcagacctaagacaacatacccttatgcagtctgctctgccaaatgggttaaatagtagttttgcaaacttttttcttttaatttgtttgtcaaatactctgctttaaaattggggaagaatttaggtccattaaaacactttgagtaaaaactcagaaagacactgaacatttgaaaagaagacagctacagggcttaaactgtgcctctcagtttgcatgttgtctgcaacaaagcaaaacacactcatggttatccccttgaaacttggggtagggagatcctgagaaggttccagcactcaatgctgacattgcgttgtgctatagtattattattgtgtggcagtgtgtaagatcaccttctgtgatcacttactgtgtacactctaaaacaaatactttcttaggaggatttatagatatagatatatattaaacatattacacgcacagacacacacacacacacacacacacacatatatatatatatgtaatttgagttttcccataccttgtttatatgcatgaggtcatatgacaataatatttgcatggaagtaatgtaaactcatgcaattcctcagtcgtattttttttataccctgcttacagaggaccttgacaactccctaagagctttgtggctgctactgggagttcctggaggagtctcccatcaggtcccagtcctcttgttttcttaatcttggctgttttgtggaagtccttgcgttgcatggctgctgaggctgtgtatgaaaactctggtttcctagccaaggagctggcctcacaaatccccagagccccaggccccggaagcacagtgcataacgcagacctctaccgcggagagatatatatgtcacatgcaggcagctgggggatagacagagtttttccccatttgcttcttgtcaaagtgaagtgccttcctggttttcaaagcaaaattgtggaacctccttaagccctgctcaccagatttcatagagttctttgtttatcagaagcatcaaaacaggtttatatttggtttaataaccccatttggtggaagaaatagagatttcagagatttaaaatattgatccattaagagatactaagtttctgcttagcttttgaataactcttctgtattaggggaaaatgtgttgtgagtcccgcctccacagcaaagaagtcagaatttaaatcccgaatctcgtttctagctgggacccaagtatgcaacttgtgctttacccatcagcccctcctgtgagatgctctgatgggaagatagccccaggaagcaggctctatgtgaaccttcttttttgcagacacagggtctgcagaaactcatctttggggagacaggggttgcagctcaagatacttgcagggaggtcatggtggtgcagacagcatgtcgactgaatccgtctctaggcgttcagcattcgggggcagccagctgggcagggttttatatttatgattctgtggtagtccagcatcttcataataatacattttggcttggaacaggcagagtgaattcttagcttctattcaagaacctgatcaattaagttctattttatctgttttatgctacccattttttttcctgttaaaccttcctattggaacatttgcaacattttgcaaagtgcagtttaaaaacctagccatagattctaaaaaaatgccctgatttgttctttatgttgttcatttactttgtctgcaatgagcttttccagatggccacaggtgacttatccgtggcctatgagttttgttcaggatgtcttttcatcaaagtctttcctgattggtatggtttaaaattgtaacacacccttcttcatagcacacttgctgtccttagcctgttttatattttccatatatgatagggtttggctgtgtccccacccaaatctcatcctgaattgtagctcccatgattcccatgtgttgtgggagggaccaggtgggagataattgaatcatgggtgcaatttgccccattctgttctcgtggtagtgaataagtcttacaagatctgatgattttataaggggtttaccctttcacttggcactcagttctctcttatccatgtaagacatgtcttttgccttccaccatgacggtgaggcctctccagtcagatggaattgtgagtccattaatcctctttttctttataaattacccagtcttaggtgtgtttttatcagcagcatgaaaatgcactaatacaacatacctcttatccctttctaaatactaaattatataagcatttttattgtcatttcctattaattaccatgtaacgagcaggagggcatgttttgtttgtttctttattttggtatgttttcttacgtgatttattccaagtgcctagaaacttgtctgaaatagtatgaatccttagtaaatatttgttgaatgaattcatagtttgtaaataaaatatttgtaatcatgctttgttccttcacttttgaaagaaactcctgtcaggaaagaaaaagttcaatttctgcaatggccaaaatttacagcctaggttgtgttttttcttcctgactacatggttagcatcaagacttgaggcgagtcaaacccctgtttgatcctcagtatcttcatttgctataatctctccagtactgcacagagaccaagacacaaagatgggacatctaaagggaaaatctagcaataatcctccggttttcatatatagatacataattttttgttctctctctttttcttcttgcttgttgagagtcatttggttaaaacgtgtttcaacttttaaacttctcaacctttaagccagacattaggagggaggcactaagaggccaaagcggtgcaagatgttgatggattcaaaacggaattaagagttgggctgctaatggaacttctagggagtaaaaacaccaaataagaattggtaaatctactagaagcaacacatccaccagaagttgcacacaaactggctgttcagagcttataccattagtaacaatgcaattaatgtgcttatagcctttcgggtagttcataaacaaagtatctcttgctcattggatttgactgtgtagtctggattctagagtctgagagtagaggcctgggctgttgaaaggagggagagtttgagagatttctttccattcttgggcccaaggacaacactgacaaatgtattcaaatacaaaatgcttcaccctcatgctggctggactcatgctgtgatgacccacctaagcttactccattcctgaatgtgctccatgctccaaataagcctgccagtcctctaggccaggtgtgcttggctcacccgagcagggatttaggaagaaaacaattcatgtgtagtattttacagtgatttacagttatttgaaactaaagaaaatgaattcatattgtttataactattctttaaaagaacacactggttaacagacatctccaattgaaactctagctttaaagatgacataggaattgaacttactttaggcagagtgtggactgccatgttgggatgactgtagtcctccaggccctctgcttcatgaatcagcacccctaaaatgctgatgattttcaaagtaccttctgtatgtttttctcatgaccttcagattaatgaaagctttaggttgcctggtctcttcctacttacctcagtggctttcatggggatgatagcctggaggcaagtaagagaaagttgttgctctttgtatatagagattaattgtgatttttatgtttgtacataagaatatgcatgtaaactagaatcttgattaggcaaaatttcaaccttgtaacatcctcagacaattgctattattcactgtaaaattgcaaatgatataaagtggcccttaataaatatttctttcattttttaaataagcacatgttaagcacctgttgtatatcaatcacaaataagacaattaccaaagggagcccaggcctcacatccttcagcctaatgatgtataacactttcatctgcctgtcttgttttggatgcagtatcactttaagaatgataattctaagctactgaaatattctcaatcataaaaaatccaacagatttcactaaactacattttgtaaagaaaaaaattgagaaggacaagactcaaaaatggtttccagttagctataaagactggaaatcacaggttgcataccacctttatgtgggttaaatataaccttcacaagggtttgtttggtccacatattatcagctttaacagtgcttttattttttttcccccaaatctttgagcttagaactaatgatgtctttttaaaaaacaaaatcagaggatatggcaactgcagggctactattatcctgagagaaatcaatgggaggccatcagaaccagccctcttacacagccaacctcttcttcacctgagtctttaacttcctcattgtctacccagaactgaggacagaggtcaggctaatcttggccctagtgctctcattttctctttggtagttttaaaagaaagttattattttttgaaattcatatattaaaatattttggtctaaattctgacctaacttactcaatcgtgcctgatctggtaagaattcaagtttacgacactgcctctcagcattgccattcatcaatatttgactatacaaacattttgatgaaaatgtcgtttatatgtgtacatatatgggcacatatagatgtagaaatacaaatttaaatatatagaaagagtgagaaagagagacagagatggaaaaagaaggaacaaaaaaatgagataacgaaacaaagaaatgaagaaagcaagcaaagggaaggggggatgtgagggagggaagaagacaggaagggaaggagattatctatatacatctattctccaagatattttcagctcagtttctgtgccatcccctgtgttacttcaggcttgccctaccctgactggtggaatatcttgtcttccagatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggtaatgagaatctccatctttctgcaattgtagagaaagcacattaattgatgcataaaattccccaagacagaaggacatggatgagaaattcaatacaaactggagctcccccgatggtgacttttgttttttaaccttaaaaatggtaaattctagtgttttcagtatgacaacttatgtttggtacatataagcatgtggtcataccatcagctgctgcttcttcttttttttttttttttttttttttgagacagagtctcactctgtcaccaggctggagtgcagtgtcgcgatcttggctcactgcaacctccgcctgccaggttcaagcaattttcctgcctcagcctcctgagtagctgggagcaaaagcacatgccaccactcctaactcttctttttttttttttttttttttttttttttagttgagacaagagtttcaccatgttggccaggatggtcttgatatcttgacctcgtgatccacctgcctcggcttcccaaagtgctgggattacaggcatgagccaccgcacttggcccccaccagcttcttatattcagaacttcccatttcaaacaaggaatggcatgcaatattgagctttgcgattgagtcagggtatttatgatatgtggactatatgttttggggggagagagtgagagagatagggatgtggggttatataggctgtttcttcatgctcccattgatgtttcagtcaccagccttcccttttgctaccaataaacacatagcaaaggaaatgtatatttattaagcatctattaaatttcatataattatcttacttttgcttcttaatgttgagtagtatctattgcagagatgttaaataattttcccagtgtcaaacatgtctgtcaagtgatagatacagaatcagaaatcagccatttctgcagccagagtttcttagtctcctacaccaacttacttctgtaaaatcaatttagtttgaagcttccatgcccattacatttactcttcttttatcctccaggtgaactgctagttttttactgtattgattgtgaaaatatgtacagatcatttccaaatatacttttgttttgactgaatttaaagcattctttggttttggcttagcaattttgcttacttcatcaaatgctacttaattttaattaaaaattcttatgttaagctagtctcaatccccaaatttccctttagtgtttttactcactcctcaaactgttaacagcaaggactatttcacataaaatataaagttaagtcaaaatctcagttcagcaaggaaaggaccaggcatctgtcttcattgggtcctaggagatgtgtattatcacttcagaacaccctagggctgcttgggcaccagggcaggttacccgagtgccttctcctaaactcaagctggccgaagttatagggtaatgaattttgcctcttcatgtgggtaaaatcagatatagttaaccacaggtagaatgggcttctgcattctgtgagcccccactttatcctgcagcgaattctatctcattattgcggatgcctacaaaccaactatgatttgtagcctgggtggaggccatgtctctttaaacattatacctctcaagacctacagaagacattcagtggtaattagttgaacagattaatttagacaatctttaaagaagagaattatcgcaagatggcacctatgagcttgggaggtgtgttgaagtgttagatggttgtgctgccgtaaaacatattcaaacatctgctcccaatcgcttggattcactcattcctttgatttataggtttactctcacagtgcatattagacactatgtgtatagtcaaagaaacagatataggagctagaataggtagaagtgcttccccctagttactcttgactctgacccctcccctcccctccctcctccttccctctctccgtccttccctctctcccttccttccttccttccttccttctttccttccttcctttctctctctctctttctttcttccttagacggagtcttgctctgtcgcccaggctggggtgcaatgatgcaatctctgctcactgcaacctctgcttccagggttcaagcgattctcctgcctcaggctcctgagtagctggtattacagggcacaccaccacgcctagctaaggtttagtacagacggggtttctccatattggtcaggctggtctcgagctcctgacctcatgattctcctgcctcgacctcccaaagtgctgggattacaggcgtgagccaacgctcccggcagactctgagtcctttcttagctgccttcttgatctttgctcactgtttcttttcctttacccctttctttataggacatttgcctactgaacactacctcagtgtctcctcttacttgggaacaactgacccaggcttaaattactgcacactgaggggcagggaaaagcgtggccttatatcccttaattgggctgaagggctctgtgtctcctttcctaaaactttccactgatctcttccattccgctcccagcctctccctcctttgacttgctcaatgtttcactctgaacccctcatctgataatttcacttcatcatctagagtgagcccagagggattcttcataatgtcttctctcaccttgatcattccagaagttattacatatttcatgaccctttccatttcctttagagccagggactattttccatccagtgccattttctgtggcaagagacctcgctcagggcaccagaatttattattagataaggtcctgttcaacaatcagcctatcaaaggtcaagagaaaaggactgaacttcccctcttaaggatgcctgactcactcctggatgtcccatagcagcacgttgaccatctttgggcaaagtctaggtgagaacagatcagaaagtttcttctgtcattctcaagagggagtagagactgatattctgattcaacacttctgagcttcattcattgtcttagtgcaagtcatagcttgtgataaagggtttttataaatactttattatagaagcatttatatgtattactttatcagatatttactgatttatcacttacttagtgcctactgtgtgccagacggatagtctgctgtgcagagaaagtcaggggcattacggtccctgcccttgaggaaccctcagaacactggaaagaaaatgctatttagttattaggtgggtacaaaagtaatggtggtttttgtcatttaaaagtagtggcaaggtcggacatagtggctcacacctgtaatcccagcactttgggaggccgaggtgggcggatcacgaggtcaggagctcgagaccaacctggccaacacggtgaaaccccatctctactaaaaatacaaaaattagctgggcatggtggtgcgtgcctgtagtttcagctactcaggaggctgaggcagaagaatcacttgaacccagaaggtggaggttgcagtgagccgagatcgcgccactgcactccagcctagtgacagattgagactccatctcaaaaaaaaaaaaaaaaaaaaaaagtagtggcaaaaactgccatgagttttgcaccaacctaatagaaatacatgggtttaaaaaatctggcgagagaaataagcacagatgtgcctgaacctggggtagaaatgagctgggaaatttagattgtgaagagaagcagcagttacgttttgaaggagcagaagcagctagttaaataaataaacaaactggtgtactacaagtaggggttgggggtagggggaacatctgtgtgcagtggggaaatttaaaataatataaaaatcaccggcctcttaaaccacaaatatattggtgtggttgttgcacagtcgtcatttgagaaatgtacagaagataaaggaaaggaggaaggtcaaattcaggttatgaagctccttgtatggaaataacagtgagctagctttgtctgtacaaggattatgggcatacaataagtattcacacatgacaccaggcatatctttgtgaaaatgcatttattatttatctatcaaactctactatttactgcagaaaggaaaaatacaaaagctaacacacttgtgaaatagttaatcaagttcaacatacatgcaacttatttcttgacaactgactttccacacgtttcaaatttttgttttagaccaccacacctctttttatatcagtggtgctctgtgtgcctcagagaaactttggatattcttgccttgtaaaattccctcaagcttttgctcttgtgaaattaatcagaaaactgacttggccttgtatagcacgcagtggatagcggttgaatatgttacaactcctagatagtattgtcacttaaatgttacctatcatatcctgaattgttcttaatattttatatactgtacctcatattaacatctcaataactcttgaggttggttttattatttcttttccccagaaaaaagaaactgagtctcagagatgataaatggttcggttaaggtcgcttgactaaggggcagagtaggcattttagctgaatctaaggatgcccttaatgattatgtcaaaggagctgctaatgttggagttttgaataatagccagtcagtaaggatgctagagagaactctcctacaatctctcaaatcacatcaccgcagcatgcatgtttctttttgctaagccagggtgcttagggaaactggggcatcttctaagcctctggtgattgataattttttgttttgttttattatttttttgagtaagcttctcactttgttgcccaggctgttcttgaactcctgggttcaagcaatcctcccatctcagcctcccaaagcattgggactataggtgcattcaaccatggccgtcttgttctattttaataagccactgtaactgaataacatacatttcaataagacccaagtaaatgaagataatgagtgcatgttgtagggctgagtgaaagtgacacagctcacaaggttgaggtgggtggggagagaaaaaaaagtcattcagtgaacctcaaaagcacatttccttcttagagtaagaggaaagctttaactacccgtcggaattagctgatttcctaggggtttttctatctcagccaaatcactaaattgtaatgaaaaaggaataaatgaaggaacatataaagaataataattttactgattaatgactgtctgcaaaggaacttctctcaacataatcattcaatctctaggagtcctcccaactagatggtttctgaaccagctactttatagtgctggcttgttgagagtaagaaaggaaactctggtgacagctctgggttgcagaccctggagacagcacaggagagtgttgggctgtgtggaaggtggaaaaacagtcatccagcaagaggcgtcaaaggctggtggagcagcatgttggagaaggcagagagaatacacaatgtccctcatgatgatgacccgtggcccaaatgaagagtcttctcatccaaacaaccaggttgccctaaagtgaagctcttttacttggcagtagaacattcttttatttattttagaagaaagtacagaagttttcatttgatttttagtaactctgttctttgcctctcgcccttagtgtacccttgtataaagtgatatggcaaaaataggaagagaaaatgatgtaaggtgtaaattccggtcatctgataatccaaaaaagaaaatattttattcttttccataaagaatagaatatttttatgggatgttatctttttagcacatggaatcctggagctttaagctactacttactctttggttctacttttctgttacagagaaattatttaataaatgttgctaaattcatgaatgaatgatggatgaatgatttctgttagacagatttttaccaatgtatttttagataggtcaggccatagccatgatagaattagttgaaatttacttccttgttagccattactcctgtttcacaatctcacaataaatgcttaccaaattttaacctacatgccttttgctacagattgattttcttctggctatcaaaagtagttatttctctttctatgcccggattatttcatttaccatcatatattccaggtttattcatgttattgaaaagggcagggttttcttaatttgccaagcttgaacagtagttcattggttatatacacattttcgttattcatttattcactgatggacgctgagattgtttccatgtgaggggatagatatgtcaggtagcttgatttagccattccacaatttatacatatgtcaacacatcacgttataccctataaatatatacaatttttgttgttcaattaaatgattaattttttaaaaagtagttacaagtgaacttcctgttccaaaagttatctttgtatacatttgccttcaaaataagcttttgttttggtgaatgcatgtctaatccaggccccaggacattgccctccccaagggccctgcattcccttcccatgagatgcagaatgagatgatgctggatgcctcctagtggtgtcgaattttgctgtttcctcacctgggtcattatttgatctttcagaactctttcggtttcctcaaaaccttcacctctgagattcccaggctccatgcattaagggcgccttagaccacatagtatcttgagaaggggccccaatcctgaattctgagagaaataacaattcacctcagggcacactaacgttctatcccttatttaaaaataataataaattaggcaatctctattggttgaattttattattcattaatctgtttatgagctactctactgcttattgagttttgaaagtgcttgttctctaggcagacaggaattaggaagggtttatgtgggtttttgctcactcggtccctgaattcccagacacatcttgcaaactaatcagcgccagcctcttgtgttggagaggagtgtgcttggcatgcggtgggtcctccatgccttaactgctgaatgagaggatgcatgaatgaagagatgggacattttctctctccccatccacactttctagttattttctgctgtttcagtcattgaatatactcttaaagtatacattctggagtaacttgatactggcttccttatgctaatgttcccatgactgggtttcaatttttttttattttgtttttaaggcagaatctcactctgtcacccaggctcaagtgcagtggtgtgatcttggctcaccgcagcctcaaactcctgacctcaagcaatcctcacgcgtcgaactctcaaagttatgggattacaggcgtgaaccattgtgcccagcctacatttttttttttaggcagaatgttttgtgaggtacttcaatggaaagaataaaaaggcattgcccaattaagagataaagaaaaaatatgaaaatagaaaaaaagaacttgtaataacaggttgaaaattcaaaaccaaaatatcgcatcattactttgtagaattctaaatgaggtaaatagctgatattttgcctggcgtagcattaaagcaggttttttttttctttctttttatttaatgatgccaccatcctatccaacttttagggaaaaatatctaatatgaacagcctatcatccatgagttctggaaaacaaaacatagctatgaaatacttttttttttatcttgtggaaaacaaaacataccctgaggtttctattacatcagttatctgtcaagccttataaatatactatcactaaattgtctgtaaagtctcattatttgagcaattgcaaaattgtatcagaaataaaactcaaagtcattatagggattattattttgcatttacatgaaatgatcctctccctgaggaggtggctttaccacagggatattcagaactcaccagtcagaacacagatacacaaggagacattccttacaacttcttcttgatcagaatttactggaactcttggccaagtatgtctgaaggggacagctctgacagaatgggaagctggtgatgctgttctcatgttcctttcattctctctgtctttgtcatttctactctgcctggggctgcttccgtggtccatggcaatgctctctgtgaactacaaataaatcccaatgtctgcattttttaaaagtgtagtgccttcatcatgtagcagaaggagaaataattccatctcctttgcacatctgtcttataggtattttgtgaaagtgtcatgagctaattcatgtaataacacttagaatacacccaattgtagctatttttgctggtatcattgtcattttctggatataaaatgtaatgaatctctcagtaatattttattatgtaatggaaagaacaaattgtggatttgtcacttattaactagaaagcctaagtcatttagcgtctctgagcttctggtttctaatttattttttaaaagtgggggaatatctatctctgggaaatactggctgagttagcaataatttgtgcacccagcagatgtggcatggagtcagagctcaaagatttatcaaccatctttttattattattttctccattttcagccgatcttaaataagctataaaaggcaacattgatttatagaagttaaatggatgtctaagaaaagtctgtatgcatgtattgcaaatcaaaaccacaatgagataccatcttataccagtcagaatggctattaaaaagccatgaaaacaacagatgctagagaggttgtggagaaataggaacacgtttacactgtgggtgggagtgtaaattagttcaatcatttttgaacacagtgtggcgattcctcaaagacttagacagaactatcatttgactgagcaattccattactgggcgtatacccaaaggaatagaaaccattttatgataaagatacatgcacatgtctgttcattgcagcactattctctatagcaaaggcatgaaatccacctaagtgcccatcaatgatagactggataaagaaaatgtggtacatatataccatgaaatactatgcagtcataaaagtgaatgagatcatgtgctttgcagggacatggatggagctgaaagcctttattctcagtaaattaacacaggaggaggaaaccaaatactgcatcttctcacttaaaagtgggggtcgactgatgagaacacatgaacatatcggggtggggaacaacacacactggggcctgtaggagggttgggagtgggaggagggagagcatcaggaagaatagctactggatgctgggcttaaaaactaagtgatgggatgatctgtgcagcaaaccaccatggcacatgtttacctatgtaataaacttgcacatcttgcacatgtacccctgaaattaaaagttggaaataaaaagaaaagaaactaaaggggaaagaaagaaaagtataaatgcatgtatgcaatgaacaaaaacaaaacagaagtaatagcatgccagcacaaatttcattcaaccaccaaacttcgagtggagtaaggaaatagcactgaggttccttctccccaaaatagggctgctgtctgaaagtttattcttaaaattcaccatgtaactgatggatctgccctgtgtgtaaataaaccaagagattccttgtgaatgtggaacagaagagctcatggactcccagaaatcctgtcaaggtgatccatgggtaatctcagggaatgcagggctggaaaatgattgcaaattagtaaactaaaacctagtcaattgagctgtgtcttatgtggagaaagcctgtgtgcacagaatggggatggtcaccctgagacctaaggaggacagtgtgaggactcagggcctggctctgtgattccagcacagtccagaggcggcacagactaatgtgagaaacaccagcttccactcttgagagagctgctgtcggcaggtgggagacccgtgttggagcacaggagacattggtggttataggcaaatgctttggcatctaaatctgtgtgcaaatcctggcctttccatttgcaaatgataaaccttgagaagtttcatcaccttcctgaatctcagttattgctcctgtacaatgcaggaaatgtcacaatattttcctagcgttattctcaggattaagtgagctcatgagtgaaactctacttcaatgctcccatggccagggaaggcatccacggatataagttgctcatctgagtccccaaaccaccagtacataataaagcagcaacctcaaactctagcagtgcctctaatttagggatcttattttttaaaaaatagtttatctctggaaaaggcaacagtgatttaaaatagaattttattgtccactttataaatattttggtattgggactttgcctgtgagaggtagagacctcttaaaaggttttaagcaataaagtatgaatcatggtacatattatgtaaacatgtttcttggaataataagaagaatgataggaattaagagagtggatagattagaagcagggatccagtttatgtcaccagccccaaagcctaggcagaaccatgagatctcaaaataaaactgagtccggcagcatgaggataaagcagttgaatggagagatatgaagaaggtgaaattggtggaaattgttaattaagagtgagggaggaagtaagaaagaaatgaagactcttatgcttatgatctcagcaactgagtgtacaggacaagtcattcacagagttgagtgacagacaggtgggaaagttgacccctgagaaaatgactagtgaaggaggttgaacatcttagtttaaggtgcctgatgacatccaagggaaggatttagtagacagtcaaataaatatatattcatgaaggaacatgtgtgtgtgtgtctgtgtgtctgtgtgtagcagcaaagaaggcaaaagtaaaatgtaaaatggtgcaacaaagtgaaggacattaggggccgacatgttccatggaaactagcaatttaataagagaagtctcagtggactgaaggggaaaaaggccaattgtcgtaggttgaggaggaaaagggtgcagaggaagatgagatgacagaatgcaggcaattatctgaagaaaatttggctctgaagagaaaagaagggaagtaactagattgagagatagggttgaggatgactacagcatgcaagcagaaagagtgggagaagttgaaggtacaacataaagagagagcttaattgaaggagaaagtgccctgagaagtcagaagatgagattcaggataaaatactagccatggacaaggggaggattgctcaagccaagagaaagcaaatcacagtgggttcgatggtctgactttgcagatacctttgctagattgctatttaatgtcgagcttattctctacaaaacattaaatcattttccaacagggaaaacaagaattacacacacatacacaagtcaatatataaatcaatgtcacaaaatattttatgcaagaaattaaaattagaatagagagggaaaagagaatacagaacatttgggaacatttttgagaggaaactggagttgagtcttgagaaatttgaagagttggagaagacaaacagttggtgtgttccagagagagatatatattttggaatcatcaagatctaagtggtgttgaatcacaagtatggtgtatagtctaatagttttgacttttaatctacttgcttcctgaataagaccaaaggcaatctagaaatgtataaatatatttctagaaaaatatatatatacattatatatatattcattatatatatttattatatatatataaattatatatatatctatatatacacattatatatatatatataatggcaccactaattgtttctttctttgtattgagggaatgttctacaaattatgactcccaaaatcttcatctgtggtatttttaaaatcagttttacatctctaacgtcttgagggtcattttaatttcttagcagtaaagtgacattgagtaaaccttggctgattcatataccaagacctgcttttgttttcttgtatctgtttgtgaaaagtcctatggtttcagatttctggagcatttatagaaaataaaatagtttctgaacattttaaatacatactttatttgccttcaccccttgtttcttatgttaggaaataaaaacaagattgcagatgtggtccagtccctcccacccacccctgtgtggagcacagggagatggatattatcctggggtagactgtatatttgaccactcaatgcctgcatttgctttggttggcagccaaatgacctttaagctcatttaaagcttcttgttacctaaactcctcggtctttttttttttttttttttttttttttaaatctggaagccttgagaaagaaagcaaaagagaaataattgctccttaaacaaagctaagacagaattatcagcaagcatcagtgcagcattgcagacttgaagagttgcttgcaggcatcttactggccattcctcctttgcagccataagaaatgtaaaacatcatgtaccccactcaggagaagggggtgtggggtctcttgaggttgatccactcagattcacataaggacttcaaagggaactgagttcttgaattcttcctataattttctgtttgtctgccatatatataacgttttatttgctgcttctgagtgactgaaagaggaaaggacacaaaagaggggaaaaaaacccactgtaatttttaatagttaagtcacccaaattatatactaaaataagcttaccaagcagcagttaaccaaaattcgttgatgaaaatgaatggcagtctgtgacatttcatcaaacctgaatgataccccgcccccaccactctgccactctaaatttggtgaaataccaaaattcagatatttaaacttagagaagaccacattgactaattctgtaccatacccttgctcttgagaatatttaatttttttcttgccacatgcgttttattatttttggtcatactaaagtattttttaaggatcatatgcctattccatgtgcccttgtagactccataaatgggaatgtctggctgctctgctcatgcattcctggtgtggggtgccgtttcttgttctccttttatatattgtttgtatgtcatatttttatttcaaacttcagtgagaatttccataagtatgtattgagtttctactatgtacaagttggtgtgttcattgttttgtatgcattattccctttgattaatacaacaatattgaattattgttattattataaccatttaaaacataagaaagctgatccccagagtgacctcactgatgttatacaactagggtgttgaggtacatggattcaactcatgtcgtctgatcccagcgacaggctttcttactacatacaacacaatcatctctcaactgtacttaggaagggccttgtgcattgttccaaaggaagtgaaagtttgcagaatccttacccttggcatgaagaaagcaaatctacagctgtagactccttgcctatcaataggtaccaccatcatttgcatcattttattgtgactaaaacccaccatgacgatcaccactaccatcaccaccaattgtcctacccattgttttgaagtgctggaatggtacctgtcactcacaaatttaattaaatccgatcatattcctaatatgaccttaaaagcaggaataaatacacaaattccccttgatggttccattgcctataggctcaacacagccttcatctgcagtttattggtccagtcagtgtgggttcccattataattttttaaagaaatttaaaattcactgccaatattcaaaaactgaaaatttttacattaagattctagcctggctctttggtctcatattacagaatagcataatttcctgttgctagtgagtactacaggcctgttttagttgggacagctattttatacttatctctctttccccctgacaagagattgtgtgtcaatttccatttattactaacacaaagctggattcgcatgctttttgacttgcttggcccctgtaggcatttaaatttgtgtctgtttctgttgcattaaacagctttagagagcaatttactttaagttttcaggtaaaaatattcttagtaatgtgctttgcatcatcaaactaaatacaatttctttcctctgttatttggaagataattttattcttagagtgctatttttagatcccaacactttgacacaaaaacatcaaacttttgtggaaaagatgccagaatgtgtatgaaaggcagtcgttggcattgatgggcagactttagaaactaccattttcaccttgaaaatggaaatggagagacatacaattctattgcagtacagaatttcttcaggagaggatatgggtttggtcttcattccacttcggctgtttggaatttgctttgaaatctctgcctgaaaagataccggaatgtggagattgaaattcatccctgtgtctatgcaacattcatagatgtactttcaagctgagacaaaagccttattctatatcctttgaatggcctctaagtacaggtattcgaattgtagatattgtatggtatatttctttacattttccttttgatctgtaggaatatatgtacaggtgaatatttgacttattcataatcaagatgaattaatatgtttttctccgttttcatgagttggataataaatctgaaaatttaattttctacatgtggtgtgtaatataagctctccaatacaaaatcataggtggatgcataaaaagataaattgacttgcctggggccacagagtagttcaggaacaaagattagaactaaaataagtgtcactgccaccatttttgagcatttaccgtagatcaggcaccatgctaagtgactacataatctcttttaaacccatcagtcactgtgatgtagatattatctccattttaaaattgagcacactgaagatctcagaaatgaaattatttgcccagtctaacacagctaggacctggggactgagattccagagcacagctgtatacttctaaaactatgtccttaaagacctggggtagatactggggataccaagaatgtggcattgtccctgtctcttctgtggtgtgaggtgtgactttaggccagctatctaatatctctgagcctcagtttcctcatttgaaatgggcataatgacacctacagcataggaatttttttgggggaaaaatacctatcccctagtttatttctgctcaaaaccattgtacactcaatgctagtttcctacatccaatttttccttctcagccaaatgatgtggcccttaccatgagtccaaaaacaccaccttaaacaaaaggggaaaatatccaatggcttatcctattctttctaaactttatccaaaggtgattagtcaatattttatttgcatggttaacaaaaacaaagccagagtcactagctaccgagatctttaagaacaaaatgaaaagcaacgaagcagtaactataaagcacctcgagttaaaaggtggttaaaaaaaaatctaaacttgattaaaacctgttggcaggtggctgaaacaagtccttggagtgatttttgagtggaatttgtgatggctgtttcaagttagttgctgagatagccgatctctttatgggaatgagaggtgaggtttaatgtcacattagcacacattgagctggtgggctgctcttagccaccaaaagcagcatctttgtaaactatccatttctacaagcacacgtggggaagatgtaaaattcacttgtttttggaagccagtcatgggttttgtaattaacattccttcccttcacatacacttaggcgatgaaaggccttctgttttccccctctctgcccctaccctgctgcaactggccaaatcacttctgaaaagaggggtcatggaaaagagtccctagattatccacattttgtcctctttttttcttaaatttatgttttgcaggacaaatgatactggctttctttccttcaaagaccacttgcctgtcactcagatagttatcactgataccgacagatcaaactcagaagccgcttggagaattggtcccttgcgttgctatggtgaccgtgagtacaaaatcgaaagaagctttctctctgcattacatgagcacaagatgttcttactcccttatcccttttccctgcagtgtgccctagtcttgaaaattatccacatgtccagtgctttcccataccccactgaaaacgataaaccatgttgaaggattttctcatttgcaggacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctgtaagtgccctcaattatgaatttaatgtaactgatcaacaaacaagttttagtcttgtttttgccaccagtcactagtgggcatttgtaccagcaaattaatctcactggacatctgtaaaattagcagtgataatgtctagttccttctgatgctttatgattttttatgacctgtcagtatttaatcagtcattctcttatcaaaacatggatattccgaaaattcccatagacacctattacagtttccaaaggtatttcttacctgtgactttaatcttccacactacaggactttattcatgacactttccatgcaaagctgaaaagaggattattatgcattctattcatatttagggtctacttttttgctttgcctttgttccaaaagtaatttcctgacttatttcccacactaggagcgtgtgactatccaatcagaattcccatggtttctctgccacttccccatggacagtggcgtatctaataaacttgatgccaggatgtggatcaccttttagcactgcatatcctacatataaactatattcagtaataatcatgatatgtgaagaaaaataatgggaatacagatggtgacatttcctataattaaacattttgtatataatcatactaatgaaacaatattccaatactaataaaatacaatttaaaaaaattacatcaagtggtatttttaataaaaagggaaaaagcatacctatatattgctctgttgcgatcatagtaacattaaaatttatgtttctgagtctctacttctcgaaatttgacagtgacttcataaaatttaagttttttcatatgttcatgttcaaaagagagtgtgctcatgtccatttatcttatattgagaaaataatactttctattaattttagtttgtttcatatgaagcaagagctatacaaatagataaggttttaaacttcctatttgttaaaaattcataaaaatttcattttatactaaattatgtaaattctggtactgttaatgtttttacttcaggattgattctagaaacttctacatgtctctgcaagcaaaaaaattctactacaataatttcaacagaaaattaatgataaatttctattttattaggtaaaaagttaccatattcctaagaatttgaagttgcttgggttctagtaggatgcaaattttgtctcaaacctctgtggttccatacattcatgtattcaacattagatttgagtcaaacaaagctagcacagtaattatacagatgaaaaatgagaacttgagttcttattcttaaaaataaacaattagatttgagtctgtatttttagaagacaatggtaaatctagagttctatgtattaactttccctcagaatataatatttattaagtggaaagagagaaaacatactaatttgaagtttatatatacattgttaaaaattaacagtagtgtcatacaaacaaaatatatttgtttatttttaagagtaagaacttaagtcaaggcgcagtggctcacacctgtaatcctagcactttgggaggcctaagcaggaggattacttgaggtcaggagttcgagaccagcatgcccaatatggtgaaaccccgtcgccactaaaaatacaaaaattatccacgtgtggtgccaggtgcctgtaatcccagctgctcaggaggctgaggcaggagaatctcttgaaccccactggcagaggttgcagtaagccaagattgcactactgcaccccagcctgggtaacaagagtgaaactttgtctcagaaaaaaaaaataggttaaaaaaaataaaaataaacagtagcttcagcatctattgaaacagaccaacaaacgatttgtttggtgaagggatgttttatcactaacattgcttagaattacttgtgtatggtaataatttttaaaaagatgtatttttagtgacgtttgctatttttttggttctctgcatgcagcacactttttattgcttatagatggggtaggctgtacccaccaccttgcccttgttattaccatgaccataaagactcaggcttgtcattaggtgccctatgtatgtgtgtctaaatgaatgtttttctgtagtttgattgaggcaattgaccatatcactataatgatgtgactgcatgaaatacccttgaaagcataagtcatgtcttagcaacagaaattggaaacttgagagctccagaaaaggagacaaaaaaaaaaaaatgactggaggagatgacagaggtgtttaagtctcctgcaaattaccaagcagctaagtgtttcttttgcagttaccacacaatacatacaaggaaaaagatcttcttaattggtagttttaacctccttttgctccaactattgagactattaatgggaggaagctcttgtggctttggtgtgaaacaagatccctcatacctaacatggccagtctctaaaaatgttgagttgaatgccaacaatttcataatatggatataataacttcaatgtaaatttaataaaaatcaggccccatggccttttgattcattaaagcagcagcaaacgtatattattacaaagtaatgactgatgatttagtgttaattacgtatcaatgtccagtttgtttgcactttgtggtactgtattttagaattacatttgacaaaaatcaaaacccactgaagtaattgcttggtatataatatatcaccagattggagaacatatactctccaagacaagattttatataaaaacattgaaaagttcaagatcttatactctcaaatatttgttattattaatatttaaaaggggaaaagaccaaagtgggatggaaacatcttgtattctttatttacagctacactcatattacgcattttaggcagatggaatttttaccctaaagggttcatggcaagaaacctctatagaccaggcacttggaaaggaaatggccttttaacagatgcagtggctcagaatagatttccctctcatccgcaaggagtgttcctctaaaactatctgagcagcagtttccaaggttgatatatccgaattattggacagggaacagtagattcccatgaaattttcagtccatttccttccagcctgctttcaaagatatttgaatttcgtagcccatactctatgaaaaagaagacacgccactatgttcacaagtcttagtgaatgtgttttagtgggcctgtgaaaacgataactattttgatacctatctcacaatggctgtacaggtagaaattgatattttagagtagatgagatcagaaggaaatggcttttgagagtcagtctggcatagtggaaagaagctagactagaacccaatgtggatttgaacttttgttcttccaagtgggtttgtgagctgccttgagcaagttcttctcccttcctatgcttatttatgcaacatggggttggtgacatccatatgccacccagatgcctttggctgcaaataacagaaaattcaatctgaactggcaaccacaagaatgggaattcactggtactggagcatgtgactaagcccagaggaggtaggactggcttcgtttatggttgttttcagtagtttaacaaagttgtcagtcatctgatggttttctctctctgttatgaatgttgaatgtctacttcggtctaaggctggctctccatcatggtggagctgcatcccagctggtgaagaatccctgctttccagccttacgagcaatcctcctgagaggccactcacttggcccccaagaaccaatgtgtgtgactgggaacgtatacattgcagattgatttataccagggcctacccccacaccagagagtgggctagcttcccctgaagcccatgggaatgggaaagagggaagagtctcccaaagtgaactcagtattattagaaagaaggtagtcgtcagggagacaatcaatgaggattcttctaaggcagttgtcagaactgaaatgtgtaatttatttttaaaaataccttgcagaaatttgctgagctgctcaggggaaaaactgtacatatatatactgtatgtatgtgtgtgtgtgtgtgtgtgtgtgtgtgtgtgtgtgtgtatatgtatgtttatgtatatatttactgtataaatatgagagaaaagaaagagagaaagatttaactttatgatttcagaagtatcatactgagaatattacaaaatatgatgttaacttggacacactatagttagaacctcagaaaatagtacaaatgaatactactaataattacacttttgttgaattgttgagcaattattctgattagacactatacaattctttacattcctgatttcattttctttccaagcactcccatcgatgacgatcactgtgttgtactgtgattaccaccacacagtgcacgggtaggcaggatgaacctagagaggggaagtggcaagccctgatcgcacagctgggaaggttagaatcgaggacccacccagctctgtctgactccttgcagcaaccccgactctgctttgcaccagtccacaggattgacaatgttagaacttaagagaacatacaattatttacctccaggttttgaggcacaggacataaaggaagcccctgcaattttgtgcaataccacaggtactatttttctagagatagaaaatgtggctgccatcagatccttgaagagattatgtccctgaaaagttttaacagtattttatttagttcatatttctcattttacacatggacacgtagaaggccagagagattaactcactatgttaaggccttatgaattatttattccataaatcgaccctgaaatctctctcatgccaacctggggtggggattgaggacacagaaatggagtgtggttccgtcttcatggagctcaggactgagtgctgggagaagtgcagagtgtgtcctaaggatattctctaatgggcttggtggtcagtcctggaagaacatcatgcaggagtcttcttagcagcttcttctcatctcctaggagcacttggtagaaactctgttacagccctaaacatgccctttcttttttttatcagtcttctcaaaagtaaatcatgaactcatcttgtttcatttgtctcagaattctcagtgcctagcacagggtctggcttgaaaaaaaaatgccctgaaaggctaagactccttagttttgccttgaaccataaagaagtagctggtgagagaaggcattcgtcagaaggttgggggaagttgaacttagagggtaagttcatgatagagctaatgctgtcattggtcttctcccttcctattcagggccagtgggctatgtccacctcttcagcaagtgagagccagcttgagtttgccttaagggccctgttatactgggccacagtgggatgtatcattcattctctcacattgttttcaggcatctttattatctattctagctttgactagccagggcaactgcacaggtttccaggtgtggaggttttatcgcaggaataataatttaaaaattgagccctgggaaacaccatctggattcacatccagactctgccccacccacactgggtcagcttacttaggtacagcttactacctgtaccttacttccctcatctgtaaaagattccctgtctcataaagttgtagcaagtcttagtgagtcaattaatgaaaaatgagtagtaaggtatttggctcacagtaagtactcaataaatattaactatttttattgaattttactgattttattgaattttactgattctaggaggtgcagcttaaacatagtatgtctttaacagttgctttaataaagttaaataataataattttaaagactttgcaaggaccctaataacttggtataaaactgtaaaggtataaagaaaattgcagaatggcatttagtatgtgcagtgtaatgatgtttcagtgaataaaatgagaacttcctgtatacaaggcacagtgctaggtgctgggtatacgataaatcagatgttcttctagagttgcagactcgggggagacaataaacagattattatacagcagggggctgcagtttggagcagaggtaagcacagatgggaaacctattatggaggttgtggtcagggggcaaggctagtcacagccagcgaaacagcaagccctccccaaacatgtgttgtctcagtggaatttattatccacaagactagccttgcaggaaagcttttagcaaaatctttaacattcctcacccaaattctcaccaatcttattctgtgttttatagaaaaatgtaaatgtggggtccagtcatctctcagttaagtgtttttaaatttggggatgtgcagggctgccaggtggcactggtgatctgaataagaaacagagaaagactcaaggggccaccttcactcttatttagtctaactgctcatcactcaatctgttcccttcaattctgtttcctttaaggcatgaatttgtcacctgaagccaatttgcctaggttgaaaaatcacagatcacagtaataataacaacagccatcacctgttgaacatgcagtatgtgccaggcacagttctaataactttatcaggattcgtgtctaaataatctgatgatttaagtattgtttttattcccattttacagacaagaaaattaaggcatggtgacattgaaaactcgccttagatcacagtagctgcagagtctaagctcttaaatcccattcttactgcttccaccttactacctttcctttaggccagggctcggtagaaagcaaaagaattcgagctctcagatactcaaaattctgtgtaatgcggactttgatggaggctgctttcagttaaggtttaaaggctgggaagaaagtgctctgaggtggagtttgtcttttggcatttccgataatttaaatctggcagttgatgacttcatcaaataaatacccatttcctattttagggggtagaggagagggagcaattgtgaaggtgcctagaaaaaaaggaatgcctagcatatgaaagttccagtcctctcctcatcctcaatttgtaaattacaattagcctctccatttcctttacatttagaacattgttatgtgataatggaaaacacaagacaatatactcaacagagcaacatcgtgaagaaccctgcctgtggagtcagattctgctaaccacttaagacacttgcagcaaattatttatatttctgtgcactttagttttctcactcataaaatgctaataatggtacatttctcatagggtggttttgtgtattaaaatgagataatccatggtcagtgcttagcatggtgcctggcatagagtttgttgttcccactgtgctaccccttccaattctctctcttaatggttatccaccattgccactatcatcaccaccaccatcactggcgccatcaccatcaccttcatcaccaccatcaccaccaccgttaccaccatcaccattaaccaccaccagcactgccaccatcaccatcactgtcaccattaccatcaccatcgccatcaccaccactgccaccaccactatcaacaccaccactgccagtgccatcactaccatcaccattaccaccatcagcactgccactatcactatcaccattacccccctcaccaccaccactatcaccacaaccattatcaccaccattgccacgaccaccaccatcatcatcaccaccaccaccatcaccatcatcatcacctccatcaccaccacccccatcagcaccaccatcaccatcagcattaacattatgcccaccaccaccatcaataccaccactaccacagcactaccaccaccaccatcactgctgccatcaccattgtcatttcaccatcatcagtatgcttacttctgactgggtgccatctggcttccattatacaaagattgttatagagaggcagaaagaataatggaaggagtcccatgtgatgacaggaggcttgggtttgattgcaggtaccgccacctgcagcagtgtctccttggacaaggcgatacaactttctgagcttttttcattatggaaatagcacaaatgcttatataacatgcattagtaaaataaggaggaagcactggacttcccaaggcctaagtctcctccctgcaggagtggagctgccttgctaacctcatgtctgcagatatcctggaggacacagctgaagccacaatagatccagaaaatccagggcctcggcattcatgcaggtatatcagatgagcatgaatggtccaggtgcctatcctgtttcctgaatttgcaaacgtagcaggaaaaaaacaacttggaacaagtatacacatttaatttggtagctgttactattaatggtgatttcagtgctgcagggatttcaaaagaagtcttctctatattgatactgacttacaatcgtttctcccactcaagcctgtgccttgaatgagctaacaactccctctatccttcctgttttcctttccggtttcagctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtaggtaggggacatcttaaggctccttttgtgctaaaccctgcaagatcactgtgtgaccatgcccaagaaaaaattctcttttatctgagatctgggatatgatcaaaatgtcataaatcatttctaatggtaaatttcattctatacattcttttattctggcttcattggctacatcgagttaagataatgctaacctttagcaaattttgaggttgtccagattctgtacattttctttttgtaatattgtcttcagatgcccagggaccccttttgttctacatcattgtaatataaatctactccaagggacaggacatgtcaactctttacaacttagtgggtgtagactgtaagtcatgggctgcccttccaagtgctgccccagtcctgataattacagatatccatgcaatgatatagttgaaccattttaaagggattttcgtcaacagtaacatggttgagaaaggaatgatccctttctaaatcagggggctctttgatagtacctgaaatcatagcactggggatcaacctgccacaggctgttcatctgaactggcaactgctgctggtgggggcctggaaagatccaggcatccttctttagtcattcctcactactttcattccactcatagtcactgagcatctacaactggtcaggtatcttgttagatagtgggtattgaaagatgaattgagcactaccactgcttttcaaggagtttataatcctctggtgtgtgtgtgtgtgtgtgtttcacagagaagagagcatggggttttggaagtctctcttcagtgcctgagccttaactacatttatgttggcattttgtttcccttgacataattcttacattttgttaaacataagggagtgcgtgtgtgtgtgtgtgtgtgtgtgtgtgtgtgtgtgtgtgagagagagagagagagagagagactaatacagggtgagccttatagctgtagttaaaaaaaattaacataggttgaggagggcttgtaaagctttaaagtacaaaatcgagctcttaaagttaagaaatattgtcaatactaccaaaacaaagagtgtgcttttatataaaacttggagttcagatgtttagaacagtgatgtaaataagtgacagaatttgtcagtctacccagatttaactttgtttccttttttgtttatttattttttttttgccaactcccacactacatagctttactgctagtgatgaaatgccaccagcattcaatggaagtttccttacttgcttcctttaaatttaggtttgtgcaacttttagctctgaggaaagcagtcactaaaatcacaccagctaaaagaaagcaagtaatagagtgtgaggatatcatattctctcttctcaacaggaaccatatttctttctttgtctgttatgttccccagatccagcagaagctaagatataaattatcaaaacagttttgtgattgcaagtcatttgtttaattaataactcatatatgtgatatgattcactattaaaatattttaaaaatttatattgctgttttaattctatttaaacatcacattttgatgggtgacttctgaggaaggttgctagtcatcaaaatctaatatattttttggtggaatcaagtcaagtgtttcacaattttcataaattatattccatgccaaagtttaatttatcttcaggcagtatttatgaatctttctggctgaaaggtatatataaagacggaataattttttaccctttcatgcaaaatttatgtagctacaaaattatcatacaggctggatatgtgataaagtttgcgcaagtcaaaagggaaaggcggcagctgtgtttcatggcagatttctatctgcagacgtttcggttaaattgatcacaaatgcaatgagctgtaagagcatgtcgatgggtctggaggagatatcttgctggagctggagccaaggtcagctgtggcaagagcacctgcttctgctatgtttctctccaataagtcccatctcagatgttactctgctttattgaatttgtcttaatgtacttgaagaagaataaaatgctgttggaggtcactttaatggtctttcagtttgaattttcctatttagagttcagtgatatgcccatttagaaatgtcaggtagccaacaaagctgaagtctcaacatttccatcttgcacaattcagttgttcaataaatatatagataaataaataagcattttggtgcttagttatagtcaccaaaatgaacaattgcattctgtattattcagaaattgagaggccctggatatttatatttgctagggaggaaaagatatcattggcgtgtgcttctttactggaatagattgagtgtagcattacttaaatattaatttggatatgtctgtctagatatctttggccgctgaaggatctttcaatcaaaatggagcatccttcagcattgtaatcactgacacagctgccgtggtcatgagtgtttcctgagtaccagaaataggctgcgtttttacaataggatgttcctctcagcactgcccctgtcattggaatgtgacaggttgaagtgctgatacatgagtcaatgcatactggatttccagaatcaatattttaacttcaggctgttatatcaccatgatggttagggacatttgcaaccatgtcatttcaccagtcacatttctttaacagagcaggagactcttcacaacatgcagcttctgaaatgtaagctgcaagcgtgtggcattctcacctttggaatgctcaatagtaccgccccttctgctttgttattcccccctaatgtgtccatcaatgtgaggatgaggcaagaaaaatcgaagatccaatggagagatctgagtatgcattcctggtcagatgccaacaagccataggccctgggtagaaaactaactagcatgagtgtactattgtctttatctgcagaatgaaaatgaagagactgtaactgatcttctaaggcttgaagatctgctatctgcatgtacaaattaggaacgactgtcacacctacagtcatgcccatgtgtacgtaacagtaaagaaaatgtctcattccctccaaacttaacgcaagatctttcaaaatatgcggcaattatagagtggaaatcttgtgaagatggggcctgtgagtctcattttatgactctatttccttctactttttatttttcccatgggcctattttttttttcttggcccaactgctctatttgtgtcaaaataaactgaagctactccaaacttacaatcccctggggaaaatactacactgacttgataagtcataacatttggagagatcccccaaaattgctgttcttgcttccaggctggaagggaattattactcctatttcaggtgaagcgtgtcaaactcagtgaggtcaagggtgaagccaggcaggcttggcgtgcacatgtttattttgtgctctggcacttcctaaactcttgatttgtggcataatgcaacacttaggtaactggcctcagtctcctcttggaatagtaacttatattttatgcttgtgagtgcctcatgaagatagccttcctgaagcacgcctgtagtgctttccattaggcatgatgtcatgtgtctcacagtataggaagagatctatattctcttcacattgagaaataattggaaaattatctgttagcatatttttacataaagctgtatttgcatggaggataataattatcatgacatcaacggtgaaacaaaaagtgaagaaataattgtttttttaacattatataaatctctgattatgtctactattcccccataaaagtgtatttttttcaaagttaaataatatattaagtatacttcaatttttttaggaaacattaatgtatgactttcaatgtccccttaccaattacataagggaaattgttttggttggtttaagaagagggtaagagacctctgagcgctagcgggcaggtcctgggactgcctcagtagccacataagaaacactagaagagcacccagtggccactcaaaaatgcttctttagtggggaaaaaaaaaaaaaagatgaagaacacctgggtttgtccctagcaccagtgatccacaaaatcaggttcttgtagcttgaaaatgtttgaaaaaacattggttctgtttttatattcaggaaaagtgagtgattaaatcatcctttcagcaaaattttgtctcttcttgaagatgttgagaattggatacatttaacccatcccaacacccattttagtgttttctactcgctattatatattttttgaaacagagtctctctccatcgcccaggctggagtgcagtggtacgatctcaggatctcagctcactgaaacccctgcttcccgggtacaagcaattctctttcctcagcctcctgagtagctggggttacaggttcatgctggcacatctggctaatttttgtatttttaatagagatagggtttcaccttgttgcccaggctggtctccaattcctgggctcaaacaatctgcccaccttggccgcccagattgctccctactatttcagacacacttttgaaaggtttgtctacaacttcttctgctttaattgagctcatattgtgatcttttggtctctgttggattgacaatggacaattgaagcagaatggagggatgtgtgtgtgtgtgtgtgtgtgtgtgtgtgtgtgtgtgtgtgtgtgtgtcaggattcatactgtcttttttaaaggagaatgcagcatggtatcatcttctcatgcagctcagaaagagaggacccgggcttcagacctcacaaaaactcaaagttagaagcagtaatttgattctcttggcacttccacttgtcaacatttataactcagtaaagaaagaaatcattagaagagcatcatttatgtgaaactggcattctaattgtaaaaagaaacttaaggcagatctttctggacaataaaacagttctccctggacattcaaggacccaatctgaggggcaattgcaggaaagaaatcaggctgccctggagctaatgtgactgccacatgctgagtagccacaagggaagccccagttggaaaagagcaaaccagagaggtggctgaggctgtaacactgcctagagcttagtgagctggtttccatttctctgagtctgcccagaggaagcagatgactcagaggaggtgagaaagcccttgggcagagtaggggatgggaagtgtgtcgaaaacctccagtaagtcctactggccaagttatactcttctcattttgttatgaagttttttttgaacacatgcacaagtggtgtctcagccaaagcttcgtctaccttttccatgcacagtgtgtcatcatctcctttaagggtggccttgcttcagtttcagcagcgctggcatcattagcttcatcaatacccagaccgagtttgatcatcctgtcaatcctgttagcacatgtctggggatcttccacactcaagccagaagacaggaacacattttcataaaccaggaagcaacttaatggaagaaactctccaaaaggggcttgttttccaaagaaaagtatagttcagaggagggaaattataagcctacctaggcgtgttgtaaagccattcaaaaatagctcagagagaggattctgaatggtaatgtagtgtccgactcacattctgcttaaaaggattgtaacaaatagagacaagttaaaaagaaaaaaaaaaaagagtttcttctgaacctggaagaaagggatgtggattcaaagctgcttcagtagggaaggtgattttgtagaagaggaggtaagaagtgccatgctccaattcggcttccagtgttatcgtccctgtttcaaggtaaataaggatctgctctcaggctcatcttccgtgtgtagaggggcttagggatctgtggtaggaccttgtaatctgctgtccaggtctcccttcaaagaaggacttgctctgtggctgggagtgctgttggtggacagtcttcatctgtctgcaccttcagaagctgcctcagctgcagagaaagccttgaccaaggtcatgtcctttccagggggattcacatccagtgactgagccagagtgcaaaggcacaactgttgggcccaagaaggaacatctctggttattcgttctggcttcagcactcccggtgggactgtgctgggctgatgttgggcctttaccatagttcacttttctgcccattcatactttctttttcttctgtccaaccataagtatggtttccaaggtttcccctaaaaatatcctgtacccttaactccatcacagaacttgctttctggtgaacccaacctgagaatcaggtatatttttcgtgcaacttacacacatgtgtgcatgctcacacacatacacacacacacatgcttcttttaaatcaaattaattttcttaagtgaaatttatttttcgtttctcctgagaattagctataaaataatgcctcttcctctcctactttctttttccaaagcactgtttcatgctaataggttattaagaccaagtttgcatggttttgcttcattaccctttgaaggtcctggtactcaaactaaaatggacctgcccctaccctgatctacctgacagactcctcttcatggataatgcagactttgatgagtcagatgaactatctcctctcaagggagtctatcctggtacacccccctatctctgtgagcacacacaatacgcctgattatactgacctgattgtttcatctcccctttctaggagtttctttgtgggaagacgtagtgtctaatttatcttcacatctctgggaccagtaaaggttttctaatatatttagtgttcaataaaaatctaatggattaatgaaagtgaatgaaggcagagctccccgtgccgtccattccactagtggctttatggtattaggcaagccacttactctctctgagcctcagttattccatctgcccactgggcttaataataatcaatagcttgcaaatcagtttcaaacattgaatgcagcaatggatgtccctgttccacttgggattttcttttaagggttcttaaataagaatggcaagcaaaagactgtttcaaatgggaaatgatttgtgccttcaccccattggaataatgagacactccttttggaaactgaggggttttgacatttaaaggacacactcaattggtgtaatggctccagggggaaagatccctccctacgctggattttacttcttctcacaaatcaacagaaatgtctccacacactagtgtacttggagtgtgagtgcctcaaaagctgaatgcaggtccttataaaggggaaagtttcttgccattttcttggccatcgactttaaagataaagggatttcaaaaccacattttcaaattactatatggttcacatacgcctgcttcaaaattgttattggtaaattacattctcactgctattattttccccctgatctgttcaataagacagcctttttttgggttgtttgtccaaatcagagttgtgtccaatctggtagtgagaggatgtgcccagaccagaaatgggacctttacttgtgatttaagcataccagaaataaactgaaagctgaccacactcctaacacatttgcaatgccttctgggcagtcaggatttggcctcagccactgaccttctcttggtctggactgagaataaagtgcagcaaaaagccagactatatgattgttttaaattgaaatgactttctttagcagaatttattcttcattctcccagggatcaacctcctcttttcctactatctcacccaaaagagtttttaaaagcctgtgggtgcttcggtggagtttggagcattttgcaggatggggagtgagggacagtggtctgattctgcactgccacttgcttttctttgtccttcatccttttttccccactcacattcttttccttccataattcactgagcaaatattttccaagtgcatgctcagtcagccctgggctgggcaatggggtcatggagataaataagatccattcactctttgggaggtacaggctcagggaagaggtgagctggattttctagtaagtccttcatgctgtggtatgtggtatgtactcaaggcggtatgagcagggaaaactggatgcagctcccaactccatgcggaggcaggccccaggctctatttctcttacgttgtgtaagtgtttatttcctgcctctctctttcttatattggtgaaataagattaatttgcagttagtacaatgtctagggaaatttgcccttggaaggcagcctgagacttgtgtgcccactcagtgtgtaggaagcagatctcttacattgctaagccagttgctcacttattcaggtatctgggaggacacctggagcccaaacgcctcagggcctaagactgaccatccttccagatcttgctgtctatttggggtactcaacgtggacactgcattccccgccgccatctacactgcactggagccctgctttggactcgggttcgtcttaaaatagtgagatggtacttctatcaatgacagagtcaggtgcccttttgctccatattctctgccattttcccacaaactcttatcctcaaggaccgttcttttctaccttttatctcccatcctttcacagataaattaattcatcaaaaacatgggggtgggggttactgtcaggatgaggttgttgccctgaagggcagattcaggctgacaaggtcttacccaataataagaaacagtccttgcccagaggagtgtgctccaaaagcagtaatggagggcagtggagcagttatatatgtatatatgtgtgcatatgtagatgaggttcatttcttttttataatacctccactctcttagagtttctgaagcctgcagttttcccctttccgtcagagcatattgtgttatgcgtttcctctgattccatcattttttatccttttgtttatttgccctcatttttctcctcttttatcttctgcaaagccaccttgcttccttccatttattcctgaaggccacgtaacctctgatggtgcctgcatgcccagcaggaaaatatggatgataatgtgtcctgcttgctttgtgttcacaaaagactaaaagcctctagatatttcagtattttatccttgttattattgttattctaacttgtccccatcattatgtattgtgaaattgatacctttttctgtactagaaggtcatgtggaccttaaacagtaggaaagatctagcttgaacccagtataggggaggcttcagaccaaccacaagccataggtagaaatggaaagtgtaaatcagatttccaataagtatcccaggactgggagaattttagttcaattgctcacatttttttttcatctgtagtttgtaaaataatcactggcatttagcatattgaccaaagaactttaaaagaaaaaaaagcatcattctgagaatgcaaacaattaaaatttaatttattgctggtgggagtataaatcgaaacagttaagaagactgttttgcattatctactgaagtcaaacatatgcataccctatgaccaacagttctactcctaggtatacatcaacagaaatatgaaccataataaatacagaatattacttatggcagcactattcaaaatagccaaaacctatactatgcccattgagagtagaaagaaagatgatttatgaaatgtttctcacaccagaatgctgtacagcttcctttattaatatggacaaatgtcatcaatacaatgctaggcaaaagaagccagggtcaaaatagtacatgcaatgtgattccatttaaatcatattcgacctctgatttcagaaacgggttagtggtattcttagaaggggtggttggtgactggagggaagcttctggcgtgctggtaaaattctgtcttttgttctggttgctagttactttggtgtgttcagtttgtgaaaaattatcaagtcatatattcctgtgcacttttgcatttgttcttgaacacaagaaacaataaaacacagtactaaaaacagcctcaatcattgaaatattttctcatcatcataagttttaatggttttataagtagttccccatatagaattaccatgacttatttatcattctcttttgtcagacatttccctcccccagtctgtaacaactatttcaaaagatcaattaaatattaatatttctgcttgtaatcctcctccaagctccattttcagcttttttctttaaaaagtgcaataaagccagtaataacaatgctttaatggctcttgatatggattgatgaattattattcacaagtctttcacaacatttatttctaccaaacaaataaggaaattattttaatctgttaaccaaattcaagttatcactaaactcttttccagtttcctgagggggtttggcatttggtttgaggtgtcaaaatttgtagtgaggattaaatcaatgaagcatgtagaaggtttgatattaaataaattcttcgttctgatcactattattattttaccttttgggcatccagttaatactaccagtattattaaatagtgtatgtttagtgattcctgagcaagaaatctctctatctggcaaaactcaaccagatacatgccttatccttaaggaaatcacattttgaaattaaagtctacagtaggatttcctcctggtaccaagattctgccaattggagaaccaggacttaaagaagaacataattgatagttagtgtacttgtttttattcatcatgtatatgttaaaccttctgccactttagtcaaaaagtctgccactttttgaaatctaggtggtaaatgcagctgaacttcagtagaaaacaaactgctccatgttcaagggcataaaaataaagtaaggcaggaagaaaggtgggagggaagaagggaggatggaaaggtggcactgtactaatttttatgaaataagagcctgacctgatgcagtctgtgtttttccaggggcttctctgaaaatcagttttgctggagcatgtgcaggaaagagcagatacacatgagagaaatagaggctccgcgtttgtgctcaaggagggtaaaaggaactgagatgcttctctgaaagcaatgagcatttgtccaactgacacatggaggttttcaaagacagtcttagaatgatgatagtgaagtttttaagagttgattcatactcagtccaaggaaacatcatcataatgaacccacttgataccaagggccaactgaagagtatcatacaaaattgcttctagctaggccagccaactaatggtctaagttgtcaaaaagactgatagagaatcccagagaataaatgcatgctggtatattatttggtgaaagaaaacatgtaagaggtaagaggaagaaactggaagaatcacttagttgtggtattgacccaaatcgtctaatatttgtcttagaattttagggcaaggagctacatgcaggctttgaaggtcgccatgtccagtgtgactccaggctttgccacataaaatctgtttaattccccactctggccaaagcaatctctgatgttaagttttcttaggcaatgtggatgttaaattttcttagggaatgtgaatgatatgaagaataccttctttcccattgacaatttaatgagtttagtataaagtttctagcctacaactagtatgactagtatctttaaatattgtttttagaaccagaggcattgctctggtcctcaaagagctcagagattaaggctgagaaaaaaaaaaaaaaaacaaaagaaaaagaaaaagaaaaaaaacccttaagcatctctaagtaaaaagctacatgttttttgttcttctaaaattacagtgaactgtatacaagaaacaaacaagtaaaaatgaaagtatattagagcaataggggaaaaattaaatacttgcagtggccaggaaggcaacatgaatgaatgaaatcatcctggtgggttctgtggtcaagtggagagtgcatgccctatcttaaaggagctgaccccagtgcagttgagaattgccatgcaagaaagcaggttcattgttaagagatgttctgatttttcaatgaggaactaactagaatttttagaagtattttttgtgttttaaaaaattgacaaataattaaaatgaggaaatgatcggtgggtagaaagataaatgactaataagtttatatgagttcaggtgtgcatgtctgcgactacaggggtagtgtaggacaaacagtggagtgcatggggatggataacatactagtaaatacaacatatgtgaagaggtgcaaagtctagataggccatgtggcatgagagccacaagtggttcggaatgcttggtgcactgaagtcagtgcaggaagtgtgggagaaagaagctggtggggtaaggggaggccagatctcccttgctgtgtcaattgtgatcaggaatttcagcttgatccctaggacaatgactagtttccaaagggtatcaaacacgtacagcagaatcacattttcaaatttgcattaattctagccacaaaatgctgaatggaaaggaagagcaggggctgaaggtagcatgtttttgcagggattcaggttagggtgacagagaatatactgaaagcagtctccaggcatagaaagaagcagacaagctggccgttgtggttcacacctgtaatcccagcacttggagaggccaaggcaggaggattgctcgagctcagcgttttgagatagcctgggcaacatagtaagacctcatttctagtaaaattaaataaacaaataataaaaataaattttaacgaattagctggtcgtggtggtgtgtgcttttggtcccagctactcggtaggctgaggcaggaggatcgcttgaactttgggagatggaggctgcagtgcgctatgatcacaccaccgcactccagcctggatgatagaatatgactctgtctcaaaaataaaacaaataggcaggcaggaaggaagaaaagaaagagaaagaagaaagaaaggaagaaagaaagagaaagaaagaaagaaaggaagaaagaaagaaagaaagaaagaaagaaagaaagaaagaaagaaagaaggaaggaaggaaggaaggaaggaaggaaggaaggaaggaaggaaggaaagaaagaaagaaagaaaggaaggaaggaaggaaggagggaaggaagggagggaaagaaaaagaaagaaagaaagagaaagaaaggaaagaaagagaaaggaaagaaagaaagaagacagagagaaagaaagaaaaaagaaagagaaagaaaggtaggaaggaagcaggaaagagaaagaagagagagagagaagcaaatggattcagaaacagatttctgggagagggagagaaaatccacagggctggcgtaggggaggaggacagtgagagaggaggatgagggaagattactgttgcctttctgtttctgtacaataagttttacagaagattcatgcctccaataactctctacacatagtaggtaaaaagggccgcttttaaaaaattattctctttataaagaaaaagcaaacttactcctagttttctcctttgtaaagactaaaacagccaggtaaaaatggaaatttagttcactgtgcaattgagttcataactcactgtgtcattacggtttgtcagcatctgtaattgaaataatcccccagatttgtgtcactatcaccaggttctgtaagtctcaaaccttaaggagtgcatttttgcccgagaaaccaccaaccccagtcatcttcttctccattaaaaaagttgttgactaagtcacacgcaagaaaatgtgcaatagatcttgcattcttcacttctgttaaagaaaaatgacactaacaagatatatgaatagttattcaaatccaccatggggagtgacaacaaaatgagaaaaacaaaaccaaacaaaacatttgactacatatatcctctcctctttattctacacactctctaggaaagaaataatgaaccttcctctatgatctgcttgtgtttataattgatttatcttgtggttaaagagatttacttaccaaaattgagacagacaggagaatgtaattggggtttggcctcctggcctgcttgggtatcacttacgggaactgaaaataaaataattgaacacatattgtattctataaatcattacttcagaatgcaagacgagatctatcccttaggataaatttctatggatgtagcaagtgaatgtcatacatatatttatgagtctgctgacctggtgggatttaggaaaaacagcccttctctccccactctcccctgccccatgtccccctcacatcctccccatttctaattatttccttgctttcctcaaagccattgacccaccattgggccagtctgactaatgccaggaattctttaaattatctattcattcctttaacttacagctttgtttctcacttaacatctctattccctgtctaagattatgcatttcaatttctcatctgatccactttgataaggacacatttgtatctggtcatttgtcagacaaagatttaataaagttgtagaataatttctagaatgaggctcagatgagagatcctaagggtacagaaaacgaatgacaagttggtcctgaccttggtattttcccttccaccttttcctcctctccattagtacatctggtagacctcaaaggcctgtgtgtggctttcactcatccatatgtgtagacttgagcctgaagatttgaaacaaatgttgtgttctttaaggccaggctgtacctccacctcccctgggttctcccaggagtttcagcaccaaataaataccttctaatgggacttagcttaatttgccggcttgtctttcaacacacgtttttctgatatcagaggggtaggctggtggaaaactggatttctgatgggaacaaaacactctgaaatattaaatctgcctgattcttgaataattttcaagaaacatataaaatctctctgaaatcttcaagatatatcctcagcagaaagttacaagcctattgtgtattccacaaaaaagaaatctgtcttctaaatcataatgtaataataagctcattattaatcagcttaatttaaggattaatcagcacatatatattaagtaactggttctagccattgtgaaggtgcaaaagaaggcataagagagcagcagtgattgaacaggtattgtattctatgttattttttttctttctttttctttctttctttctttttttttttttttgagacagagtctcgccctgtggcccaggctggaatgcaatggcatgatctcggctcactgtagcctccgcctccccggttcaagctatttttctgcctcagcctcctgggttcaagcaattctcctgcctcagcctcccgagtagctggaattatagatgcctaccaccatacctgactaatttttgtatttttagtagaaatggagtttcaccatgttggccaggcgggtcttgaactcctgacctcaaatgatcagcccgtcttggcctcccaaaatgctaggattacaggcatgtaccaccatgcctggcctattgtatgatcttagtgaagcctcaccacacacccacacaatagattgatttttattttatagatgaagtagctgaggcttaggtaattccatggtcaatatggctaatcagcaagtgacatgcgtttgactccatgtctatctggctctggtctatccaccttccactccactgcactgcactgtgcaagcattaggaagtctactgaagttttctaagttggtgtacctaacagcttctgtctaactttgccagaaaggacagtcccactctgtgccttccacttcagatgaaagtgtgctgtggactgtgtgagaactttttttttcacaagaaacatggccatctgaagttttactcttaaacttgtaaaatacaggaactacaatctttcactttttttgtatgtatacggaaagagcttgagggagggggttcccagcctagaaggacatgtatttttttcttaactaacttttattttaggttcagggctagatttgcaggtttattatgtgggtaaacttgtataacatggatttgtcgtatagattattttgtcacccaggtactaagcttagtacccaatagttatttttctcttatcttctccctcttcccacccgacaccctcaagtaggacccagtgtctgttgctcccctctttgcgtccaagtgttctcatcatttacctcccacttataaatgagaatatggggtatttggttttctgttcctgccttagtttgctaaagatagtggcctctagctccaccattgtttctaggacatgcatttatttgaggctctttggaattccaactctcactgaaactttaataaaaaaattaatttagaccttcatgacaacagagaactacttaactcttacccatgccaacattaaacctaaatgtattgagccctataataccttacatttgtttccttttatttaacctcttagggggaacgtcatccagacagaaaggcttcctaggatgcattcgctccttacacttgaatggacagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaaggtaccttaggcgctcctgtttctcctgagtgcagtgctgtatcacctatacgctatggtcaggccatgtgatactcacactctgagacagtctttatcatctactctcccgctgtttagagagtctgcatagttcttcaacgtaattgcatatacttattggtattacatgtgttcactggcaatgtaactgaactggatggataattacaggaaaacaccctgcccacggccaaaaagtcagttaagtagagaaagaggtggacccacatttctgttgttagctagattgttagtgaacacattaatatttccacttccaatccctcagcccgcaaatgtaatcaaagaattgtagaatctagccctgggggagccttagagatacttaagccatcttaaattattttttacaacaaagagaatatcagtaaattagtaaacacagtaccgtgtatttggtgaaatctctctattccgcaggtgacttgagcgaatgtctgaggctttaaaagccctgtctgaaagttcatatttagttcattggtgggctgggactgaaacacacatgaaagtcaaattttctgctccaggacttttcctataccccttcacaatctcctgagttcattacattgacacaaattaataatcacggatatacaccttggacaaggaatgaggatcattgcttaaattctctagataaattcaagatacctcaagaaactagaaaatctcaatattcagtataaatacgtaggatttttcaaacataaggaaaaagatttggtgtactcataatttttgcaatattttaaagacggaaaaagtttgttcagtaaataatgtaaacaatattttaagagcagcatttaaattattaaaataaaatgcttgaatcactttgagacaccatttgcaaacaaacaatcagagcaatgataaataattcttctcaattcattaaagcatatcttcgaagcacctttacaaagcaatggtttatttagtccagcttgctactgttggaacttagaaacaaaagggaaaaaaagcactcactgttttatttgaaggatactatagtttgagccctccgttcattcatacaggggccttctcctgaattagtttgaattacttacttattattcctgaagagcatgtcatgcttcttgggagaaaattaatggtaaaaattttcgggctaaccgcatggaagcttaaaataaaacagtttccattccaggggctcatattatgagctaaacaagtaaagtgctgctaggtattcacactggcggaggtctctgaacaacttcccctgagaagtgtgaatgcttccctttgagccatcccacatgctaggaggagcacgaacagaataaatactatgagaccctggcactgaaatgcacaagcattcttctcagcatctctaaccaagtcttttgtttggaagaacatggacagtagacctctctgcatttctctggggacattattcaaagatctcgtagatcatattgttctaaatgtagcctaatttctttttttttttttttttttggctcctttctccaaaaccattcatactaattttcttctgtccacggccctgtatcttttccctgcatatgttgcaacatctctgtgctccctcccacttttaattatgatctgcaagttacataggcaagtgtgtgcctagccttttcatatgcttcgtattttactatttccaaactgttcattctttctgataattctaagaaaattatttcctctatatttagtcctcgcaatgtaagtaagatggcctttttagtcacatctttgagccctgccaactgcctctggggaatgtggccggaactgaaatgggaagccagtggctacaagatggttctgaacagagggtggtctgtttggtgattggggcagccttccatgctatttactatggcgcagtatatttcaaggagatggtgtgtaaatactgaatatatcttggatagaattagggtctttttttcattaccaattcctaggtcagaactgtgtttcattggcgatttttccgtttctcataatgatacgaagaagcaatcatcataaaaaataaactagtaattaactgcaacatatattcctcatccaaacaaatagagcaggtattaaaatctaaatttaacttattggggctcataaaggtggactgacttgctaaatgtcagatttggaggtccatctagcttgtttttggttcattttttctttatgaccctaatttcattctatacatgaacatggtaataggattccatcgtttcaaatacagagcttttgttttgtgtattttttctctctctttctattatcgagatgtaatttatataccataaaacccacccttttaaggtgtataattcagtgatgtttaggatattcacacagttgtataacaatcaccaccatcagtttcagaatattttcatcatctcaaaaagaaattccatgtcattagcagccacttcccagttacctcttcccgtgtccctggaaaccactaatctactttctttttctgtagatttgcccatcctgagcctttcatataaatagaaccatatagtatgtgatctttttgtgtctgatttcttttacttcgcataatattgtcccagttcatccatgttataacattcatcattactttattcctttttaattgccaaagagtgttgcgcagtgtgaaagcaccacagtttgtttatccattcatccattggtcagttaatggatgttgggatggtttcatttctttggctattatacataacactgctataaatatgtacaatttttgtgcaaacatatgttgtctatcctcttggatatatacctagaagtgagattgttgtgtcaaacggtaactataggtttaatctttttgaggaacttcctaactttttcaaatcggctgttccattttacattctcaccggcagtgaatgagggatccaatttcttcatcttcttgccaacactttttattgtctgattttttgatgatagacatcttactgaatatgaaatgctatcgcattgtggttttgacttgcattccctaatgactaatgatattggatatctttttcctgtgcttattgtccatttgtatacataaattttttggagaaatgtctaacatcttttgtagattttaaatttttcttctttttactagtcagttgtaataatttgtcgtatgtttggaatataattcccttatgagatatatgatttgcaaatgttttctccagttctatgggctgtattttgtcttcttcatagtatcttttgaaacactaaattttaaattctgatcaagttcattttctctagtctcctatcttttttatttatacatttaggatcatagataaggaagccttacttaatccaagatcatggtttctcctaagagttttatagttttagctctcacagttaggtctttgatgcattatgagtgaattttcatatttgttgtgaggtagggggtccagctttagtctttggcatgtggatatatccttgtctcaacaccatttgttgatgtgtgtttgttgttagctctcttatcccccctacacacacaccattaataaagaacttgggtaccactgtcatagtgttttaatttaaatgttttttcttcttaattaaaatgtaacataattatttataaaatttatttgaaaatttatttagaaatctagaaaagttaaaacccaatctaagtactcaaaaataatcattaatagggaattgcacttccttctagttttttatccccttgcacttaatataactaagataattttgcccattacattttatattctggattttctttatttcctttcaaaagcatttctatgtaagtcaccaatatttgtaagcatccatcttaatgattgcaatatgttccatctggtgctactaccttctcttgtttaatccatcctattaccagagcattactgctcacagataaatcgtggagctctggcaccacccctgctcaagttgaggttctggttcatctacagtccacgttgtatgacactggttgtgtacctcaacctcaagattccgtggtttcctcatctacgagatgtgggaagcgcaggactctttcacagggagtcgtgtttaacattcgatgagcactctacaaagaacatgggacagcccacagcatgtaaagtctcactaaatgctgactcttcttattgattgaaatttttcattatctaaaattttggtgtaaataatgctacaataaacacatatattgattattttcttaataacagaatttcagtgaaaaaaataaaagtatgtacatttgggtgctctttacatattgccaaaaacctgtccagaaatcatttaatacttatattcattttaatttataccatttatttttactttttattatggaaaaatggcaaacatatgctgtaggacagggaagagtttaagaactcccattcaccggttatctaacttcaacagttacaaactcatgatcatttttatttcatcggtacactcacctcctatcctcctcctttattattttgaagaaaatctcagatataatactatttcatctacaaatattacatcgtatattgctaaaagataagcactcatgataaacacgtagccacaggatcattattataataaaagtataataatttttgaaataattgctcagtgttcaaatttccagttgttttatttttatttaatttgtttgattttatctaaattaattacagcttggatgatttctggataatttctagactattcattacccaggactggtctttctgtttgttctaattccaaatctaattctactactattattaaaaccagctactgttcattgagttcctactatgtgctgtgcttttacgtactttcttccaatcctttcacccatcccaagactgaattcatcctgatttatatttgagtaatgtgagattgaatgggatcctgtgattgcaggacatgtgtagattcaggttttatctccaagtctacaggccccatggaggctcagagacgcaccttccagtaccatcccatttccagctccttctcctacttcatgtcacccatcaatgccctgtcaatacggagatcctcttgcaggtctcaggaggctctgctctcagagacatccagctctggaaaatattgtctctgtcgctaacacatcaagcccaaggttaacttccattggtccactggcaatttgttttgttttgtttttgtttgttgttttgttttgttttgtttgacagagtctcactctgtcacccaggctggagtgcaatggcgcaatctcagctcactgcaactcacgcctcctgggttcaagtgattctcctgtcttggcctccccagtagctggtattacaagcacctgccaacacacccagctaatttttgtatttttagtagaaatggggttttgccatgttggtcaggctggcccgaactcctgacctcgggtgatccacctacctcggcctcccaatgtgttgggattacaggtgtgagccactgtgcctggcccaggtgtttgttttttttaaaatatgtgtcttaccatctcagaatctagttagcataggttcttccaccaagtggatgctcaaggggtgttgttgatagtggctcggtggccttggagaatcatcatggtcactagaaatcacttgcaagttaaatatctttatcctttttggccagtggttttagatgctcagataactcaacccatctgatcaaaagcttaaactcttagattataaagtacaagaaactgaaagaataatagagtccagctgtattgctgaatttagctttatgataaaacagacaatatttaaatattaaaaataactagaactggggctggaggaagagtgacaacagaaatttggtttgacatttctaattacaaaatgcttttcattttcaatttattgtcttaagtataaagaaaaaagtaatatcctgtatatgcccatatctatgttattcctaacagaatgctctgaattttacttccatttaagcacacacacaaatatcaaataaaagtcctttattttgttaactaggaggcagtagctcaaaatgcagaccaaatatccctgagtaaatttactcaaggaaaattcttgaatcaagctgatgataaccagaattctcactgtcacagatgtctgctgcatatttttataaacaggagtaccaaggttgtaacctgcatgataaatgcaaaacactttctctgaacctttagtaaaaatgaactagtattctcaatctgctaggcaatatgcataaatatgcaactttaattttttggcactattacagactgttacagaattttcacaaggtggaacacatttgcaatagaattaggaagaaaaagccaggtattattatattgtaggtgccactaactcaatcagagactttcatggggaatttggaacattccatatgccatttagggcaaagggaaattaatcatgccaatatgggtttatgtttactgtgcagtttttatggcagaggtttgctgcctgatctaaggtgtgctgccctatgaaagagccttccccacacactctgttactgtatagagataaaatttaaagtgaactcaagagcagccttgatctaaggagagtatctcagcatttggacagatgaacatttaataaatgaatatattgtataaagtctattgggatggattcaggttaatttctcttctaacactctgtaagttcaaactgtacttggcaactctcttaagtgctttacatacatcagatcatatacatcagagaaatactgatgaggtaggtgttatgattcccattcatcagataagaaaacattctccacaaagttcattatcttgcctgggaccacatggccggcatgaaaccaagtgagactcagatccagtgctgagtcactcagtgctagttccactacactaacatggtaacagttggtgtgctagagcattcttcaaggaggctgggtgatttacatatcccactaaatgaattttatcagtttttagatcccgtatttcttcctggtggtggcagatctccattcagtgtgttatgctagagggattgtttcccataggaaagcctatttacccaagtcttggctatattttggaactgagtaccaatgcctacacagctaaaaaaatgagtttaagagttggagacctatgtcttttctactttgtccataaatttcttatttgctgttttcgttgttcttcatgatttaccaacatcatagagaattactgctgctcaccccaatgtcttgctctgtatttagagaccatccacaatctccctgagataccagagaagaacacaaactagaactgtcaggttctcagttttgggagtaagatggtgccagtgtatttctctatgcactatgctggaggcagagacatgttatctttgcttctcaggaaattagccaggcaagtggtcattattttgcagatgtatgtagagctggacttaaaccacaggaggaaaacctgagctttcttttctggctatgcaaccctgttcaaggtttgtaacctatgagagcattaagtttttcatttgtaaattaagaatagtgacttctgccacttcaaaattattgtggggaacatgttgtctgatgcatgtattactcctcacacagtgcccagtgcataggaaacgagaaagcagctaaggttagcttgaacaatggatctaaaggtttcaatgtgtgctctcccctcttatattttgcagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaggcacccagtcttttgctctttatcaattcttcttctcaggacttcgtggttgttctgctctgcaagaatggtgagtgtgatggcatgatacccagcggagtctcagcctgggctggagggacggtgcatgccctccagaactctgcataatttcaacctcaagttggtcccatctgggaagcttatttccagacttccagccaaatccttgattattctttacctttatgagatgcaattggtattcagggccagtgtcaattcactgctgaagtctcaaatgcattgactttaatttgcctcaactgaatagcagtaattctttattatttattctgtgctggaatccattaagtgcaaaggagaacatcataagcatatccgaatttcagaaggacacttgccacatgtattttgtcatctttgcttcagtcttctttactgagggctgttaaaacaatgagcatacatgcaggctgtattaatagaaggcaattgtccaggtcttagagagaagtagttagtatatgagtcataaccttggggaataggtggcttgcttctgggaatcaaatttctttttttcaggctttttttttaaagataatgacaaattgtggcatttgctattttgaaacagaaagatttggggcattttatttgacaaaactatagtactattgtttcacaaatcaaaatgctatcacttcctttatttttataattactcctacttgatacaaaattcacaaaaatacagggcaatattttcctaatgctaaataaaaggattattttttaaattttatttattatttaagcttcaagactagtgataaggtcaatatcatagtatctgaggaagggatcatttttcaatttgcatggtatctaataggttctagtgcctaaattgcccattattaatttaagcagtaggtgagaatcagatttttggaaagcatttggacaaaatgtaatacgagaagttgagagtgataagcaaggtggaatacacttcatgcaaggaatggtgaacgacaccacttaggatggctactgcgagttaaaattttcttctgatactgcttaattccaccctgcaaggatgactattcttgatatagtcatggcaggaacactattagatcaaaaacttatggggtagaacatacaacagtatgatataaaaaacactgtcctgtgatcaagaatacaactttcttccctttgtcatctgctggtatcataagatggggctgggccttggcagattctgcccaagccatgccactgagtttctgcacggacagtggtggaacctagcagaaaggaagcctggagtgtgccccatacacagagtcctctccaggccttatgaggaaactctaaattattatcttgctttattttttctttggtttattcctctttgattcatcttgctttccagctatttacagcatcaaaaaccatgaatgatgaatgggtgtaaagaaatgatcaaatgctgaatcaggcatgaagtgaaataatgatgatggaccacatgatgttaacaggtgtccttctttctaagataaaaatagaagggaaggaaaatagacagaaatagagactaggatgacaatggctcattctaagcccatctggacttgaagaatccacaagagagagggggaaacactatgggtaattagatctgtttatcaatagccctttatgtgattatgattaggaccattctatcaacatagcaggtcttagactctgcccatcagggctttgtgagggtgataaagctgactgaggacactgaggcatggagaagttcagtaggtgggcgtgccaacgaggtaatctatggcacagtggggaccagaatgcaggtttcccaatagtcagccagcagcctccgttctaaacaatatcatcctctaatgatgtcattggaccatagtaagatggttggttacaaccaatgcgagattttttccaaagcatcttttgggtatagttccataggcacaattgtacctgtcaggccatgcctagggaaatacagctgccatgaagacagacagtgcataatgaatataattgtatcaaattgcacacacatatacacacacacacacacaaatatatataactctatactgagcactattttaattaatccacacaacatttacttctcatcacaaccctgtttgattgatttattgtagaaactgaggcacttcaaaatctcacagcaagtaagaagcagagctggattcaccctcccttcctcagtctggtggcatattctgtattcttaaccacaagggctaaactaagagtgtttttaaaatgcacaatgttttaaataatgtgaatctatttcattgagaaagcattcttgaattctaccctgcccctatctttttacatcctgaggtcttactctattaaaagctgcctgatcccataggcatctgcatgttttaaagtcctggctacatgcaggaatcaagaaggtacttgtgccttgtttgtatgattgtttaagtttaggtctcagggcatgtgtgaaagttcaggtatgagtcctgagccaaatatgagtgaccatggcctgtgacacagtcctcaggaggtcctgagaacatgcgcccaaggtggtcaaggtacagcttggttttatatattttatatattttagttagctcaggctaactcatgggagatggatgtccaggacattgttgttaatagagtgtccgccttccccactccagcttggaacacccccaccacaccttgctccagggaacccatagcagtaggtagtgggaaagataccctgatttagaatcctggacatctcttgccatctccttatactgcagagatacaactaagatatgtgctcaatcattcattttttattaactctgtgggtaattactagtcaaactgcacagtatcaggaactgtgaagataagaaaagaaatgcaggactaagtgctgtctaaaggagataaggaatgagagactaaaaaatctgccttcaactttttgaaaggcaatctagatagaggaagcagtcatgtttcccacatttctacagcaatctaactagaagggagactttgactaaattttaaaatgaatcttctaaaaattcagggattataacagtggaataaagtaccttgagtggtagtgaattctttgccattggaggtcctcaaataataatgcatgactatttgttggagaaaccataataactatcacaggagtagatgagaggaaaaaataataacctctgagtttcttcccaagtcttagattttgtgattctttattcccttcttgtgtagtcttacattaatatttctttctgttaaggcttcatttgcagactttgaaatgctgctttgaggaataaagaatcgatattcttacagcttgttcccagtatgtttgttctattaggccattgacctaattaccagagaatcatggggggtgagaattgcattataaagaactgggaatattttaatgtgactttgatacactgtcgtgaaaaaaaaatacctgtgaaaatactagtgggagttaaggtttattagaggttgcaaaaagatcagaaaaccacagggtttaaagggggaggttatttattatctgtgagagtttttatgataagattgattcaaacctccctgagaagaactgagagtcttctgttagtctagctgtcttaacctttgtgactgaagatagccttgggaatctggtggaaattataagagggccactcttacagggagcccattttgctttctccaaataaaatcaagtatccgcctccaggttgtgcacaatggctctaattttagcactctgggttaagaagtcagcaggtggagtaaggtggatgagttgcataaacactgcacacaattctcagcttgcaaatttatttaatatagttgaacgggccagaggaaagaagatcaacgtgattcaaagtcatggttataagtctctccctggcaggggtttgattttccagggttggaattcttctgtgccctttatcattattcttgaaatttctccaactagagaatcattctggttaaactgctgctatcttttcaaaggaaaacaggtacttcttcctaaacaaaaagaaattagtttaatttctggaatggaagaacagaggcagaaagagagacattttgaggtcacagagttgttaggaaagagaaggcagttttagttctataacctagggctgtggccacagacaacttctctgagtctggacggttggaggagaaagggtcttgaagacaggaaaagggtacagaaagggagatgagctcattctcaagatacacaggactttcacagaattttatttagtgatggctttgccttctccacagtagtggggatttctctttcaaatttgcaactcagaaaatattcatggggcacttaccatgtggcagatactagctcatgtactgaagagacaaagacagatagaaaggatccttccctggctttaagaaatctaactggccaggcgcggtggctcacacctgtaatcccagcactttgggaggccgaggctggcagatcacgaggtcaggagatcgagatcatcctggctaacacggtgaaaactcatctctacaaaaaattagccaggcatggtggcgggtgcctttagtcccagctactcgggaggctgaggcaggagaatgatgtgaacccgggaggtggagcttgcagtgagccgagatcacgccactgcactccaggctgggcgacagagcaagactccttcaaaaaaaaaaaaaaagaagtctagttatgggacagaaacatagttaaaaaaacgaatgtcatcgatgctaggtagaagtctgttctaggtagaatgagttaaagatgatcaattctctctgggagagaaggtcagaaaaggcttcctagagagggtgatgcttgagttggtcatgaaagataaattagtgttctccagcagacattatattttttcacgaaaataaagattatttttgattgttcctcattttctccattttattcacattgcagttgaaatctatatatgtgttatgatcaatttctgtttctattcttccatcatcttctttgttgatagaaatgcaaagtcaaatttagaatatgcactaactctagggctatccatctatggtgaaatcctttgggtacacaatccaaatatggttcccagatcaccttctggggaggctgtgcagctgccctccagcaccaaatggtttgtctgactttgcttcaggatttcctttttatcaatctttttttaagcatatgcattcaaaagatgcactgtctgcatttgtgattgcacacaccttggaaggaataatgatgaactgcgacattttatattttgagcacactaactcaagggaggcaagaataagaaggaagccagggagggagcattttcaaaacacaaaactcggcagtggctagccagggctgggttgaccttagaacatcccctgccattcctgctatcttatggaagcccttcaaagtgtaatgctgcctccacatagcccctccctgacaccagcatatgcttgatttcctcagagcagcaagaatcctgataaacagaaggggaaaagcaagccttggaaggattattttgacagcataactaagccctgaccacttcagtctctgggcttgtgtcaagtaacactttgctgattttgaatttaaaattcccagtagtcttttgctatctcccagactttgttttagttgtttcattccctacatttctgtgctttccaacaatctcttgtactttcatcatccatttcacagtaatgaggttatgagacactgtgacctctagagggcgataaagagtcctcctggtcactttctcctagggaaggtcaatggatgataagggcaggacagagggcacttccattatcacagggttagacttgggtggtaagggtgggcctgactggagaaacagtggcatgcttagtagcactggatctggttaatctttcttgtttctcttctctttgttgttgtttatgctttattttctgatatgctcctaagtcccaagaagattgctatgaactgagttgtgaaccacccccttcccaaaatccatgaccctcagtgtagctgtatttggagtaacagggtaattaggttaaatgaaattataagatcggagccctaatccgacaggattagtgtccttaaagcaggagacactagagaactctgtctcctgctctctctttgaatgccatgtgaggacactgagaaggcggccatccacaagccaggaaaagagccctcaacagggaccgagtcagccagcacttgtgtttgtatttcccagcctccagaagtttgagaaaataaattgtgttgtctgagtcactcactcagtctatgacattttattgtagccaactgagccaactttgcaactcattgacaaaggtcaaatgagatgatgcaagtaactatgctgtgtagattgtaaactataaaacacactttatttccttattggtaaaagtaataatatgaatgatctgcatcctggggttatcagagcatgaatgtgaaggctagaatttggggaatttggggttaaaaattaatactcctctttgtatgaaatactctttgtatgaaatactcttaaaaattaatactcctctttgtatgaaatactcctctttgtaatgaaaatgtgcagtgcgtagaggcagaacacttgggcctggaagggacattaccctgaagaaggagaaagataaggtacagggtgtcctcttgaaaaccggctgtctctagtcacaggaaacagattttaatatacacaagcatgaaaacgaaaccttttaagaatgactttctcaattgccccctgacacagaccttcagggaacttccctgatgtctctaaaatagagaggggtgtgtgtgtgtgtatatagagagagagctataataactaagaaacagagttatgtgtagaactaactaacaaagacttctgctcactgcagtgctagtccttgcacaatacacctggggcaacatagtcaaacacaaggaaactccccacctcaaccccaacaactttggctgtggagctagctgggcagcatgtgccagcatcaaagaaaatcaaaatagagacaatagcagcttctaagtcagtcctctaagaccctcagaaaagagctagtatggaaataaagccaacaaatatgtcaaaatacaatcaactctacaaacatctgtttaatacctactgtctcagtttgccagggctgccaaaacaaaataccacagactgaatgacataaacaacaacaatttattttctaacagttctagagactggaagtccaagttcaaggtactggcagtgttggcgtctgttgaggaccctgcctttgtgttggccacctttccctgtgtgctcacatgatctttcctcgtgaatgaggagaaagggagagagagacagaggggctttgctggtgtctcttcttataaggacactaatcctataggatgagaggcccaccctaataacttcatttaccctgaattactttgttagaggcctcctttccgaatacagccacactagagttagtcttcaacatatgaatcttgtggagacacaaacatttattctataatacctgccatgtgctagatgctgttccatgtgctcatggtagaaaaataagtatggtgtagttggcttcagaaagattcttggggttaagattaatatacaattcatctttgtaacgtcagtgtgaggcagagtaacttagcacatagttcacctctgattattcttggatttaattaatgtattttgaatctagtaggaggagaagttacatatacagtgagaggggaaatgccctatagaatccataagatgttataggatgacagtggggccatattggggaaagggggtagctcttcctggtgcatttcaaaagtcttctagtataaataggcatgaatatacattgcattaattgagttcttaatcatattctttttgagattctgtcctgccacctgtgatgtatgtgtgggaggcagggttgcttggggagtgggtctctgtagagctggcattctgtggctctacgttctcacagcctctgggtcttctcactttgtactttcccagtttaaacgactcttcagaaattttccaataattgagcaactgctggttttttcagcaatgctggttgcttacagctgtactgtgagaatcagaataattattatttgcccttatgatgcttcattgtttatagaaagaaaaaaggagtgcacaaagtgccttggttcttcatctgtaaatgtgggataatcttgttggtcaagggtctcacagccgtgtggtggggcattaatgagatcctgtctgtaaagggcttggagaaactcacttgaaagatgtggcataaatacaaagaagggttattacaaaacagaccaaagaacaggctagttactgaactacctttattttactttttttttttttttaagccagggataaagaaaatgggagattgaatgtttagcttttggactggaactctaattagaggtttaaggattaagaaaatagttggagtcagtgtgaagaagcttttctcagagaaaagacatgtttttattcttcttagagcacttgacctgtaaatacttacatcttgagatgtgaaacaaattcaatgaaaggcctgagctcagggcttattcggttctctgtgcagttaattaccttttgtccagcaaggaggccttgaattatcattatttctcctaattcaaagtcattgaagatatgtctccactgtaataagtagtttgacctctcgatgttaagaaataaggactctgactgtcggatgccctgttctaaatctgcagtggaaagatgggtcgggggatagtttccagccttaagaatccagttcaaattcctaacaccagccatatgccactgtctttgatctttcagctagaaaatatttcctagcagctaatacctatcaagtgctgagtatgtgccaaggcatagttttcgtagtttgcaaacattaattcatctcattctcacacaatgactatggagtcggtactagtatttccctattttacagacaaggaaattttggcctagaaaggttaaatgacttgtccaagaagacacagcaagggatcagtggggctggaaatcaaagcccattatatttactttttaacttataaactcttctgctttgttctctgacgtttcatggtactgtgtgtacttctctcaaggaacctgccatgtttttctggatgcttgctcaagcccccatccaggttgtattcttgtctaggaatgccacatttacttcctgtgcaccccaccaccacgtcttgcttgtagatcttcattcaagagaggggccaggcagaaataatggggtaatatatcaggagtgctaaaacaccactggaagatttagaaacacaatgccagtgaaggaacttgccacagatctcctgatatttagcaatttgtactttgatgcacaaggaagcacacaggactaacaagtcaagaaaaaaataccatgcctttattggtgtcagtttctgtaatgcaagtttcaggatgcagcaagagcctccagctccgatacccaccagccaaatcccacagccactgtcaactgaaatgctgtagtggaatagcacacaggggagtgctactttcttggaacaagtgattttaaagtattaatagggctccccaggattttttattttttggtcagaaaaattacatgtgataaatgtatgttctcatttaaacatgaagaatgaatgtgcagatttattatctctcccttcttaaactccttcaaaatgacataaagcaggccaggcacggtggctcatgcttgtaatctcagtacttcaggaggccgaggtcaggagttcgagaccagcctggccaacatggtgaaactccgtctctactaaaaatacaagaatttgtcgggcgtgatggtgcatgcctgtagtcccagctactcagaaggctgaggcagagtaatggcttgaacctgggaggcagacgttgcagcgagccaagattgcaccagggcactccagcctgggtgacagagagagacttggtccaaaaaaaaaaaaaaagacaaagcaatcaaataactttttattttattttagaagtaggaaactgaaaagacaaagacaacagaagggaatttagtatgagtgaaaaatatgaactcactgtgggaaattggagagcagataaaggaggaaggctgcctctgccccaatgtttgctgaacagttttcctgttcaggctaatatgcaagttctttttcacttccatcccaggcttattctttagcatatagaagttgaaccaaagattgtccaaagctgaaggcaaggtgaagatactgggctaaatacggaaataaaggactgtctgcacactgggctatgggatccctagccttattttgtggccctgttcccagagctcttatggtaagactttttttttttctctatactggagataagagtccttgaccatggaagaactgaacagccccatgaaaaacatgtgtgataactggaattatagaaatgtcccctcattgaaaaaaatactttacccatatgatcaccagacagtaaagcccatctactggcctgcgtagctccttcacttgggaacttcagtccaatttgtagtgcctcagtcataagtgtgaacaaataaccaaggctactcagtactttcaccagccttccaagacaaaagatgacaatgaaagcatacaaataaaggtaatggagaaacagaggtgatgcaagagacacaagaaacatcaacaacataatatcttcagctagataggataatatataaacccataaaacaataatatggtatttatttatttatttatttatttatttatttatttatttattaagaaacggagtctctctctcgcccaggctgcagtgcagtgccatgatcatagctcactgcagcctcaaactcctggactcaagggatcctcctgcttcagcctcctgcgtgtctgggaatatagctgcaagccactctgcccggctgggaacatgatctttaaaaaaaaacctggcaaacaatgagaaataacttttggaaatgtgatagagaaatttgttaaaaaatctagaaagatgggagataaaatctgagaaatctcctagcaagttgaataaaaattaaaaaagtgggcaatcaaaaacaaagaagaaaatcagagggtcaaaatgtaatgtccaatatctaatagtatttacagaaagagagaataaatgtggaggaggtgttagcaaagatataattgaaaatattttatagaataaaactgatgtaaaagtttgttctcttacccagcacagtgcatagaaaacggcacacacaaaggcaaaggcaaaatcctaaatctcctaaagatagatgaatcaggagtcagacagatatggaacttctgaagaaaaacactggccatttgcagatagtggaaaaacaccacagttctaagcggaaatggtttgcgaactggaatcctatgtttagtcaaattatcagtcatgtgtaatgtcgttattgaagacttcctaaatatctttcctgggactctacttgatatgcatgcattcattatctgatattgcataaaaactaccaccaaacttagcaccttaacgcaacacacatttatcaccttatatagttctgggagaggtcaggaatctcagcctggtttaactggatgattccagctcttggtgtctccgaggtcaaactgttgtcctgggcaaagagcttgataatctgcttccaagctccctcgtgtggctgttgacaggagatttcaggttcttgacaggctggttttttaatagcgctgcttaaacagcatgtcatctggcttccccagatacagtggagggcagggggaaagggtatagagggaggacacaggaggacagttaaaacagaaattaaagtcttttagaaccttaactggagaagggatgcctagtccaacctgggagagaattacacaagggtgtgaataccaggaggcagggattattggatgccatcatgaagattgcctgtcacaacgtggttcacccaattaaagaagtatataaaaaagaaagacatgagatccaggaaacagagaacccaccacagaacaggccaggtatttcgggatagcagctatgcagaaggcacagagaaaaaccagtctgggtcaatggttctcagctgggcatgctattgccctcccagatcctctgggagggtgcatttaacaatacacagagacatttttcattgtcaagatgggactgctacaggtatgcagtgagtgggagtgagggatgcggcaaaacatctgtaaaaccaggatagccccccgatgaagaattatttggtccagaatgttaagaattttaaagttgaggaaaccaaatctataggcgtagaatgagatacaagaaaacaggccatttggaaggaggatcctagaaaagtctgcaagtaacaaataccagctttatcacttgcatgcatatatcagacaaacaataaggactttgaaaaccaacctcaccaaaatggtgatagacctatacagaaagcatgacagggaatcttatgtgactgggtctcagaaagacagctccttatttacaaatgtgggtgggcaaaagattatatctaaaatggataaatcaagaaataacaacatatttagtaaaatagagttaaaaataagaagagtaatggaactaaaataactgcatgtgaggaggaaggcgagagggtggggcaacagctgctttcttatgttcagttattctatactatttgactttataaatgtattacttcgataaaaaattgaatgcttcaaataaatctattgttagattataaagaaagttgtttacagttttgttaaaagaaaattagtttttttccctaccaataaatatgtataaatatctaaaggatattggctgaagacacataagatgactatgtggacagtggcacacatgcccctttttgatgttttcagttaatgtagttattcaatgagtgaatgaaggaatgaatgaacaatgcatgatgaaataattaaattgaaaacaggtcaggcgcggtggctcatgcctgtaatcccatcactttaggaggcggggggggtggatcacctgaaatcaggagttcgagaccagcctggccaacatggaaaaaccccatctgtactaaaaatacaaaaagttagctgggcgtggtgtcaggcacctgtaatcccagctactcaggaggctgaggcaggagaatcgcttgaacccgggaggcagaggttgcagagagtcaaaattgtgccaccgcactccagcctgggcaaaaagaccaaacctccatctcaaaaaatatatatatatatattttttataatatatataaaatttatatttatatattatataatatataatttatatttatatattatataatatataatttatatttatatattatataatatataatttatatttatatattatataatatataatttatatttatatattatataatatataatttatatttatatattatataatatataaataatatatgtatttataatacataagtatatataaaacaaatgattctaccctttttttaatggtaaagcacattttatttaaatagttcatgctaaggctagtaagaagctcctcattgccagatctggttcaggccttaatctccatgagctacctagagcacacatatggaaaccaaaaataaaatttgaagtcccccaaccccccagtgatcagagtggaatccctcctttatggcagagcactccaaagttaacttcaagaactggtttaggccatgacaggaaaggggcggttggacatactgcattataccctccccacttttggaattcaggaaaagtcaactagcatttgacatcaacccagaccttaaatctcataagaaatatttgcaatctattctctctaaatccagccacctggaggcttcatctgcatgataaagctttggtttccacaacgtcttatcataactcagacattcctttctattgatattaactctttcaaacagtctgaaaaattgtagatctacctataacctggaagccccatctttgagttgtcttgcctttctggaccaaaccaatggttatcttaaatgtatatgattgatgtcccatatctccctaaaatgtataaaaccaagttgcaccccaatcaccttgggcccatgttctcagggtctcctgagggctgtgctgtgtcgtgatctatgatcactcatatttcactcagaataaatctcttcaaatattttacagagtttgacttttcattgacacatgcccttacaagagcattggagctttcttggccacttctcagtcttctggatgaacaccttgtcctgagcctaccctttaaatgttgactttttgtgtcagctctgggttttttttgctttttttgtttttgtttttgtttttttgtgatggagtcttgctctgtcgcccaggctggagtgcagtggtgtgatctcggctcactgcaagctccacctcctgggttcacgccattttcctgcctcagcctcccgagtagctgggactataggtgcccgccaccatgtccggttaatttttttgtatttttagtagagacagggtttcaccattttagccaggatggtctcgatctcctgacctcgtgatccacccaccttggcctcccaaaatgctgggattacaggcatgagccaccgtgcctggcctgttttttttttctttttttttctttttttgaagaaaagatataccctcactgagctaactcatccattcccatttccaaaacttcagctggttactgtatcctgatgaacccaaatctatatgcctagcttgggtagatctatttggccttaaaagaattgtctcaattacttacaggggcaactttacttggttgtcccctaggcctctaaaactcaacacttcacaaaatgaactcaagctctacctcaacacctccccaccactccaactcctcagctagatctgcttctgcttgattttttcttttttcagggaaatgttctacattcaccaaaatgtccatgtcagaaacaagcatcactcttcttttcctctttctcacccctctggagtccatcaaacaccacactttactgaatatacttatattgcatgtggcatagctgcttccacagtctctttaaatctattcaattctttatacaaagatagctttggctatctttgttctggccaccctaatcttggaattagattactgccacggagttcaaattcttctcccaacctctaggcctgtacccttttaattcattctccattctgaccagggtgatcttttaaaaattcaaatatattcatgtcacttattttttgatagcttcccattgcctgcaggttcacctctaaactctcctcaatcccaggctcttgttattctctgaagtttccttttttttttatgattcttacaccccactatactctctgtctatattaagttgtgctcagatgattggatgcatcatgttctgtccttcctctaggtctttgcacattttcttacctttgctcgaatcctctttttttttttttcctgcctccattccctccttgctggaaattctaatttctccaagttttggttccatgtcactttctctgggaagctttcctggtcccctcccaaagactgcattaagagcccttcaactgagctttctgtatcagtctattacagaaattgtcacaagcactgttcacttgtatccactgctatgatctgaattccaggactcagcactcctggcctagcacaatgtgggggcccagtgtctacaggcgataaatactccaccattgtggacaacttttcttagtgaaattgcttaagagcttcttttaaaaatagggcatttttttttcaagcaaaagatccttttttacaagcatatactaatggttcatcttcaaaagagttcactggcatatctttgttgtgcactaaagcacagtgaagaaagaaaaagaagaaattaaattggctaacaaccttgcttaaaagcacagaaataaaatgagagtaaaacttaaaaaagttgcagataataaaaatggattgcactcttcttcttatttctaattttgatagatatttttcttctcaaagggtctgagagaaaaatatcttaaaagggaggcaatttaaaacaggcaaaatattgcattaaaacaaagagaggggaaaaacgtgatcaagtcatcagctccgtaatgctaatactgttggttttcaggtgtttgaattgcccaccttaggtggggcctctaaaaagacaaatgagattagagatgaagtgcctgctagtctaaatgaaagcacaacaatgaaaatcaaagaaacagcacacttaattcccctctgacgttcctgatttccagctctccgtagcaataactaagtaagcctgggtgtccagcaacataggccatcgacatttgtcagaattttcaataaactggcaatgaaagactaaatccatgcaaggtgggagatgaattagcacatagccaaaggtactggaggaataagcactggtttcatagctgaaatattttttgataaagtaataatcctcggtaatctctctccagctttaaataacagccagtctttgtgccggcagtttaattttgttggctgcccttgtcttacaaatatatttagtggagtctggaatatcattttgtgctgaaagctgaaggctttgtcatgctgaagccaggcagaggcaataaatcaaggacaaagtgaaaaggaatagaaatgggctatcggaaacttatttccccagagcggccgagctttcgtctcatgctagcaggtgtattgcatcagtcatgtcttcctgttaagtgcctatgttgtaatgatattgacttacaactacattgcaccctggttggcattgctccgaagtgcttaagatgcatctatgggaaatacatgctgaaaatagcgtcatgaaaatatacaactccagttttcttttctttcttttttttttcttttcctcctctaagatcattcttcccaggaaatgggatttaggtaacttccccaagtcacaccatttgtacatggaaaggtgtataactgaataattttatcctccagtaagaactgtgctgggacacgatattcaacttcagcttcttccactaatttcctcatttgtgtctaatcaattaataaatgacgttttaaaggtaagggaccactataaacttaaaatgatgaaaccaggactaatgttcttcaagatctgtgtttgccaaattggtcattactgagaatggattgtggagaaagaatatttaagtgtttataggggtctgtgtcttaccgttagcaatataaatgaataaaaatcactatactaggaagccggggagctgggttcttgtattagttttctattgttgagtaatacttctacaaatgtgctggattagaagagcaaacgtttcttatctcacagttcccttgggtcaagagtccaatcaccatttgtctgtgtgctctattcaggggctcacaggctacaatcaaggtatcagctgggatgtggtctcatcagaggctcccctgggaaaagttctgtttccaagctccattaggttgttggaagaactcagtttcttgtagttttggttcctattttctttctgggctgccatccagtctctgttcccacctcccaaaggccacgaaagttccttgtggcactccctattggccttgcagcttactttttttttttttttttttttgagacagagtctcgcttttgttgcccaggctggagtgcaatggcacaacctcagctcactgcaacctccatctctggggttcaagtgattcttctgcctcagcctgctgagtagctgggattacaggtgcccactgccacacctggctaatttttgtatttttaatagagaagaggtttcaccatgttggtcaggctggtcttgaactcctgacctcaggtgatccacccgcctcagcctcccaaagtgccaggattacaagcatgagccaccgtgcatggctgcagcttgcttttttaagccagcaaaagaaagcaaatatatgtatgtatggatgagtcttttaatgtaattacagagaggatattctatcacttttgcaatgtaatgtaacctaatcatgcgaatgatatcacatcatcgttgccatattctatgtgtttaaagcaagtcacaagtctcaactacactcagaagttggggttctatgtggggtgtaaacatgagggccaccctagggtgtttctcccacataagtagtccttattattattaaaaactagatactcatatatttgctgtaagcagcaagaatgaatgacttatattaacactaaacaaaattgataaatctcacaaagttaatgttgaaaaaaacagacttaagaaaggcacattctctatacattcattttatataaatttttaaaacatgctaaattaatctgtgctcttagaataatgttaactttggaggtagggagaatgagggaatgcaaggggatttatacggtgatagaatgttctgtctcctaaagtagatgcattccatttgtaaaagcatatggagcatggagtattatatttatttgcacttttatagacataagtacaattattccttatacttcaaaaaaaaagtaaaacaacacaacacacaaaaaaaaacaaaagccctgagttaacttagaatagatgcttaatttctctggctctcagttttctaatctataccatgaggttggtcttgatgatgtttaagtctattctaacagattatagctagagttgtataaagtcttgagaggctataaaactcattggatgattctgaagagctcaggagtcatcgtgtcccagcacagttcttactggaggataaaattattcagttacacgtctttccatgtacaaatagtgtgacttgaggaagttacctaacccccaatgcacttttgttttcttgaggccttattcagctcaaaacatatctatactctactaatttggcaacaccttctgactaggcacctatgttataaccagggtggagagcaggcagtggtgggtgaatctggcctgggggtaaataaaaaggaggtgcattgcagataattttaaaacaataataaaactgagtgcaaatgggccggtcttgtgttaccaccatgtaactgcctttctagacaacgttagccaccgacacattctcacacactgcagcggacagttccaccactgccccgtgttttcacttggcaattgtgctaaactcatataaagcactggctgcagatatagctaagatgtgacactctatgctgggatatatgacatggaagctgagggatatgtgcacacccacctaacagtgcgttcacaccaagaccctcttcaaagagaggtctggatattcagaaacatactatattttagcctcacttgtccctcagcttcctcctccaagccccactgagcaaccatgatccctggaagtattaggtaactggctcccagaattgcttgcttgaggccaagagttcaagaccagcctgggaaacaaagagagacccccgcctttacaaaaataaaaataaaataagcttggcatggtgacatgtgactgtaggttgtcccagctacttgggaggcagaggtgagaggatgacttgagcccaaggggggtttgcatggctacagtgaggtacaattgcactactgcactccattctggacaacagtatgagaacctgtctcttaaaaaaaatacatctccaatttagtacctcttgattatcccttcacttatagcttcaagacaaattctgaatccaagcactgctgaccacctcacccctgcaggctgccatctcctcccccactttccactccatccgctcctgtagccacaagcctcttcccaggccccctgccctctcctctggactgcagtagtctcttctccatagggcacccagagctatccattcacagcatgagagaccaactgcatttctcctctcaaacctggatctagcaggcagtacacaatctggcccttaaagttgatcccagacttttttcacctactgtcataggcctggctcatcgaccttctcattatttctaggatgtgcccagcaggccactgttttgggttttacactaactttctctatgtgcaaacccatttagctcagtttcatgtagatcccttgtctgggccctacatgtcaccttgtctggcagtctttccctgaccacaggctgccatttgaggaacccaaggagtggggcttatagagaccatgccatctccaaatcagccccaaccttcactctctgccttctacttggcttggtgtttcttcatcagcttgttatctggaattatattcttaatttatttgtttgttgcctgtcatccaaaccttaatgtaagctttggagggcacagatgttgtcctttgtagctaggatggagtttagcacagagtagatattcactacagtattcagttgactgaatgattgaaagtctggtttagcttttacattagtcatattgaattttcactaccacttaggactcctatttctgtttggtaaaatttttccagcaaataacatggcagtatgggtcggtttgaccccatgacctgagctttgttgggaattttaatcatctgtcatcataatttcatcaaaattttcttataaaaaatgagtaaacaactggtgatgctgttaatggagcacctacatgaaagcaacgttcaggccactgtgaaattaacattatcttcaaataatagttggtcagtggagcctgctgggctgagatgtgtttgaatgatttcatcctttagcttcagggctgaaattaagaaccaggttagaccactcaaagttaaaggaaagaaacaagagcagaagggaaaggaggtccaggaagccagaacaccaaaaactgtaagaaaaaacagacattgagaaatagagagtctgggacaaaagaataaaagcagagaaaatatccaggcctcgatgccatatgtccctcaggctttcccatcagctgctcagttactgtgtgtctctttcttaaagtttcttcccttggaccccatgctttctccatgtaggctctgccttacttcctgttgcagcattttagcctggttggtgaaattgcatatcaacttaaggctctagagccacacagctatttgatttgcagaacaacatgtaagggagaagattctctcccttgcagaaatgggccagacctggacaaacaaatagaacttccatgagtgtgcattgttttttctttccttactctggtcttactacacacccagagtcaagctgttatctattgtaagttatattaagcctttagtctgtttttttgtttgccgggaaggtagatgtgatgtcaaacatttgaggcattttgaaagtctcagaatattaggagattttatcatcataataattggggattgaatccatttacagtaaatgtcccagtactactggcccattctatcacacattgagagaatgatggttttccactccataatgatatctaaaccacaatttgatctgtgacccagaagaagggacctgctctccctcaccagttgcttcctaatccctctcctcaggtgaggtggaaaggaaggggaaaaaaaaaacaataaaaatgcagcgaatttaggagaaatagaagaaggaaatgacacaaaggaaaggggggggagaaagaaagcaaaagagaagcaaacattaaataggtacaatccaaaaatcctatcagtggagttcttgtatcagtggagttcttgagttgatgggcttctagtttcaattatttgtaatcttctcttaaatatggtagtccctcatatttattcaacaagtcattatgcgcattatctctttggatctgtataccatgcctgtattaatctgatttgctgtcatagctgacaaatcccaaatctcagtagcttgtaataatattatatgccacttactttcacattatatctcactggctgtgggttagcttctgtgattttgttccatgcagtttttcattcaaagcccccggttgaagcaataactctatttaggattttctatttctcaagatagaagaaaagagtgaacaaacttgtggaaatatgcagtggttctcacagtttgtgctcacaggctctttgtcaaaggaagttggagggttattcccaacatcgccaggcaggaaaccatgcagttcccacaaggtatggccggtctcatggccataagccagggtgtgtaattaccttttataggaaaagtaaatatgtatctgggaacaataatacaacctacattaataccagagtaagttaataaggcttgtgggcccactccacttaccgataagaaaagagagggacagaaaactaaggagaaaaagagcctgacctagatctcaggttatgtaatttccagataattgatatggcctttctatccactttctttccctcccctacttgcattttcttttacactaaggtagcactgctcaaacggcagcaggcaccagaatcacctgaaagactccttgaaacacagatgactggaactcactttcagaatttctgatttgttatgtctggcatagggctttttaaaaaagttttctttttaagcaagttcctagctagtgttgaggatgttgatcctgggaccacactttgaaaaccaccgctttaaggtccatctccagagtagagtgcaatgtacaactgttccaattacctattttttttagcctttttgtagaataagtgaacagcgacttcagtgaattggttctgtaactttaacagctccactcgatcttaggagaggctatagcagccccacagtagtagctctccaagtgtgatccctggacctacagtaccagcattgcctgggtatgtgttggaaatgcacatcattgactctgctccagaactactgactcccaatttctggggatggggcaaagccctctgtgttttacgcagtcctccagatgattctgatgtatgctcaattttgagaaatgtggtttggtcctacagctagactgcaacaccatggtgaggtcttcaggacttgtttgctacatgcctgctgcttgctagaaatgaaagctctcaggtcccatcctatatttactgactgatcttcatgttgtggggtttcttcttgcagagcccctagtctctgccacattacccagccatttagtccatttattacaactgactgtctgcttgactttcagttataattttacccctgaatgatccttggttctgtgctctgtagcctcaggacttatattcctgctcatttccctggccaatattagaaccttactccaggtgtagcttatcagccctcttggaagggggttggtgtgaggatgcttagacagggttgatgtgagagcctctatttctcatgatttgtatttttccattaaaattcttcaccttccttcattacaaccttgtcttaactcttgccctcattctttgagactagctttatggacaattttaaccagtgtattaaaaacataattacagtcatactattgtgtatttatgaaacacaaatcatctaatcagctgattgcctttgcatgagttgttcatgagaaaacatgatgcaattaccagtccccttccaacgagatgtactattgccattttaaaaaagcatttctacatccagaagtcatttagtcttttctttaaataaagtaaaaaaacaaggctgcagacaatgaaatgagagaaacagatcgacatctctaatgattctaggcaaactctgagtcatttcacttcagatctgtgatgtttatacagcaaatgcagatgttatgtttactcactgcagagcatttcctgaaagtcttggcttgcatggaaaactttcatggggtattcttttagacagtgtatgtcttgctagctgagaaaaattttaaagaaaaaaaacttgacctcagaggatattgacgtagaggtatctgaggttaaaatgtcagaaggaagacctttgggaacatgtgaatatttcccgagtcccaactctaccaatgtgtgaccatcatcactgaaatttggtcatatggaggtgcataaggcatgtttcttgtcttcaacgagctcatagtcttgcaaaatacaaacaacacagagaaaaaatgaaatgttttatcataaatgctgtgattagtgcaaccaataatttatcaccaaagcaggcattcacacaacaggtatactttgtagctgttcctggcacaccgcttatatggtcactctagttacagttgataagtgcagatatgaagtaggcttagaacggacatttccttgtgggatgattctgggaaagctacctaagacaccagatctagtgcttattgaactaatatttcattgtcctgttgatctttagagccattcactatatatttacaaactatcgtgttggatgtcgagatctctttctaaagccaaaccattatcaaatgctttgtctccttttcttaccattcacacatttcacctttcaaagaccgtcaccacaccagctccatgccctactggttacgtacagaaagagtaacagactaaggttgacaagcatctgtttaaccttgattttattgcaaaccagccatgacacattctactaatcagtaaacatctacaaacatgagaaggacatcatcagtgtccctgctcacattgttctttggtgcccttatcacactaaagagttgtacaggcagacctatggatgagtcaccactctgacacctcaccagttaggtgaccttagagaagtccctgaacacttctgaaccacaggatgcccatttgtaatagccacagaaccatggagggcattgtatagactgagcacagtatatgtgaaatgccaagcaagtttctgctgccaagtaggtatctggtgcatggtgatgagttgctgtcattattctcactgatgcagttgctaactgcaacatagggctggccatgagtgacagttctgattttttttttctttttttttttttgagacggagttttactcttgtttcccaggctgaagtgcaatggcgggatctcggctcacttcagcctctgcctcctggttcaagcgattctccttcctcagcctcccaagtagctgggattacagatgcataccaccatgccaggctaatttttgtatttttagtagagatgggttttcgtcatgttggccaggctggtcttgaactcttgaccttaggtgatctgccctcctcggcttcccaaaattctgggattacaggcatgagctaccatgcctggcccttatgttcttttagatgagtgaccatgctctttcccaaagccatctggggagtcatcctccctttttaccatcttcgcatgttattttcaattttcatactaacatgtcagaaccagtttgctgcttattcctctgctgtactttcaaacagaaaatagcatgttgttggcaggttctgactgtttgattaaaagaaataaacaaaaatctgtgatgaaacagttcactatgatgtttaatccatcgtgtccatggaaaggggttcattagccagaatctcactctgaaggatgcccaaagctaagagatcaggggaggcttcactcagtaatggcatctggtgaaggttagcatgaaaaaaaatccatggtttgtcaattacttaagtaatatcttgtcccagcatggtgatgctcatggcaactcccattgattggttttgactgctcttggaataatactggagccactttgctcccagctggaagcagagcacgatcagtagtgtctgcctggggtagtaaaacaagaaacagaaggcttctcttaatgtcctaccagtcctaatctgtaaactaattgcaggactaattcctacaggactgtcacacaagcaaagattttatgccttatttattaatttatacacgttccaatccatcttgtactcctggatttagcatactcttacaagctttcagaaatgaaacaaagattagttgacattcatattcttttcagtccacccttttattcctcctaaaaacggtagacttctattcatattacaaatatttcaactacttacatattcttaactattgtaaaaataagagaatggtcaatgaagaggacaatagaaaaacctgataattattagataaattgagataactattttaactatatatactgagagtgtttggtaaatataccgcattctgctatggtctatctacactctattttcttgtatacaaggcatagtgtatgtatgcctcttacctttaataaggataacaaatttactttcttaaagtaattgaagaacagtaatttacctgtttccaatagtatttattttttagatttttatcatctccaatgaatacttgcttgtgcccagggataagtgtgataacacaggggatgtttctatgtaattatttatctcaaagtcccatttaaactgactctccctcaagaaggtcccttacaataacaagacaaagctatgaacagcaccttagacagttgaccttaactatagaacacctcttatactgtgggtggagtgagagtgagtccctcacaaggcaggaagcagaatcttcagggtgagaaatgaatgcatcctaatggcactttcctgcttggataggaactcattcttaatcagaacagcttttgaaatgggaaacacttgtgggaggggaggattatactttagggcctggaaggggctgctgatcaaaagtctctttttattctggaatctggggagaaggcagaaatcatatactttatttttgtggaagacctgctgctgtactacaccaagcattcttgggatcggggcatgacgatgatcccatccaggatatccaggaacccctgaattacatcccatgctttgtatctgttggaatttcctatgaacagcacccatagcttgtattagaagctcacaagtgtctgtaactgtagaagattaagaaggctcaggagttattgtaactcattttggcttacttaataaaagtaaattatagagactgaaatatttctactggatatgcttgcattttagtatgctctgttttttatataacaaacataattgcataatgaaattaatatattagcctcaagtagtttttaaaaaaaaaactgaatcatttggatcttgagatcttactgagttattactacattaattattaaatatcaaaagaagtaccttagtttaagaaactttataaccatatttctaccatatttgaaacctttccaaagtatttgtcttgctgttttaattctaatttcctgggttccttgtgaaggtgaaagtctttggtaagtttcacagcctttcttagtgtcagattgggcccatagaggttcaaattttgattgagtaggcttaccattgggagagtgggatgttaagaaaactcagggatgagtgggaggtaaagagagaaggtggggaattagatgaagtgtggagcttccaggccagattcccagcccctccctggcccctgatcactttattctgggatgaagcccagaataagtttccctcttctcccctgtcttttgctccagggctacacagggtttgcaaagtgtggtctctggaccaacagaaggagcttcacttgtggactcattagaaatgcaaattctgatgctcccctccaacccctaccctctcacatctgcaaaactggaagctatggggtagggcccacctttcagtattttaacaaaccctctaggtgatcctcctatttgaaaatctgctattatagccagacactatttctgaaacacccctgagatagcgctcacctgagcagcaggtaaatgtgtaccttcccagacctcttcctgaagatcctgtttgattgcatctgtgatgagccccagaaaggctggttgtcaataagtaagtatctacgaaaatttttttcttttctttcttttttttcttgagacagggtcttgttctgccacccaggctggagaataccagtgcaatcagagcttactgcagctttaacctcccaagcccaagcgatccttccatttcagtctcttgagtcgctagggccacaggcctgcaacaccacacccacctaatattttttattatttccttagagacaggatctccctgtgttgctcaggctggtctcaaactcctgggttcaagtgatcatcttgtctcggcctcccaaagtactgagattatagatatgagccaccgcacctggcctacaaagattcttcccgctagaaaacattggcattaccaagcaagcttccccaccacatcctgtggcacactgtgtgctggtggcgagtcacaggggttttcaggatggattcccctcaaatctcactgaccaggtgggtctgggtcagttaaagtccttgtactggtcctctctgagcagccaagtcagtgcactccagtgtctctgcagatgtgatgaaaaaagtcatgagatcttctaaatctgatgttttgtcctccagcataacccacgtgaactgagacatccttcttctgtcatgttccttgatgagacttaacccacatgacagacagcagcgcctccatcttgaaccctggtgtcacagtatctgaggttagaggaaggaagtgaagacgaacatagtccacttacatatttttttgatttgtaaataaaatactactagttcagtgtttgtttcgtataatacattttccttttttatcgtaattaccaactaaatatgatgtagcttttcataagtagctctatgttaggctcataaacattaatgcttattgtatgccataatagagtaatacttaaggcaggtgagttcttttgtctgtgttctgtagtttctgtgttttcttcccccacttcccttgttgtctgttttcttggaccaaggctcttcgtatcctagaaactcttcaacttgctgcctctgatttttcctgttctgggtaaactggtagagtaaattgtttccaattcagctccaagctgctcttcctttgagttgctcccacttgcacccagtgtgccatggacagggatgtcagccttgagtgacaggaaaaatgttgtagtttgacagctgagtccactactgctgtaatcttgcaagaactatttaatctctcaaagactttttcaaaggttgtaaagtttgataataatgtctacttgttatttaaaaaatatggtattggccagacgcgttggctcacacctctaatctcagcactttgcgaggccgagacgggcggatcacgaggtcaggagatcaagaccatcctggttaacatggtgaaatctcatctctactaaatataagaaaaattagcctggcttggtggcaggcacctgtagtcccagttacttgggaggctgaggcaggagaatggcgtgaacctaggaggtggagcttgcagcaagctgagatcgtgccactgcactccagcctgggtgacagagtgagactccatctcaaaaaacaaaaaacaaaaataaaaatacataagttattaaggatgaatgcacagaataactaaaaccatgctttgccatatcgtaggttttcaaaatatttgaattcccttctcttcttagtcctatctaagctgtgtttgaatagttggattagcctgagaaatggcttctctataagtataaggcaaatatttgcttaacaaatgtttaccaaggacctactatatgccttgcagaccaatgcaagtgttggcaaaaaaaaaaaaaaaaaaaaaaaaaaaaaaaaaaaaatcaatcacttaaatcattaaagtaagttttgttcaaaagtcttactgaagactatagaatgaggactatagccccagagtggtccttcagagaagctgtcagacttctctgacacagtgtttcagcccacagcttacatatgggggtgggggttcagtaaatgcaaaatcacatcaaaattgctcacaagtgacatcaaaccagaatcacaccaaggttttggtgtaagagtacctctggtcatagattacaaaggcacaatcattaaccctatcagatgtcatcttatgtgcaagaaaaggcaagggctagggtcattcatactttaaggaatatagtgactcgggcaagagatgtggggggccatgtgccctatcctgttttgtcttcaaagtgtctggagagctatacatcattccagagtcaggggcttgtgaaattatgctggcaagctgaaaagggccaaaagggcttcttccctttgccattttgtctcacaagatcccccctttgatcataaatcaactgtctggttgcatttacagaaccagtatggattgttccacatagctaggaagactctttccttaggaaggtcggtgatcttcatttgtatttgtaaggaattgggcagcatgcttactttcctatttgttggaaagcatattttgaatatcttctattttttaactagcataatctgattttctttcctgacatttccctgcacctaacataacatctcaacaggactatacaaggatactagagattatacatagtggtatatacataatagcatcactatcagttacaaattagaaattaaaaaaaaaaattgataatcatgcaacaaaattggaacatgcatttgcatattttttcattaattgtactatgttttttcctttttagtatccatatttattattatttatgaaaaaatttgacctagagcttattataaatgtttttagagaatacttcaaaataatactgtggatgatgaaaactttgaatagccatgattaaaatatgatgaaagttcccagttgacaagaacatctagttatttctattatatgcagtatactaagataattagaatcatgactgacagtgccacatcagaaaaatcaaacttttataaagtttatgtagtctttagaatactcacattaataacatttataaaaatataattttagaaaagatttaacataatcaaaattatagctgataccatattagatttctatgaatttatatattttatgtgatttatagcaataacatacccataaatataatggaaagaggatctagattatttatcatttgataatattttctatacaatctacctaataagtctaatattttaatcaaaaagacttaatttagaattttgatctttgggaaaactgcaaaagatgtcaaaatgtttaaaatacttgatcaaaacagattcacagattattataaaataataattattcatttcactagagtcataacatggatgtaaaatacttaacccttttaagctcagttttcctagttaatcaaaaactgaataaagacaacacaggaattatcttaatagagtgtaaaatctttattgtgtaggccagctactaaaaacataaagaaaaacctcccatagtgtcattgcctttttttatgaaaagcccattcagataactgtcaaatctgatgaaaagagcccttgaattcaatcagacacaggaagagtgcgtccagggtcatgaatgtacactatataatagaggaatgtaaacacaaaactagtaccttgagcagagggaatacatggcttttagtaacaatataggaaatttcctggttacattgaacaattcagacatatcaagaaaagccaaggcacagaatcaagttatacttgagaaaaaaattgtttttctggaccttcaagataaacatttcagcctcaggtcacaacagcagagttagaactggagaaaaaaagttacaagaactgatgaaaaagttgaaagagagagttatcatctcagctaagcaaaaagttatatcttctcaaggagaaaaggaactgaaggcaattatgtataattcacaaatcaggtgcagtgaaataggcaaaagttaaacttttgagacataaatctgaaaagcttcaaaaagaaactgatttcagaattaaaaatcaaaacctcttgcaattgcagtaagagcaaatcagtatttttagataaccttatttttctaacataactgacaaaattttgttttgttttaatatattttaatatcaaagctcaatctttagaaagacaattatgaataatgttatttctattatagccaacttgatcatataaaacatatctttcatacattctcttttcacaactatatcatgacttacccagaccatttatgacatgcttgcactttctggtttgtccaataccttctcttttttaaataaccgctcattttactttaagacaacaatttatgtaagcttctttctcatacaagattaatatctttcctcttaccttccttaccaagaatacatcatcatatccattccattcatatacattcttcatatctttctttcctacttactggttcctttctatcttgtttcatgaataaccactgaattagataaaattgtcctttttctcaaaatgatgcatttttatgcttttcttatatttttccatcaaaaaaccatatttttgcatactttgtatatataattatatattaaaatattttaaattcttagtaaccttaaattttagtcaaaatctaggaagcaagatcttgaattgtctttcatatatcagtattttatatactaaaataatttcctaatttttagaaacatatttccttataacaaaatttttctctcaattgaaaatgacccaagtattgaatgattatctattatttaatttaacataactttaatatttaaaattacatgaaaagtttatttacaagtatttacctaatttattatttttaacagattgcctagattacttatgaaaactgacatattggacaaagctagtcatcatttaaatttatttccaagttgaccatttttacagcctgtgaatatcaagtgtttacctaagtaagaactttaaaattaaatacatgagtattttgatgatagctcagaaaattcggttgttttcattaaaccaacaatattaaattagtcttacttataaaaagaatacacacagatctttctgttttgggctgagtttgtagttttatgacattctaaaacctgccaccttaaaatatctagcagaggcaaatatagaactgtctcttcagtaaatccaggcaaaaatgtatgctgatgattctgaagacaattttatttttattttatccataatttttaaacaagcttatttattaaggattttcttaagtcacatgaactggaaaatatttaaacttactaattcatgagtgctcgtttatttatgcatctacttagtaccatatgacacaacatacagaataatacacatacatatgcaaacacttctcaacatatatacacacatagaaataaaaatattatagttttcatttcagaaatttagttatgagatagtaatataaactcactaatttaaacaagacaattagacctaaattatttccaacaaaattggaacctttttccatgactaaactttatttgacccaataggtaatctaatggaggctgtggaccaaaattttgggtaaagcattttccatgaaagtttttatttttagaaacttcttttaccttttttttccttcaattccaagtgagttaaaggataatacttcaatgattacattttagggagaacttgccaagttgtgtaagataaacaaaatctccagttactaatacagccttgaagtaataatgccgtaaacaatgagttttatctcaacaccagtagaatagacaacagattcaagtaggcagaaaaaataatagagaacttaaaagactctgcaggttaactctatagttgcgaattttttgagtaatgatcatttaagctctgaactttctttttctttttttttcttttcctttttttttttgagacagggtctgcctctgtcccccaggctggagagtggcacaatctcagttcactgcaacatccacctctcaggatcacaccatcctcccacatcagtctctcaaatagctgggattacagatggacaccaccactcccagctaatttttgaagtatttgtaaagatgaggttttgccatgttgcccaggctggtctcaaactcctgagctcaagagatctgccttccttggcctcccaaagtgttgagattgcaggcatgaaccacggaacctggacaaaaatttcccttcctaagaaacaaaagatctcatggaagaacttacccttttgtcaaggagtgtaaataactagctgaataaaactcagcattggcaacaaagtatgagatctgagactcaggagagacccacctagtcatctgcaaatgtggaggagatgcaggggctttaagggccatgctggtaccaaggctctgggtccccacaatgttccaaatggtccttatctgtatactatgggtttcttctgggacaccatgattgttgactaaagaaaatagaattaagctgtttagaaagttaaagttagttttattcagaagtcttactgaagactaaagattatggaatgaggacctcacctaggagcaatccttcagagaggttatcagatggctctgtaacagtgtttcaacccactgcttacatagaggtggtgagggttcagtacttcagtacatgcaaaaatcacatcaaacttgctcagaagttacatcaaagcagaatcacatcagggtttcaattcaagtgtagatctggttttagattacagaggcacaatcattaacttcatcagatactgtcttatgtgtaggaaaaggcaagagctaaggtcattcatattttaaggaatatattgactcaggtaagagatgtggtggggggcatgtgccctgtcctgttttattttcaaagcctctttctgaggagctgcacatcatcacagagttagggactttgtgaaattactctggcatgcagaaatgagtgaacactgcttcttatgtttgctactttgtctcacatgagaaatagaagataataacaaaggaagaaatgtaagcaatctactacattccaggcaccatgtataatcctttatgatagttactattagtattattccacatcatgaaattgaggaagagcagttttaaataaattgctgataaattggcagaaccaagattcgcaccagataccctgctcttaaatttgttttcttgaccactaattcacaaacttcaaatttgagtggttcattctaaagctgatgtctagtatctttaataataaaaaaccctctttgccccaacttacatatgcacaaatgatattttccttaaaaacaatgctttagacaattgattctgttatttcatcttaccagctgtactctctgaaaagtgaatttactgagcacaaatacccagggagaaatggctaattgtgccaccacgtttcctagccagctgttccacacagagagaagtagttcatgtttaaatatccaggctgtaatggggggtattgcagcagaaggcctctgcaagctgccagaacacatttcttgtttaatggcaatggagacaggggctggtgtggtgtgatctgtaagtaacaggacagtgagctcttttaaatcatgctaagggagctctaggcaaatcatactaagggagctctatagtcaagtgcactgtggcactgagggtgctgcttacctgtctgcagctgcatcctcaacaccttcctctatagtgtacttgctttaaagatacctttaaaatatttcacagtatatatatatatatatacttatcaaaggaagtttaaaaacaagtacatgcaaaaagaagaaataacaaatcacctttaaccccatcactaagatagataggctaagatttcattttgtatccagttctctagtgaccttggtaaagtcataaaatgtattgacccttggtttactcatctataaaatataaataataatatatattttgaaaggctattatgaggattaaataagataatgtaaagcacatatcacaatgcttaaaacagggatcataattaataatgacttttatctaactaccaatagatacttaaatgcaaatgtaatcaaactacacagttttagaattatcttcatttaataatatcgtgtaatatttccacattgctacatattggcaaacaaattgtattagattatgtagtttgttttcatctttctcattgttggacactcaggttaatttaaaattttgctacttcccttttccccaaatgttatgatcatttgcttactgctcagtcctttgggtctcaattattgccctgtgtaaattcctggacctgaacgactagatttaagtgtataaaaaaatccttttaaaatcttagatatccatttcaaactgccaggattgctgcagaacttgggaaaggtccatcctgacagcctctggccaagacccaagaatgcaggggcagttgcttggaagttaggaccctccagagtggcgacatccaggtccatgccagagagtttgacgtggtattaatgaagtctgaagcataaaatccaaccctggaatggcatttgacattaccccgtccccaggcatgatgttaagtgtcaggcttctggacaattactgtttgtaggatatctgttatatggtgtgcaagcctggaaaattacattattttttctaaatctaacaaattatctgtgaagtagacattagtatccttattttgcagccacggagcagagaggttagatgacttgtcaaaactcacgcagtaaagaatgaccacctcacttgctctcttctgacttactaaaaacaatacaaaaagattcacagagggcctgtatctcttgtcctagatcacacatactgttatcaacaagaagggcaccaataccctggcaaacatattgcctgttccagtcttttagttagattattcagaaaatatcagagagagagagaaaaggagatgggcatgctattagtagaccatggtaagaaactgcacctttattctgtggccaatggtaagtggcagaaggatttaaaaggcagagaaggtagaagggagaaagatcagacactggagaaaagataggatttccgaggggatagttttaggaaaaaaaatggctaaacacagattttagaaagttatttaccttggaaagctcatgaaagattctgaagttaatgaatggtttccaaaatgctttgtaaaactccacacaaatacagttgcatattattagtagtattagtcagaagctaatatgttaggacagatattgatatcataatgtcatctaaaaatataagtggtctctaaaatgaaattgttcctgccacagacagcttatcctcttacaggctttcattgtcaaatattcatgtcagttttgtagactgtttatagagggaggaattgggaatggtgatttggttttctgttttgcttttgattttctaggagaggattcctgggacacttactcatagtggctatcatgctccctcctgcccgtcctcaagaaagcatagtaacctcccagctctatgtgaatgtgtgctgtggtctatgggggtgcaagtggattgcagtgtgctgtatctgtaataggttccatctgtgctcttgagtgttctgctgatgaattctcactacatccatgggtaatatgccccgggttgttttaagattatttaactatcttcgtgagtgtcagtatataaatatgctcttgcccagagaggtcataatccccactgaacagtgattaattatacacatacctcgtgtttgtattgcagcttcccccagggagctcaaagcactttgcaaatatgaattgcgaataataaataatgcctttgatttctaagacacctatctctaaggtcttaagtttatgcctctctcagcattctactaggagcaaagccctcacaacccaagggcaagagtcagcacctctcatcttcccctgtgagaggggatcgtgaactattcacaggcctgattttaccagagtggaactgagtatgtgagggacaggaatgtataaaggcagggaaagtagaagggagagaaaccagacactggagaaaagataggattttccagagtatgactatcaaaaaaaaaaaaaggttaaatgcagattttagaaagttacttacctcaaaacactcagggaaaattccaaagttaaaacaatacagggtaggtggggcatgtgacactaagtgccatttagaaggaaaaatgtggctttctactaaatcttgactatgagaaatcctcattaatcaacaaaaagatgaggtaggagggaaggttcaaaacatggactacaactataattctcagttaatttgaagcaccttagtgagtaaattccaacattggcgaaaataattcatttcttttgctaccgaagatagttatccagataaaatgtatgtagatcagatggccctatttgtttcacagtttactctatttttagtccctcttttatccagggaaaggggtgggagagttatttgggtcattttttgcttgagcacagaactcaacagcaattaaattatcatcgagcaaaagtgatattttaggcacagttgtttacaaaacagtaaataaataagaaccactggttcctttctatataaacacgcttctcctaggaattcatccatttcagaatttccccttcactaggcagaaatttgaacttgagatgaggattaggcctttcagaattctttggctgctgcctacatagcaaattgtacacattcaattgatatcaattggtaatgagactagcactccaggccactgttttcagtgttcaaaaccacactgacttccttctaatttcctgttgtgcaaatggagctcttaaatgtggtgctgcattaatagaactcttttcagaatcattttaacaatgacaaaaataatgacacagaggatcaagcctaagctgactagtgatgatgatgataatgatgattcattaccttgattctttgtagaatgtctgcaaatgtagcttcagagggattaaaaaataataatcaagataataattgcaagaatagttaacatttaggaatattatgtgccagatactcttaaagtgcttaattcagcttcaaccttcacaatttaatgaagtagaagtagatactatgattatatacattttgcacatagggaggtgaaacactagaagaccattagatttttccaggctttcacaggtgatatctagaggccttgagatctgatccagattgcttagctcttaaacacgattctggcctgcctctcaaaaaacatgttgatgggcacacaggcttaagatttgaactgggccactatgtcatggagctctaccaggattctatctttgaaaggggtgtcttatgaaagaacatagtttttattattatgcgttttgactagtctttcagctggtgatctgggaagaagtaatctgaaggcaacattcctaacttactataaagcaatgtcttatctcatgcagctggctgcgaatcaaatagggtcacagtctacacaaaccccctattcataactcttagatctccatttccgctcttcacttctctccaaaattctggttccacatttgctgctgttggtttgccaactgtagcaaataatatttcacaaaaaaatagtggttaaattgattcttcccctgttgtgaaacttgcattttttttcttcctctattcttacttaaaacacttagtaaattccttatttccttaatgagattagtatttattaactaccatctgccatatatctttctttgataggtactgaagatacaaagatgaatcaaacagaatctctgtcttcccagagctcacatttgattagaagagtcatacattaataaaatatccatactagtagaaatataattatgaactgtttcatgtgacaaaatttagggtactacggaagctcatatcaaaatgagggacaatggggatcaaagaaggctcccctggtgagctgacctctgagagtgggctgggttggctgagatgggtggtgctccttccagtagagtgtatggtttgtgcagaggttctcctatgagggaagatggggtaaggaggaactgaaggaaagtctggctggtataaaggggataaagtataaagagagtatattttatacagagtataaaagggaatgacgtgagaggggctgtgagcagactgggtccagatcactcttggacctggaatcctaggctcatggctcttctctttgccttaacgcctcaatgcacacaatctgccaccaaatcctgtcaaaaatgacacacactctctctctctctctctctccctttccccctctctctttactctcctatggcctcagagctagatttccctttttaaatccaatcttgcctgaactctacctccagccctccagccttttagatgattttccacctccaatccttctttaccctggggcatcccttcattgagagctgcagtttttccttttgatttttctaaaatacattttagactactctgttcttaagaacatttactgattcctgaaacttctgccttataaaccaaaacacagtgggacagagtgaaaagccctttagcatctgacccagcccggctgtacgtggtgcactgaacttcccatcagaagttcccatcaacccttttgtctgaactagaatgtactgtcaattgtgaagggcttcttggagagctccggagatctttgctaaatgtgagggaactcaaactcaattacattttatttttctttcaaggaaaacacacttgtctctttttcaaccttgccataagtgaacaaatacatgtgacaaggtaaaaaagtgacacagttttctttctatgcataggttttctgaatcacatttatggcttcatttagcaggtatttaggcagcacttaatacgtgtaaggaagtgaggagggggaataataaagcttgagaggatgtgagtctctttagcatgaagtataggacatcaggaggagattcctggagagatgactgacaggttgagataagtttagaacatagggcaggtattggactttactgtgttgatagctaaggatgtttattcactgtgaagcaacactatcaggtatggtggaggaagacaactttgctgctgatataggggatattctagagaaaggatggccagtgggaaggcttgggcattacagaatacaagggagatcctcttgaataagctggccctctctctcgccattgcatactgcctcagagcctggaatattttctctgggtcatgacatttgttttgtttgtagatgtgagctccatgaaagcagaggcattggctatgtagtctcagaatccagcaaacgaaaggtggacagtatgcatttagtaagacatgctggctggctgcaactaacaaccttatcacatcacagaacaggtggactcagaggcagaacatggagccctgccccctcacaatccagaaaagctttccacctgattgtctttatgccggtaaacaggattctctgcttatgtcttgacaacttaacgttgtgaaaacagaccaaagttattcatgagctagttacacgatttgttaatgattttagaaaatggtttaggaaatcatctctaattgaccatcatttatactttcatttatgaaagtgcctggagccagcactaactagtctgtcttccctgcacttagcaggctgcatggggctgacagaagcaaggaaaacatgaggaccaagcaatgtgcagaccattctgaccaagttacatcattgacatctttaaactttaaaaattatcattctgagctcaacatacattttttgaatgcatattgagtggtgcacatgagatgagatgctgaggatgtgttgtggagttggttattaaatgcagtgtggctcagcttcctgttatgtgatgcatttgtgctgtgggtcaagttgccacctaccccactccctggaatgacatcattggaaaatgtatctaagccaccattcacagtagtgcttcttttgaaattacccccataaataacattgggaaaaagcaaatgatgggttggttaaaaaaaagtcatagctcaaaagaagtaatgcctcccttcaggatcggagtttggtttcacctctcaaattgctcagcaagtactttcttctacttcttccaagcttacacgcccaccttccacccaaccatagatatgcactccatctttttttttttttaatccctttgctttggacatgctctttcatttagtaagatcctctgttttcttctccttctcatggctaatttttagggtcttcaagacccttcaagacccatggctaataattaaggtcttcaagaccctaattccgggtttatctttccttccaagccttctctgatttcccaactctcctgcctgtggatgttccctcgcagcattcctcttcacagtattataatagtctgcttattgttatgagtaactcatcactagatttgagtgtcatgggagaaagtctgtgtctccttctgtagccagtgtccacaccgttgtccctggtacatgacaggtgttgactatctgcctgttgtatgtggatggaaggtttgcttcccagctgagccctgcactgggatcacagagatgttaataatgtgagcatgagctccttgttagacagaagtgtcactgtcagtggcatttcaaccaaccaggtaacaaaccacaaatcgtgacccaatatttctgtaaaattgcatctctttatactgtcagtatctgtagttaccaaaacttaaaaaaaaaccttcagaaacacagaatggctgacattagttccaaatattaaaaagttttaagtgtcatgctcaaaagcatctatatttaaaagcaattggatcataaaaagtgaacataaaatttacacagctgcctcatcctgaatactttaaagactaattactctgttgagtcctaatgactattgccttcaagccctgtaaattatatataaataagagaagagagtttgtaaatgtaagtgactctaattgggtctcagaagaaagaaaaacagatctttagtagctcgatgaaatctctaagcccataaaacatcggtcagtttctcccatggagttttgtggagtgtaccttttatacatgcaacagagactgaattcaaagggcaggcctgaaccaaggaacctgtttgattttgcttgtatatatgaactgaaaaatataaattaaagaaactcctgatttcataattcaatgtatttttatttccttgaaaaagggctgccattcagtgaagcatacagtaaggaaacctgtcagaacagagtcccatggaagagtagcagttggtctgtattcattcccagtaatgggactctttttctatgcaaatgcattttgagttaaaggtaagacaggttgtagaatattttgtgcaaacgtaaacagaagcactgaaatagaagaagataattgttgcttattaaagtgcttagaatagagctgaatcaagtaaaccagaacccatcactgaatagtttggggatttggtacctgtttactacttcctttgagagttttcaaggttgtttttgaataagaaatgaatcgagccctagaaaaccatcatagttgagtggatctgaaaatgctcagtgcagtgcagttactgcctcatgagaaattctcaaaaagctgagaatattctctctctttttaattttttttttaatttcagtaggttttgggggaacaggtggtgtttggttacatgaataatttctttagtggtgatttccgagattttggtgcacacatcacacaagcattgtacatggtacccaatatgtaacattttattcctcactatgcccccaccctttcctgagtccccaaagtccattgtatcattcttatgcctttgcatcatcatagcttagctcccacttataagtgagaacatacaatgtttggtttttcattccagagttacttcacttataataatagtttccaattccatccaggcatttaggttgctgtaaatatcattaatttgttcctttttatggctgagtagtattccttatccactcgttgatcgatgagcatttgggctggttctgtatttttgcaattgcaaattttgctactataaacatgcatgtgcaagtatctttttcatataatgactttttatggctgagtaatatcccttatccactcgttgattgatgagcatttgggctggttccatatttttgcaattgcaaattttgctgctataaacatgcatgtgcaagtatctttttcatataatgaattcttttcctctgtgtagatactgggattgctgaatctaaccgtagatctacttttagttctttaaggaatctctacattgtttttcatagcggttgcactggtttacattcctaccaacagtgtaggagtgttccctgttcactgcatccatgctaacagctataattttttgatgttttgattatggctattgcaggagtgaggtgatatctcattgtggttttgatttacatttccctgataattagttatgttgagtagttttctatatgctttttgtctatttgtatattttcttttgagaattgcctaatcatgtccttagcccactttttgatgagattgtctgttctttcattgctaatttgtttgagttccttgtagattctggatattagtcctttttcagatgtatagattgtgaatattttctcccactctgggttttctgttaactctgctgattatttcttttgctctgcagaagctttttagtttaattaagtcctgtttgcatatttatatttgcttttcttgcatttgctttggggttcttggtcatgaagtctttgtctaagctaatgtctagaagagtttttttcaatgttatcttctagaatctttatggctttaggtcttagatttaagtctttgatccatcttgagttaatttttgtataagatgagagatggaggatccagtttcattcttttacatggggcttgacaattatcccaatacaatttgttgaatagggtgtcctttccccactttatgtttttgtttgctttgttgaagatcagttggccgtaaatatttggctttatttccaggttctctattctgttccattagtctatgtgcctatttctgtactagtacaaagctgttttggtgactatggcctaatagtataattttaagtcaggtaatgcgatgcctccatatttgttctttttgcttagtcttgctttgcctatgtgggctattttttggttccatctgaattttaggattgttttttataatgatggtggtgttttgatgggaattgtattgaatttgtacattgtttttggcactatggtcattttcacaatattgattctacccatccatgagcatgggatgtgtttccatttgtttctgttgtctatgacttctttcagcagtgttttgtagttttccttgtagtggtttttaaaatttttttttccaccaatgtgaaatgggttgagattttgatttgattttcagcttctgttggtctacagcagagtagcagagctactgatttgtgtacattaattttgtatcctgaaactttgctgaatttatttaccaattatgggagctttttggatgagtctttagagttttctaggtatacaaccatatcatcagcaaatagtgacagtgacagtttgatttcctcttaccaatttggatgccctttatttctttctcttgtctgattgctgtggctaggacttccattactatgttaaatagaagtggtaaaagtgggcatccttgtcttgttccagttctcagggggaatactttcaatttttcctcattcattataatattggctgtggctttgtcatagatggcttttattatgtaaaggtatgtctcctttatgcccattttgctgagggttttaatcataaagtgatactggtttttttctaatactttttttctgcatctattgagatcatcatgtgatttttgtttttaattttgtttaggtgttgtatcacatttattgacttatgtctgttaaaccatccctgcattcctggtatgaaatctacttgatcatggtggattatctttttgatatgttgttgaatttggttggctggtattttgttaaaaatttttgcatctatgttcattggggatattggtctgtagtatttttttttttttttgctatttccttccctggtttttgtattagggtgataatggcttcatagagtgatttaggaaggatgccttctttctctatcttttggaatagtgtctataggattggtaccaattcttctttgaattaatgatagaattaaactgtgaatccacctggtcctggccttttattttggtggctatctttgtattaccatttcaatctcactgcttgttattggtctgttcagagattttatacctttctcatttaatctaggacggttgtgtatttccaggaatgtatccatctcctctaggttctctagtttatgtgcataaaggtgttcataataacctttaataatcttttgtatttttgtgttatcagtagtaatacctcctgtttcatttctaattgagcttatttggatcttctctcttcctttcttggttaatcttgctaatggtctatcaattttatttatcttttcaaagaaccagcttttttttttcatctatcttctgtattttgtcatttttgttgttgttgttgttgtttcaatttcattcagttctactctgatctttgttatttcttttcttctgctggctttgggcttagattgttcttgttttatcagttccatgaggtgtgaccttagattgcctatttttgctcctttggactttttaatgtagacatttaatgccataaactttcctcttagcaccacttttgctgtatcccagaggttttgatagatattgtcactattatggttcagttcaaagaatttttagaattttcatcttgatttcattggtggctttgttcattttaaaaaaaatttttttgtctttgttgaattgggttaatttcacagccttgtctgtgagctgtgaagatctttctcccgcttgtttgattggactgctgagactttccggtgcatttctctaagtgtgtccttcatttccaggagttgtaattgtttttattttactgtctatttcactgaggaatttctctttcatatcctgtatcaggtttttgatttctttaatttggacctcacctttctctgatgcctccttgattagcttaaaaattgaccttctgagttctttttgtggcaattcagagattccctcttggtttggatccattgctggtgagctggtatgatcttttgggggtgttaaagaaacttgttgtatcataatgccttaattgttttactgattccttctcatttgggtagactatgtcagagggaagatatgggattcaagggctagtgttaagattttttcattcatggggttctcctttgatggggtgttctcccccttcccctaggaatggggcttactgagagccaaactgtagtggttgtttttgctcttctgggtctagccacgcagtagagctactgggctctgcattggtattggagagcttctgcaaagagtcctgtgatatgatttgccttctgatcttgcagctgtggataacagcaactgctgcagtggaggtagcaggggaatgaagtggactctgtgagggtctttggttgtgtttttgtttagagtgctggttgcatgttggttggcctccagccaggagagggcacttttaagaatgcatcacatgtggccctataaggaggatgcattcttgccttaggaacacctggctgagtattcaggattttcaggtggggagcagggccatagagctcccaaaagcttctgacctttgtctttcactacaaggatgggcacagaaagaccaccaggtaggggcagggctttctgagttcagcctctctttgggcagggcttgctgcagctgctgtggaggatgtgggtgtgacttcgagtccaatggagttatattcccagggggattatggctacctctgctgaatcatacaggtcaccagggaagtgggggaaagcaggcagtcacaggcctcaccccactcccatgtagtccatagtcctgaaggctggtctaactttcattgtgcccctccaacagcatcgagtctatatccaggcagccagagaccagggctgagaacttgccccaaactatgagtttcctagcagagaaagcaagccgacttacaggcttttggtatctcagggaccctgcagtggtgatccagttccttcaaagggtctgtgggttctcttagctttcctggtacgttcctgtggtagttcttggagcaaaagtttacgacgtgagtctccacacactgctctgtccatccaagtggcggctgcaagctagtcctgcctgctatctgacatcttaattctcgagaatattctcttgaggatatctaattcttttctgttctaatcttttcttaccttgcttaagatggaaattatggaaaataaccttaatgtttacttttgtcataaaaattggctttattttccatagaatttataatttttaagcataaagtgtctctttttccaaaaagcttaaaaatatttatttttaaaaaaacttggagtcatatcattgcatttaaaaaaatgtttacttgactaataaggattgaatacattcaagatgtacaatgtgatgggtcgatacatataaacactgtgtaatggttaccacaatcaaaaaaacacatctatcaccacccatgctttacattagattgcctgaacttgttcactttgtaattgaaaatttgaccaacatcctctcgtttccccaaaccccagtccctggaaaccgctattctaccttctgcttctatgatttctacctttttggattccacatataagtaagaacatacagtgtctgtctctctgtgtctggcttatttcactttgcattatgtcttccaatatcatccatgttattgagaattaaagtatttttattatttcctgtggctaaataatgtaccactttttctttactcactaatctctcaatgaacactctggttatttctatatcttggctactctgaataatgttgaaatatacatgaggtgcaaatatctctttgaggtactgatttctggatatatatccagaagtaggattgatggatcatatagtagttctctttttaatttgttgaagagtcttcaaactgttttccataagtgccataccagtatatgttcccaccaacagtgtacaagggttcgcttttctccacacccttgccaacacttgctacctattgtctttttgataataaccatcctaacaggtgtgaggtgatatcttattgtggtcttgatctgcatttctctgatgagtagcgatattgagcaccattttgtagatctgttggtcattgtatgttttctttggaaaatatctatccagaacttttgctcacttttgtcattgtttattctttgctattgagttgagttctttatatattttggatattaaatccctgccagatctgtagtgcaaatattttttcccattctctaggtcacgttttcattttttcaactgtttcttatattgtgcagaaacttcttagtgtgatgtggtctcatttatttattttggattttgctgtgtattcttttggtgtcatataaagaacaaatattgccaagactaatattaaggagtttttcctccatgttttcttctaggagttttatggtttcagatcttatatttaactctttattttcaagtaaatttttgtatgtggatccaacttaatacatgtgtatgtgtgtatctatcttttccaacaccatttattaaagaggttgtccttttttacattgtgtattcttgctgttcttatcaaagtttagttgatcacaaatgtataggtttatttctgggatctctcctctattactttagtctatgtgtctgttttgatgccagtaccatactatttttttgttttgttttgtttttgtttctaattaggaattcagcatggataacataagcttttgatcactatagttttgtaatatagctagaaattatgaagtgtgatgcctccagccttgttcttctttctcaaaattccttttgctatttgggatcttttttgattccatatgaactctagaattgtttttctattgctttgaaatatacaattggaattttaataagaactgcattgaatttgtagctcatttgggggtggtatggacattttaacaataatgattcttctaatctatgaatgtgggctatctattaatttatttgtgtcttctacaatttctttcatcagcgtcatacacatttaacatttgattgtacatgcaatggttccaggacaagttcttaacaatgaagcttggcctcagaatggtcacaaattgtattttagtcttttgctctgggacgcctaactgagtgggattatctatgtctttatttaaataattttcattaaatgtttttattttctatgatgggggctaaggaaggatgtcaagtatggctgctaaccttcaggaaaattgtaggccacagccaaattagagggaagaactgtgtgaaatggcccatatttaaatgtccaacccaattaaacagacctacagttgtcccatatgtaaaattagcgtaaagttaattataagtaggccatatttttcagattgaaggatgaaatatatgaaatacatttgagatagttcctagaacaaaatgggcaaccaatgatattttaacgatattggtaataacagtaaaaataggtcactaattttgtttcccccaaattcatgcccacctggaactgaggattttatttatttgtaaaataaggtcttaacagatgtaataaattaagttaaaatgaagtcatactggataaaatgggttctaaatccaatgactggtgtctttttaaggaaaatgagatgtggatagagagacacagagacaaatagggacacacagagggaagagggccatgtgacatgaggatagaagcagagattggagcaatgcacaccaaagaacaataaggattgtcaggagctaccagaagctgaaaagagacaagaaagcatcctccccttgaaccattagaggacaagtggacctgctgatatttctgtttcaaacttccagcctccaaatttctattattacagttgcccaggagacaaaacagatggtaaatggaaccacagcactggatgagattgtgaaagcagtgagtattgatagagaagttcctagaccgagcccggggactttaacatgaagaaagcaaggtgacatcgagaaatcagcatggagagagagaatgaatgaccagtcaagtaggaaggaaactaggagagaaaaatattaggaaattgaagcattttagaaagaaaagaatgtgactgtattgaatactaataaaaataagatactgattatgaaaggaaaattcgatttatcaacatacagttcattggtgaattaataataaaatgaaagttttggtggtagcttagggttaaaatctgactggaataagtttcaaaagtaaattaaaaagaggcattagagaaagtatagataacgccttaaaagttttactgtaaaccatcagggagcagagaaatgtgacattagctaacattaaaagagttgcaggccgggcgcaatggctcatgcctggaattccaacactttgggaggccgaggcaggtgggccacctgaggtcaggagttcaagaccagcctggccaacatggtgaaaccccatctctacaaaaatcagctgagtgtggtgacaggtgcctgtaatcccagctactagggaggctgaggcaggagaatagcttgaaccctggaggcagaggctacagtaagccaagaccttgccactgcactccagcctgggcaacaaaagagaaactccatccaaaaaaagaaagaaagttgcagaagtttccttttagatacaaaaaatgctaatgggaattatatagcagaaggaatcaaattttaaagagaattgtaaaggaatggggtgttgcctcagtagtgtctttacaaggtgataacgatgagaaggaaagaatacgttggcatcagataaaaaatgaggataattcatctaaattaatgaaaggaaagtcagcacataggggttcagctattgacacgtcagtaaatgtgggggcgggactttgtggttcttttacaaatgtttcagttgtcttcgagaagatggagacaagattattagctgagagtgaggaaggagaaggcagaaatgaagagaaggcattatatggtcgccttagccaataggtgaatggataggagaaagaagctgagattaagaggagggggaaggcccacatgaagttggcagtcctggatataaagtggcttataaacagtgtgcatggtttgtgttttcttccaccagataaaccattcaaaagtagggtaagcaggcattgttcggacaaacaaatatccactttcaagaagcaagaatgggccaagggacttgaggctgtaaatgagaggatagtgatggaccagacaatatgagctgggaaaggagagaggagaggacacaaaggagttaagagctctgagtagatggtgagattaacccttacactaagtattggagaagtccaggcattagaggaagggaattagaaagggaagagattgtagtcagaaaacaaaattcctacagttgcaattacggagggtttgcaattattagtactaacaaatactgaagtctgatattgagtccatgatgcactaatcaattatgactgacagcttgaaaaacagttagatggaggtgctgaagtgggtgtgcatggatatggagacattattgtgtggctctcatgggacctaagatgtgaataaggaggggcttcctggcacagatctgtatcaggagcattctaggtgcagagaaaagcaggaataaagtctccaaagaaggagtgagctagcacattaggggaacataaagtaggtcagtagtagttggagcttagtgggtgagggcaagtgtggaatgaaatgagaccaaagaggtacaagggaatatgatatagtttcttgcagaccatgtcaaagaatttggattttattctaagtgcactggagaatcattaaacattttaagtagtggcatctggtttatagtgtaaatgcttattttgactgctgtgtagggaatggatgggtgtgggagaatgaggaggtgaggctggaatctgggagacaagttcagatgtgttgtagttgttcaagtgagagctggtgatggactgccttgcggcatggtgaagacctggaaagaagtgcaaagatgcacaatgtatttagtagagaccagagggctgtcgatgacttggtgtggggcacatgtataggggttctggtcaagaaaatgaaacaaaagaaacaagtatggctcctagaattttaacctgagcagccagcacagaggggtgccattatgtgaggtggtaaaaactaaaaggggagctttttggtgaggacaatctggttagcagaaactgaaagatgcataggaagctgtctaagtctaggattgacatgaactgatgtggaatagaaaagaatcaacatggagaagagcctgctctttcaaagtgaaatggtaaagcaagaaactagcaatgccgtagtaaagggagaatgagagcgaactcttatccctcagtggtggtccagagtctggatcagtcatccctttgatgatgtgagggccatagtgctttgtgtctttccctttagatcttatatgtacattgtggcacccaggctaacattcttaaatatcactttgtgtcacacatgtgtttgctgctcctaatggaatccccctttacagaaacaggtaaaatttccttggcattccttgccagtgtggtctctttctttaacatttcattccaagttcccattccttttgtggggtcacagtttccctacttttcaaaatgatgaggttggttgtgcaaatggctgctaaggttctcatccgctccactgtcctacagttctacagcttcaggtacggtgagatccagctacatcactctgtttacatcatagttaatagtatatcactttttgttttccaaactaagttctatcttgcttctacaaaacttcttcccagacaaactctttctaattacctccacgcattttttttaacttttattttagattcaggggtacatgttgaggtttgttacacagttcaactcatgtcacagaggtttgttgtacagattattttgtcacccaggtactaagcctagtatccaatagttgttttcttgatcctctccctcctcttaacctccatcctcacgtaggccctggcatcttttgttcccctctttgtgtccatgagttctcatcatttagctcctacttacaagtgagaacatgaggtatttggttttctgttcctgcattcgtttgctagggataatggcttccagctccatccctgttcccacaaaagacatgatctcattcttttttatgactgcatagtatttcatggtgtctatataccatatctactttatccaatctgtcattgatgggcatttgtgatgattccatgtctttgctattgcgaatagtactgcagtgaactttcatgtggatgtacttcaacccttataaccacttattgattttgaattcacaaaacatgtattccgtagcactgatcaaatcttctccctttccctctgcttatacgtccattcctctatccatccactcatccttctatgctgccacacatctcttttgaggtagcatgacatagtggaaagggcacatactttatatacatctgcactccttggtttaaatcccatttcattatgaatattctcattacagttttacttgtggagtttttatacctctgtaaaattccattttttaatctgaggatttaatgaaaaacctatctttagtaccaggttaggtgcctaatacagagtaggcacatcagatcagccagtgtgactgttgcttttgtctccttcaactagattataaggtctttgaagatagaactgtagcattatagccatttgtttctctagtgtcttacaccagcaggcattgaataaatgttagtttataatttgggggaagtgttgataacattctccatagtggctattttattcaacaaatgtcttctggagatttaagatagcatgtcccatgttattctctttagacacaaagatgaataagcaacaattcctcctaggggagcttagattcaagaggatgagaaagacaaaagagtcttgataaattgagatttgtattctacgtgaccagagtggcaatatggtgaaaagaaagatgttattagtctttggggcaagtggggacctgggtcacatggactgggtcttaaataatgaggaggagcttgccagacatattaggaggcaagtaggtgttttcagctaaggggaaaagagaaacaaaataaaacaaaaacataacaatgtgcagaggcaaggaaaagcatttggagggatactgcgtgttcaggtgtgtgactaagatataataatacatacataataaagttggaaaggtaagaaaggacattgaatgtcatggtaagaagttggactttctcatatagaattagaaagccttgggcttttgctttttttttttttttttttttttttttttgacagagttttgctcttgttgaccaagctggagtgcaatggcacaatcttggctcactgcaacctccacctcccaggttcaagcaattgtcctgtctcagccttccaagtagctgagattacaggcatgtgccaccacgctcggctaatttttatattttcagtagaggcagggtttcgccatgttggtcaggctcgaactcctgacctcaagtgatccgcccacctcagcctcccaaagtgctgggattgcaggcatgagccattgtgcccagccacctcggagttttttaggcactagagtcatatggccacatatgtgttataatattcatattaataaaagtgtggaaaacagattagagtaggaagagtagaatggtgagaaaaggtaaaacagaaaaattatgttcttgtacaaccaatgtacgagagtatttaccctaagtcccagctcaagatactgaattagatatttgaacttttaaatttaattaatgtaattttattttatttttcaaaatgtttattttcataggtttttggggaacagttggtatttggttacatgaataagttctttagtggtgatttctgaaattttgctgcacccatcacccaagcagtgtacactgaacccaatttatagtcttttatccctcatccccctttcacccttacccttgagtccccaaagtccattgtatcattcttatgcctttgcatcctcatagcttagctcccacttatgagtgagaacttacaatgtttggttttccatgactgagttacttcacttagaataagggtctccagttccatccacgttgctgcgaatgccatttatttgttccttcttatggctgagtaatagtccatggtgtgtgtgtgtgtgtgtgtgtgtgtgtgtgtgtgtgtataaaaaaataaagaaattgtgtgtgggggtgtgtgtatatatacaatttctttatctactagttgataaagaatatatacctatacacatgcacacataccacaatttcttaatctgctagttgattgatgggcatttgggctggttccatatttttgcaattgcaaatgtcactgctataaacatgcgtgtgcaagtatctttcttgtataatgacttactttcctgtgtagatacccagtagtgggattgctggatcaaacggtagttctacttttagttctttaaggaatctccacactattttctacaatggttgtactagtttacattcccaccagcattgtagaagttttcccttttcactgcatccatgccattatctattattttttgattttttgattttggccattcttgcaggagtaaggtaatatcgcaatgttgttttaacttgcatttccctgatcatgagtgatgttgagcattttatttggacttttagaccctgagttcctggtccgtcatccccttgtcatgtgtagctgaatttcaagtaggatataaataataataaaatgccttgctacaaggtactgggtgatccttggctgagtattagaggtgctttgaaatagatccaacatatcctacttcaggaggagtgtagtatctcttccatgcgaggttctttcttgaagctagttatgtctacttagacgtatacagagtctaacattgatcaacttaaagcctggccaaatatccatggcaagcttgtcagatctgacctctggatacttagagcatgaggtcctgggggtcaaacctgcagggaggcactggtttctgggctgtggctcatggggctcacaggagtgatacaaaaagctgtcctggggatctgtgaccaaatcccagtaggctgagctctctctgaaggggcaaatggtttccactgtattccttggagaccaaggcattgtgttggccaaatgaagttgtggggtggagatggggtgacgaggaagagacagtgagcctccccataagtacccctcccacttcaactcgtgcagctctacatttttttttcttttctgtactagccttcactgtccgcatcatttgaatacagtgttgcaattggaaacaaatttgaaaactactggactcggcatataaggcaatctcagatgcatgcaaaagagatggaaccctaaacacaggcaatagtcagcaggttccaggcagttggtgggagcccaaacctgagtaaattttctgaggtgttacagcctcagatgcaggtgagaaggaggctaaaccagtgcagagactgctcaactccaacaggaccaccagattctagcaagctcctttggcatgccacccttgggattttcaagatacgtatacacccaactcaggccaggcaggggagctcatgcctgtaatcccagcactttgggaggccgaggcgggtggatcaactgaggtcaggatttcaagtccagcctgaccaacatgatgaaaccctgtctccactaaaaaaaaaagaaaaaaaaatgaatagttagctgggcacggtggcaagcacctgcaataaggaggctgaggcagaattgcttgaacctgggaggcagaggttgcagtgagctgagatcgcaccactgtactccagcctgggcaacaagagtgacacttcatgaaaaaaaaacaccacaaaaacaaaaacatatacacccaattcaaggataacacactctaggcgagacagtgtataagaacaagtcaagtgaattggtctctggacttaataaaaataagtactatgagagttgtcctgttccagagaaattattttttagatattaaaaatttcaacagcccttgatgctaaaaactctcaataaattaggtattgatgggacatatctcaaaataataagagctatttatgacaaacccacagccaatatcatactgaatgggcaaaaactggaaggattccctttgaaaactggcacaagactgggatgccctctctcaccactcctattcaacacagtgttggaagttctggccagggcaatcaggcaggagaaggaaataaagggtattcaattaggaaaagaggaagtcaaattgtacctgtttgcagatggcatgactgtatatctaaaacaccccatcatctcagcccaaaatctccttaagctgataagcaacttcagcaaagtctcaggatacaaaatcaatgtgcaaaaatcacaaacattcttatacaccaataacagacagacagaaccaaatcatgagttaactcccatccacaattgcttcaaagagaataaaatacctaggaatccaacttataagggatgtgaaggacctcttcaaggagaacaagccactgctcagtgaaataagaggacacaaacaaatagaagaatattccattctcatggataggaagaatcaatatcgtgaaaatcaagttaaataatgggttatacttaaagtaatgggttataagttagtatttgcaagcctcatggaaacattgagtcaaaaagcatacaatggatacacaaaaaataaaaagaaactaaatcatatcaccagagaaaacttcaaataaactatctaacaatgcattttaaagaagcagcaaagtaagagcaaatcaaagccaaaattagtagaagaaaagaaataataaaaactggctagacatatgaagaaagatgaaactggatctcttccttacaccttacataaaaattaattcaagatgaattaaagacataaatgttagacctaaaaccatgaaaaccctagaagaaaaccgaggcaataccattcaggacataggcatgggcaagggcttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaacaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcagggaacaacaggtgctggagaggatgtggagaaataggaacacttttacactgttggtgggactataaactagttcaaccattgtggaagtcattgtggcgattcctcagggatctagaactagaaataccatttgacccagccgtcccattactgggtatatacccaaaggattataaatcatgctgctataaagacacatgaacacgtatgtttattgcagcactattcacaatagcaaagactgagaaccaacccaaatgtccatcaatgatagactggattaagaaagtgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacttggacacaggaaggggaacatcatacactggggcctgtggtggggtgaggggagcagggagggatagcattaggggatatacttaatgtaaatgatgagttaatgagtgcagcacaccaacatggcacgtgtatacatatgtaacaaacctgtacattgtgcacatgtatcctagaacttaaagtataaaaaaaaaaaataggcctggtgtggtgactcacgcctgtaatcccagcaccttgggaggccaaagtgggtggatcatgaggtcaggagatcgagaccatcctggctaacatggtgaaacccatctctactaaaaatacaaaaaaatagccgtgcatggtggtgggcgcctgtagtcccagctactcaggaggctaaggcaggagaatggtgtgaacccgggaggcggagcttgcagtgagccgagatagtgccattgcactccagtctgggcgacagagcgagattctgtctcaaaaaaaaaaaaatttctaagacccaccaaattattcaattatttcctccctgcctccctctctcccttccttccttccttccttccttccttccttccttctttccttccttccttccttccttccttccttccttccttccttccttccttctttccttccttccttccttccttccttccttccttccttccttctctcctttctttctccctttcttccgttgtttctttctttcttttcccttctttccaaatttactgggtacttaccatgggccagacactagaaacccaagaaccaatgagatatgtcctggctcccaaggattttattgatttgtgcgagttaggcaagtaagtagacaacacaacacagtacatgttagaataaaggagatggtagggcctattggatcagttatgggcagtttacagaggccagggagggcttcttatgagagggaaacttatgatgaattctgaagtatgggagagtcaacctaatgagaagggcattctgggcagcggtgatcaccatgggctgttgtggcccttgggaaactcatgctctttggaaccggctgaatttagtttttaaatctgacctcatcatttactgagaacaggaaaagttatttacttcccagcagctctattttttccgcagtaaagtgaagaaaattaaagagaaaaagcattctagatgaaagtggagtattgagtaggtgctcaatcatgatggaatacctgtgctaagccaaggagtgtaacgatgtctagtaagtgaaaagggatcttatcagggtgtgataaaccatcggttcttttaagaggattccttatcatgtgtttaagtacttttttaaatatagattttcaattttttagaaaaacagcatttataatatctgttgtttatttctaaaaataatgatgctggccaggcgtggtggctcatgtctgtagtcttagcactttgggaggctgagacgggtggatcacctgaggtcaggagatcaagagcagcctcgccaagatggtgaaactgcaagtctactaaaaatacaaaaataaataaataaataaatagctgggtgtagtggtgcaagcctgtaatcccagctacttgagaagctgaggcaggagaatcacttgaacccaggagatggaggttgcagtgagccgagatcacgccactgcactccagccagggtggcagagtgagactccatctcaaaaacaaataaataaataaatataaaaataatgatgatgattttgcctgaatacggggaagaagaagaagaagaagcagctagatttaacttgagtgctccaacatggataggacctttaaaacttcgagagtagttgctagtgacaaaagtttatttctttttatacatatttattccagaagcaactaaggctcaaattagttttatttttatttattttattctattattattagtttttgagacagaatcttgctctatcgcccacgctggagtgcagtggcacaatctccactcactgcaacctctacctcccaggttgaagcgattctcctgcctcagtctcctgagtagctgggattacaggcatgtgccaccatgcccagctaatttttgtattttttgtagagatggggtttcaccatattggccaggctggtctcgaactcctgacctcaggtgatctgcctgccttggcctcccaaagtgctgggattacaggcgtgagccatcacacctagcccagttttatttttaaactaagttttattttaagctaaggctcaaatctcttttattgttaatttccacattgtgaacatcttatctctgtttatatgaacaaaaaatgatgtgtgtcctttatagtgtagcaatgttaatatataaacaacaagaaaatgataccaaatagacaataaatgcattacagcatgtcagagaaattgcatcgcattcatggccagaatattcaattcattctttgctttattagacttagggacaacaccttccctctgacaattcactgtctgtggaattataaacttgcaatgtctatcattgctgtcaacctaatgaaaggggatggggacagaaaactccagggaggaaatggaagctcacagatgaagcaagccgagggggtagaggaaggcctgaggatagcgggaataactctgggcccaggattctccagagacaaatagacatggcaatgccaggcaagaagctgatggtgatctgaaccactggagtgcacagctgaagaggtggaaatgtctcttagctccctaacaaagccactgaagaagacgctcagggaggtgattaatgagcccccagctctgacccacatcccttctggaagttagcctttcatggggtcaaacttactttgaaaagtcatggagtgaatttgcttccccaagagtcatgtgaaatgagttagtgggaggtttcagaacatcacattcgcgggtggagggatactttaagaggcactgattgcatcaaagctcctaagaaggcgagtgaagtatttgtatggctttggaagaactagctgaggtgtttttttgtatcacgaacttggatattgggggaagcttcagaatactttagcagataggaactctgctgagattactaggtcctaagaggaatggtggcaagagggatgccagcaaacatgtataaaatgaaagtgttttcaaaaatggaaaaatatgtaaagaatatgtgtgtgaatatgaattaccagaacagtaagatgttaagagagttcaacagccttaaggaatgtgggggtcgatcactatgtctggcacgtaattatcacacactggtttattttatgaggttgaattaaatgttaagacacacagattcttagaaaagtgtggaagggcatattgcccagcaacccaccagtgcacgagatgggcctttccctgccaggggcaggaggggtaccttgcccgtgatctgcacagtgactcgcccctaccagctcctgtctgcacaaaatatgctgctcttgggagcagccattactttttaagtagtaaaataacaaaaataataatatccggaaatctgcgtggtcagaaccacagaaagagaatgaaccaggaaaaccaggaccaggtatagagagcttctccttctggcctcagaagtgttaggcaatggcctcatagctccaaactacatttttctattcttaatttattgtttcacatgcatgtattctgaaattctatgagtagcaacttatatttgaaatggtctctgccctctccccgcaaaagtattcaaatacttgggtgaggactggggatcagtcagggacacggtggttactcacaaccctcttgccttactggattggcagtctgggaaagatgggcaggctgagagagttcagggagtttttctttgggatgagggaatatgagaaactttgaggggatgagaaagagttactttagttgttctcagctcaaatttgagcagatactcctttctccccaatggccatcagcttatgacatcgctcctcaattccaattattttccattcccacatatgtccaagggaagagctcctgccattttgtgtgtgggactccagtgactccagaccagatgacccctacagacagaaaaggacagcaagcagcatgcagttgggctgcttggctcaactctcacagccagtgacgctggggaaaggatcagatgaggaaaagtgcctgtcacagtgtctgagataaagtagcatctcaacaacttattaccccatggcaatttttaaatatagaatgtctttcaaacatttttttaaattttatttttaattgacatataatacttgtatatatttataaggtacatagagatgtttcaatacatatatgtatagtgatcagataagggtagttagcacaaccattatctcacacatttatcacttgttttggaaacattcagtattctccttctagctacctgaaacaacatacaatatacttttgttaactctagtcatcctacagtgctatagaacactagaacttattcctcccatctagcttaatcttatttcccttaacaaatctctctgaagtggccattttgcattgtgagctaatattctctctctctctctctgtctctctctctctgtctctctgtgtctcacacacacacacacacacacacacagaattgatacacttctatttttaatatgtctcctgggagtctcatatgtctaaattctgtttcattttgtaagaaatgctgactgagacccagtaaattgatttcctaaccaacaaggaatagctaacagctgtttgaaaaacgcagtcctaataaaatttgaatgttccagtgggctgtaaagggttaaaagggttaatggaccctaaagggttaaagtgaggcactgtgccctaatctggccacattcccatcatgggcattatatatcaacgggtgataacaggactgagttctctttccagtccttagatataaaagggagacagcaattaggaagaaagagagttataggaagtggtaggaattgaagagaaagtagaaaagatcttaactctaccttattaaagtttcatgatccaattacaaaatagatgttttattttctaaactggcattttggtttgtgataacaccacacacacacacacactctctctctctctctctgtctctctatttttgcagctctcttcagaattttctttagggaccctgataaatatacgtgatatatttttaaaaattgaataatggaaggattaagacctggggccctaataatcaattaaaagataatctgatcatgtctttgcattttataggtgctgctttatattctaatttctaatatttttctttcaaggaagcttacaggttcgctatcacctaaacaaggaagaaacccatgtattcaccattgatgcagataactttgctaacagaaggatgcaccacttgaagattaaccgagagggaagagagcttaccattcaggtaccttccttactttctcctgcttcagccaatgtgccttggctactctatcaaacttttctaagcttctaccccatgccagtgtagtgcctagtgctggaaacatagttacaaatcacacttgcccccagacttggaagaactaggatagtggttctcaagatgtgcttcccatgtcccaccagtatcagcatcacttgggaccctgttagaaatgcagattcttgggccaagtgtggtggctcacacctgcaatcccagcactttgggagtctgaggcgggcagatcaagaggtcaggagttcgagaccagcctggccaaaatagtgaaaccccatctctactaaaaatacaaaaattagccaggtgtggtggcacacacttgtagtcccatgtactcaggaggctgaggcaggagaatcgcttaaacctgaaaggcagaggttgcagtgagcagaaatcacgccattgaactccagcctgggagacagagcaagacttcattaaaaaaaaaaattaaaagaaaaaaagaaatacagattattggctaggtgcagtggctcatgcctgtaatcccaacactttgggaggctgaggcaggtggatcacaaagtcaggagttcgagactagcctggccaacatggcaaaaccccatcaatactaaaaaatacaaaaattagccaggtgtggtggcacgcacctataatcccagctactggggaagctgaggtaggagcacttgaaactgggaggcggaggttgcagtgagcagagatcccaccactgcactccagcctgggagacagagtgactccatctcaaaaaacaaacaaacaaacaaaaagaaatgcagattcttgggttccacagcagatctattaaattggaggctatggaagggggaaagcagcaggtgatactaatgtctgctcaggtttgccaaccgctgggctgcattaaagtgaggaagacgcatgggcaaagaggaaatcataataggctgtgggaaggcatgtggtggaagcaggcacaggtgatactgaagagggtgctgatcccacctgggcatcagtacttacttcctggaagaagttaggagtaagctgagtcttgaagatgagtaggagttggccacagggaggaggagagtgctcaggaagagggtccatgtgagcgcaggctaaagctgtctgaaagcatgttgtgtgggaggcaccccatgagatctcagtgggctccatataaagggccagcagcagatgatggcagagcccaacagagaatagacagagtccagatcatcccctttaaaatcatgaccctcagcaagcccttgcatctgcctatcaatcactccatgttttttaatctgttctcctgttctcctggttgaccattttacactctctcctctttacttatactgctaacaattgccagtttgtcttaactctgagcagatgactttgctttcttatttcttgtaagaatttacactcttacattcagaagagaatatccgcacattctcaagagcacattacctacctaccacatgtgtgtttgcactctctctccctcctgaatagttcatggttctagctaaggcctgaccttgctacctgtgggtcagatctgataccctactgaagaaaatcactctagcattctccttcctccctccctttcatcatttattccagctctactgaatggctccccaaagcctaaaacaaataattattacatgcattaagaactaatatacagacaacaatagctaaacaagcaaacaagccagcatatctctgggtaaagagaggaaacctttctcttatctgacttcttacagtgttccattctctttgtccttttcttgcccgaatttttggaaatgttgtttatatgcttgttcttcatattttccctacctttttcttatacccataccgaaaaggtattgcctctgcactgcagcaaaattgtacttctcaaggcatcattgtgcttacctggcaaaatccagtggtcatgtctcagtgttatctttccttgtcctctcattgacaactgacatagggattccttcctgttcttgcaacttgacctaagtctttattgcttgcccaatacaactctcgcctgttgatccttctgcctgtgttagttgctcactcttgtctcttttgttggtttcccatcatctctcaaaactctaccccaaggaactctcagaacgcccaaggactccagcttctgcttttgatctacactcactccatactcatctcattcgatctcacatctttaaatttcatgtacatgctgatgaatcaatcctgaatgtgtatctaacactaatcctgtccctggattccagaccttataccaactacctactgggcatatctatatgaatatccgttaggcattggaatatttaagtaaatagttaaaattgacttattaggaagttctcctgaaacaatgacctcatcccctgcaagcatgtcccagttagtggcagcttcatttttcaagtccatagtttcaaaattgtggtattctccttttatctctccttctcttacatgcagcatctcgtggatcaacagcatctacctttccccaagccacccttgccctttgcttggattatcactgtttacagttgccttttgattgacatctccctgctcctctttaggttccctggctgtctatcctcaacatagcagtcagagtgatcctggtgaaggaatagatcctggcattcttttgtccaaaccctgtcaatgatttcctttctcgtacagagaaaaagtcaaaggtcttccagtggcttataaggatctccattatctgacacccctgctcatttctggttgcttctctaacctcatctgattatatgccctctggaactctagttgtgccactctggcctctttgctatttgcagagcccttggactcactgctttgcctaggatgctattctttatatatactcatgtccagttcttgtacttccttctgcactcaaatgattcaaaaggtcattctcattgaggccatctctgatcagcttatttaatagagcaacctatttccttgacgtcaaccctacacccccccttattcttgcctgcattatttttttctctcagcacttaacttccaatacaatgtatttacttatcaaattttctgtcctgtctccctcctctagaatgtaagttgcctgagaacagaggagggtcgttctgagcagacgtgccaaaggaaaatcatggcaggggagatgggaggactatgtatgagtccctggtggattgcactcaagctgtgcaaagtcaggcacatggctaatgggatcttagtctcctcttcttacaggtgaactgtaaaataatgaggactctttctgggaatagcaccatatgcatagtcagagtagagcctggaagaaaccagtaggatatggctagcctgaaaaagtgagaatgaatggggagggctccctaggaatgggaaggggactgaacaaatggagctggaattagccatgggtgaagtaaggagggatctctaaaggatggtcatagaaataaagtcctactgaagtcccagtgttggcttttgctcacccctgcaagatgggattatcaatcgtccatgttggttgcagctaactgttcagctgccctctcctccccaggaccacatgttttgtcagactgcaatccttgcccaggaaaagctctctgcccacaactaaatgagaccaggtcagaattatgggacaatggggacagtggtggccctaaggacaaacagagagaaagggggagaaatggaaaatgagttcctgcttcctattaatgttaatcttgcacagcaagttcctgagcaggtttcatttgtttgcttgtttgcagcaaagaatttggtgagaaaatctctgtggggagataaatacctataaaacgctgtatacagtttcccagggagaagacttgtgtgaaaacccttatttcacaaagaagaaagaaaggggtattttatgtgcgttgtgggcaaattagcgagacctgtctaatctctcctgagagaaaatctcagaggggggtctgctatctgtatgcattttttcaagctatttccagatgggatcgttttatgcttcttacctgcagacctctgctgatgtgcctttgttttctgttttcctgcagatggaccagcaacttcgactcagttataacttctctccggaagtagagttcagggttataaggtcactcaccttgggcaaagtcacaggtatgttgttctagttcatacctttccagtgggctttattaaaataaatgaatgcataattttcattagggtgtttaaggattcaggtctggagccttttgctcccataatatctgagatctgaaaccaagatttcttattcagaaaatgccaagatgtatctgtggcagaaataggcaatgcatttctatctactttataaaaacttgcaagaggtaaaatactaaaataatttagcagaatacttaaatttttacttaattttcaaatatatttttaagttttacttaattttaacttaaatgtatgagtgcatacattaaggatttgagcaactcaatagttcatcaaaaattttaaaggcattgtaatttcctattataatagtgaatctttttttttttctattggaagttctgtcaattttcactttatatatgatgacagtattcattacatgcatacaagatagaaattttttatctacttgatgaagtgaacattttatcacacttaagtgacctttttaaactttagtaatgtctttttatgcttaaatttattttgcctattattaatatgcctattacaactttgcttaacttagtgtttgcctggcctcttttctcattctttttctttcaatttttccttttctttcagctttgtaggtgatcttgtgaagaacatactgctagattttattttttatactcaactgtccatccatttttttataatggcaaatgtaggtccttctacattgtggggctacttgtaaagttggattttgtttctgctacccgatttcctatgtatccagctcttcctgtgattctatcatattctttctgactctctctctatcacagtacaatgcagaaaacattaataactcaatgcatggtaagcagaaatacatttaacacgtaagttagttgcttacaagattgttgtagtacttacagtgtgggttctttttggggtcttttggaatgacttcctcgtgccccatactgtatgcaaattcacaggtagaaggaggaggtatctgaaaaatggctgtggaaaaagcatcacgggcccctgcttttgcttgccagtagaaagagctgaaaaggcataaaaatgattcttgctacagccctcaagcttcataaagggtttataatttccagatgtaatgttgatccagaaacctagctgaagtagggtcaaaaaaatgtccattttagttccccaaatagcagttggaagaaccaatcaacactgatccctgattgagtttatttctgattccattcacagtcctaataataatcatttttatatttttcagatactgcttatttttgatttattaatatagacactagtttatacattcctcatttcttcctgtatctcagacttttctatcttctgccaggctttatttccttctttttaactaaattcttttgaattattttctgtttaaggttcccttcattatacatacatatacatatttacttacttatttatttattttcctgaacaaaagttttattttacctttaatcttggaagataattttgctagatcttcaatgcaatattgaagaatattttctctcaggtactgagaaatcagtcagaggtgtaacggagccagtggcactggcctttaagaaccaggtatacatgtctctccccaactctgcatccttcagtggtggcaggatgccagcttgaaatcagctgtagtaggagggtttacactgtggatatcagaaatgctaaaagccaggactttccctacctcttcctactgaagagccagtttcaaagactcactggcacatcagtgtcctcttgttttctggcttccccggttgctaccaagaagtccgctgtccatctgtcctgctattgaaggtgctctgaccacctccatacctactacttacaagttgatttaaagtcatccttttttctttgatgttttgcagttttgtcatcacgtatctgcttgtagatttctttttaaaatatcttacttgatatttttatgtttcctgttcgctatgtcatatgtatctatgtatccagttcctatttattattcatatgtatctgttcatcagttcttaaaaattctcaacatatcaaatcttgcttcctcctattctatctactcaattcttctagatctaaattatatgaacttagacttgctaattctatcatcatatttcttaccctctttttatagctttcattctttgatataacatcttgcattctgggcaattcatttggctttagcatcacattcactagtcctctccttatttaggcctaatcccattcaatgaatcatttcttattgatttcatctttcatttctaaaaataatattttgttctttttgaagcatggctattaataaagataatttgttgtctctgttcttttgtttgtttccatctttttatgtatttaggcatttcattaatagttattaaacattttgtctctgataattccaacatctgaagtctgtgagggtcccagtctgttactagctgttttctaaatttttcctgtggtaacttgtttccttatgctgtgtgtgtgtgtgtgtgtgtgtgtgtgtgtgtgtgtgtgtgcgtgcatgtgcgtttgttcatattgattacaattaatttgtgacaactctaaggatcaaaaattaagacactctcctcaaaataagatttttttttttttaacttctgccaggtgccaggaggtactaccaatttaggacaattttaatttctcactttttttttctgaacagagaagaaatataaatttgagctccatacctgaatgagatcagtcttctggttgaagtcttagcggaaatgttgttactattaatatcattaaccaaattaaaacacccttagaaagagggaaaatgtgggcttacggaccacaaagcccagacctttttcatggcccctgctctgtgtaatggaagttccaataataccctcttgttaaaaatgaaaaaaaaaatcctcattaaatcttaccactgtgtatagcattcatatgacccttcacacttttagctaagccaacaataaggctggtgaattgaaactttacagcaaggtactacagacaacttgttattttatttctggtgctttgtaattatcaggtagaaaagaactgttaagattgaggaggaatactgtattagtccattttggcattgccataaatacttgagactgggtaatttataaagaaaaaatgtttaattgacttatggttctacaagctgtataagaaggatgatgctgtcatctgctcagcttctggaaagcctcaagaatcttaaagtaatggcaggagacaaaggaggagcaggcatgtcacatggtcagagcaggaagaagagcgaggaggaaggtgccacacaattttaaacaattatatctcaccaacttactcaccattgcaaggacatcaacaagaggatggtagtaaaccattcaggagaaatcctccctcatgagccaatcaccacccaccaggtcctacctccaacattagggattacaattcaacatgagatttgagtgaggacacagatacaaaccatatcaaatacccaataaaatgtcttcattgttctaagaatgggagacatctgctcactgggctgccttcccatttgaactgccgttgaacagatggaaggattttgaccaacacttaaccttaacactctggtctatgaaagttccctagcagaaggtaaagggagacaatatgaacattcaggcttattatttagaaaggacgctaatcctgggggacctttggaacaaggaaaccaaaccctatgtatcagaaatagagtaaagtagggatggagaaaacaggaagagatggtattaaaatggctacatggaattaatgataaatgcaactgaacttcacaattttagaaaagattgctttgtaggacatttccaactgtaaatcaaacactagaaagcatttttcatggtagatatgaaaagaaaacatacgtagtaaatctagtgtctcagttttcttcagtaccatcaatagcatttcattgcaaagcaaaagcaagtttgttcattttctttttgtctgagaaaggaaaaattccttactaaagaggactgtggtttagtacatactctataccagccacggtgctacagatactgttataaataaagcagttttttgtttgtttgtttgtttgtttcctgaaggtccccatgatgtagatactggcccatgaaaaatagcagatttaattgtgtacattaaaacttcactgttggttctctaagaatgttgatgctcaaatccatcaagttacgggatattgcaaggtttattctttggtttactgacatttcttaactttcaagagagattacttggttctggcctattgcatcagtgaatttaagaaaaataacattaaaagagagagagagcacatatttagggaagtaatccatttggaagagataatgtttctggaaacttgcttatttcatttgaaagtatagatgtgtatgcctcagattcaaacatagtgtgctttatcactgttatttctaagtctctgtttaacttggccctgtcacaagagcgtagacagccaggcagacataggaattgaaaaaacttgaaacttctgaaagaaactctgccttttttgtttttaatttattttttttctggtcctgttgtccccttctttactcttctaaaatatatcaagaaaatttgatttcaaaacaaaaactactattgtttggtgaaattaagaattaagttattattattatctcttcttaaagaagacttcttgccaatctgcagaattaagaagtagctactttttaaacatatggaaacaggttaaagtttaggtggaaaagaattatagtactgcctttaaactattgctaccaaattctgaagagacattaaaatggaatttgcactcatggcatgctgatagcattatttttttatgcagccaacgtttgttaatctcctacttgccagtttgataggcctaagctcacacctgacagaggcattattcttctgctccaatggctgtttgcccatctagatttcaatatttacttgcctcaaaaaaaatacagaaattgaaagaatttcttctcaagatgcataaaatttacagctaatctgtaaattgcagagctatctgtgagcacttacacatgattttgacatgttaaaatgagttctgattgcatctatagaacagggttctttaattctccccaatccctcaggtttaaactttgagcctactgtgtcttgtccaacattacagtatcattgaatgaaaaccctgaatgctttcacataaaatcactttacaagcatcttgcagaggttgaattatggctgccatttatagaaagcacagaagaatttatgcatataaataaaaggtgtgtacttcaaaatgctcactttggaagactgaactctaattcctttttgattttggacacagagccttcttatgattcaaatctgggagtcaatgctaaaccaggaagcaaaattctacagtggaagatgctcagctttttggagacaaattgacccatgtttgcatctctcatgtagttaaccattgtgtgaccttggtgaatttatctaacctgtttatggttccttattggtaaaatgaggatagtaatacttaattcatttaattaattcacagagctgtgtaagtatttcttgaagctttatatgcaaattacttggtatttagcatatactcaagaaatgttggcttatttttttctttactttcaaggttgtagaaacgtaaaagagaaccatgagggtttttttttttttttttctgttttcttttttgttaatgtgtctgtcaaggtgactgtaagtgtaacttccagggaggtgctcaactgtgctccaaaagagcaattctgaaccatggtgagtcatacagaatctagtgtgactcattatcaattagcactgtttcaagggtgtatcaaactcataccagcttcaacaataacaacaaaagagaaaacaatagttggtgaaaatagaagtttcaaggtgtaagatctgcttcaggtacagctggcttcagaatctcaaatattatgattcgggtttttccagtctgtctgtttctcactccacatttgactgcttaccgcttggaggtgcttcatttgcaggcaagatttcagtggtaatgaaggtgaaatcatcaactccaggtttaagtagcagcagttcaacattccatgtggaaagaaaacctcccacttttaaagttccagaaaactttccttatgttaagtcatgggattgagttttcaaggaccaatcccagaccatggcagtgttcaggtgattgggatctactgcatggccatggccaaattattcacccagctatggctgtgaagagagtggagatagttcagcgttaattgcatgggttgaaaacagggaaaggctacttctcagaagcaagttgagctgttcttaccagagaaagagaaagatcaacaatgatctagtaatgccacctcttcttctcttttgcattttgctctcccttttttaagaggagagaagagggtgcagttatagccatgggctaggaattgtggctcatttggggaaaggattgtgccggtgtgcatcaacagttcaaatatgttgcggtatgaaaaataatagttgagctatgctcttttaataaataaatgcatgtaatcttctttagaacaagtttatagcttccaaagtgactcctctaaaagattatttcattttaaatgcataggcttctcaaattatatttcattttgtttatggtcatacatagttctttagtaaatactaaatctccaaaccacagcctttttcagactcaaatcctcacattgtgtgtaattgctttatattttgtccagataatttttaatgatactgtctgtttgggtaataaagtattttagattcgttaatctaatttgaccttccgcatcatgaaataaatggtgtgttttagagcatcctgaaatatcagatgtcagtaatcatcctaacttcccaaacacgcatgtcttatattttctactttgtagataaccagcactgaattgcaactgggttagatgggatttttgttatttttttcctttaacaataacaagttacattttttccccacagagaaattcagtagatgatttagtttctcctcatgcaacaggaatgtgtgttatcttctgatttaagatgcaattttatttctgtgtgttaaatgaatcacctcatgatagcagtgccagcgtgctccatgctctgcactgctctgtagaagttgtctgttttttctaagagtgaaaccactctatgaatagcatgcccttgagttactcattttatatcgtcacttgcctgctctgtctatactagtgactaaaaaaatgaatgaagtaaaaatatcaatgatatgttgtttccaaatgcagactgtcttcagctgggaggagctgttagtaatctccttctaagaggggtggccttcacggatttgccagacattacacatctttgcctgactgtgatagtgaaggatgttttgtgtggtggcccagaagtcacatgacatgactctcattgatataaacttcaaattcgttctcaagcaaaaactattgagcattactatggccacacaatgtgtgaaacaaacaaatataacagcaaaaaaactgtccttgttctaaagatcttgcttatcttaaaaattaattctttcaaaggaaagttatttgggtgggatctgttggtagtattaaagtttttcaaggttttgaagtatcccgtgtaggctatgctaaatattagattttcttcactgttacaaaataatagtactaaaaatggtataatatttatagcatgctaataccaatagtatcataaaactagtagttactgttagtattattatttcataatatctttctgtatgctaaatctaaactcgttccttatgctaatttatttttcccctggtcattacccagggagataagtaccattcttatttctatttttatagatgagaaaattgagtcacagaggttcagtgactttctcaatatcacataaccagtaagtgtctggattccaagctcctaataaatcctgccacagtttggtttttaaggaatgatatgaaaatttcacacaatgcacagttcatttttctgctgagaagctctgcatcaaaagtttgtctttttagacttaatgggcttaaaagtagaggtagagtgagggagtctttaatcatggagagaggatgacacatttcttgtaagtcaggctttggaatcagctctgggttcaaattatgacttcaccactgactaatgtgacctggacaaattactaaatattccaaacttcagtcgtctcaattagaacacaggtatatgttattatgacaattataattccaaaaatctggtggtaatgcaaatgatgtgcctaggatgatgcctgccatttaataacagctcagtaaggtttgtaacaccagtataataataatataagaagccacttcatccaacctagcattttcccttttggactctaattgccttccagctaaaggtatcctagtctttatgtaacaaagcttaaattttactcttctctcccactctaggggaatgaatggataaggcaaggtgttaacatgactttaattgatgattggtaaacagtggaggtggtagtgtggacaatatatttttatttttttatttgttgttcttttcttttttttttttggagatggagtctcactctgtcacccaggtgcaatctccactcactgcaacctctgcctcctgagttcaagctattctcctgtcccagcctcccaagtagctgggattacaggtgtgtgccacctcgcccggccaatttttgtatttttagtagagatggggtttcaccatgttggccaggctgatctcaaactcctgacctccagtaatctgcccatctcggcctcccaaaatgctgggattacaggcatgagccaccacacctggccaataatacttttgataaaatcatctgaaaagagttaactagaccaaaacccacctgaaattatttaaacttatttcctcaggagtcaagctgcctctgatgggttataatcatgttatactttgtgagtcagtcaagcttaaaatcatcaaatccagtccgatgcttaaacaccccagacattaccactgtccctctccacttctcagcatggggtagtcatgaggttccaaagacaagaccccagcctcatttacggttttatcttccctgctactgtattggcagacacatattacatgttctataatgtatgttgaaggaaaacacacacaggcacatgcatgcacacacatatatgtataatgtataaatattagaactgtggttacctgaaaggttatcacactacccatgactgggcccaatgttgtgcagctagctgcctcccagacttggatgagtatctccagcttcctcttacaatgtatttttctcacgaatgtgtgtggtagtgagatgggaaatgaatgggttgggagtcagacagtgctgagctcaaaccatagaaaggttgcttcttagctctgtcatgactaacatcacctctctgagccttggtttcctcatctgtaaagtaggagtagtaatacttgctttatttatttgttttgaagatatgagataatgcctgtgaagtgtctggcgcttagtggtatttgaaaacagcagctactgttaataagatcatacaaccatgctgcctattgattttctttgcctgatatccctcttccttgccgatggctctgctattgatttgtttgccctttgcctggggaatctgggccagtgttataaatgtcaatgttgacaaggtaatgaagtaaaaaggatccaagctaagagtaatgaactccctgcggcggccttatagggacccctctgaagcttggtgagaatggaagcactgtattggccagaagctgaaagaaacaagtggaacaagcacagattagaattctaggtgctttcccacacagaaggagagggaattgaggctcgaggagtgttgtgtggccactggttactcatttagtctaccaagattttatttttgcaggatgccattaatgataataaattgagttttaaaacagattaacataacgtaaagctcactgtcacttaggaatgattgtatatgccatttatccatttctaagaatgatttgacctgaatctgtgtatttttcctttacacttgcacaattatcattgccagtgatcagtgtcagagctagggtcttgtggttaatattctaaagttctctgcctttttcttgataaagaatcacatggcctgcttcttagtgaggaaaataaataagtaaatcattctacctaggaaattctagttttagttaattcccttaaaatcaactgctgcctactctaatcaactctaatcaatcatatataagacttgaatatatgccttatctttctcacttattttcttacctttttcttcaaaatgattccatagaatataagccttgcacagagcatgcctcccataaaagataaacattatataaatatttggaatcagtaaattgctccctaacattgtttgtagataattcattgaatgcattattgaatacctattatatacaaggtgatataataagagaaaatatgaaaactttaaagaagtaaagcctatggatctttgttcccaaagtgataaaacaagtatctgtgaggataagacatttatttaattaggatataaatagttttgataagtgctttacagatggagtgtgcttaatattcataaaaagaagagatcatttctagctgagatgacccagaatgttattgtgtggaagatcaccttgactttagtcctgaagcacaggtttgacctcaatagatggagtacattccaggaaggaggaatggtgtgaaccaggtaagactgtaggaaaacaaagatagtaggatagaaacagtaaataggccatctgagagggtttcatacatgcagcagagtagagggagacaagggaaacaagaacagtccattgggagaatattacagaggacatccagtgctctgcaaaggcattcagaatctattgtgtagagaggagagagcatggaaaggagctctcgtggtcagagctgctgttatcagactctcttgttagtaacaagcaagatagaggaaagagagactggtatgcaggctatgctaatgcctaacctttggatacgaaagagatagcaatggaacaggggagcaggtgcaggtgcagtttgtaaaataagaattggaagatttgggtaattcactgggtaggtgggtggcagagtacccagggaaggaatggagaggacaagaggaaaggaaattacagcagatttttccagtcattacagagggaaataaattcgttctggtctggcctgagcccgagtttactgacttggggcataagttacaatggattataaagctgataccttaccctcttcctttgagccagctctccagtcctgctcagctgcttctggatttgagaaatccctgtcatcaagaacagggggaagagaagtggattggattgctgtgaggagagtccagttgggggccttcactgtggcgatgtccacagtagtccacagctgcatgggacagatctctcccagccttgaattttttaccattgcctgacttgtatttcttatctgtgtatgtagctgcttccttgggaaaagtgtggtccttgaaggcaggaacattttgttgtcaatattcttatcactcccactttgaaacatgggcctttgtgctttgtctatgcttctatgtgtttcataatacacttcttctgattagtaatgcatcacaggtggtagacatgttttcaattcaagggggaaatgcttgcactcctattcctgattttaggatccctactagtgtgaccagtcatgctagtctactcaagactgcgggattcccagggatgtgggattataggtcctaaaactgaagcagtcttaggaaaaccagcacagcctgtcgcctaagccacactcagttcaggggttttgaatagtttaatggaactggacccagggctttgaatgccagatgaacaactgagtttcatgctttgcctagccacagctgagttcaggggccaacatccctgaggatatgctgtggtttgaataggtgaggttagaaaggagcgagaatgaaccactcagcccactgaccagcactcactgagtctctgccggggtgcagcatagagcaccaggtgtgctgagatgacaggaggggggtgtgggattgtttattcccttaaatattcagtgccctgggtggaaacccaaaattgtgtgcaagcagtaattacagaacaattgatctttaaagcatggaacttgtattcaaagggcatcattaaaagactagagaaaggagaaatcagaagtaaaactatgtgtaaccaaggtcctgtttccctactgattttgggtggaaggccagatcttctctatgaaggatgacacactctgtctagcgtatgcagagatgctgtcttcatcagagagaagtcctgcaaatatgcacatttcagatgcagatcacatcagctgctttaggtctgtgaacaggaagttccatatgtgtacgtctgttttcacactgctaataaagatatacttgagattgggtaatttataaagaaaaagaggtttagaagactcacagttccacgtggctggggaggcctcacaatcatagcagaaggtgaaggaggagcaaaggcacatcttacatggaggcaggcatgcagtgcagaaggggaaaaagccccttataaagcaatcagatctcatgtgaactaactcactatcacaagaacaggatgggagaaactacctccatgattcaattctctccctcccaaaatacatggggattatgggaactacagtttaagatgaggtttggttggggacggagcctaaccatatcaatatatatcatccattctcttttttttttttttttttgagactatctccttctcttggccagactagagtgcagtggcatgattttagtaacctgtgcctcccaggcttaagcagtcctcccacctcagcctctcaagtagctgggaagacaaggtcatactgccaagtacagctaatttttgtattttgtatagagatgggctttcaccatgttgcccgggctggtcttgaactcatgggctcaagcaatctatgtgtctcagtctcccaaaatgctgggattacaggtgtgagccactgtgcccagcctgtatgtgccaattctaacaagagcttactttatattgggagctgcagaggttactttggcttgaggtgggagataggggctttggtcatgtgtgtgggtagagtgcttctcaaaacatgagtgaaacttttatacacggagacaccaagctaagctttcagagtttaatatggaatttccagtttaaattatcttctttataactctgggtatagcaatgtttttttgtgtgtatacatgtatatgtatgtccatgtgtggtgatgtacatcctggtacaggtatgtatgtgtacgcatatgtgtatgtttgcatttgtccatgtgtgtacacatattggtacatgtacacatatattcgtgcgtgggtttgtacatgcatgtatatgcatatgggtgcatgcttgcatatgtccatgtgtccacatgcataaacacgtgtgggcaactgtgtgctataactgtattgtatatatgtatatctggatatctatgtttctgcgtagttgtgtatatacatatgtctgtgtgtgtacaggcacatgtatatgtgtgtgtgtaaatgtatgtctgtgcttgcaaatgtacatgtacacatatgtttctttctgtatagtgtctgtgaatacatgtacatgcatgcccatgcacgtgcatatgtgtatgcatgtgtgcatgcatgttccactctgtgtgtatatgtgtatgtgcatatctgtcatgtatgtctgtgtgcatgtacatgtgtgtacctatatgtgcatatttctatgtatatgtgtatttgaatatctgtacatgcatgtctgtatgcatgcacatgtgtagtcctgtacacatgtatgtcagtgttttgcatgcatatgtatgtgtgcattcatgtttctctctgtgtgtatgtgtatgggaatacttgtacatgcatgtctctgtgtgtgcatttgtttgtatgtgtatgtgcatattcctttctgtgtgtatgtatgtattcatatctggacatgcatgtccatgtgtgtgcccatgtgttttgcttcttttctgagtagtcacatttcccaatttgctttttctctgttatatcatgtgatctctcattcttgctagaggctttactcatgcttctgatgatcttggactgtgctcatgtttcaaaaggaagtgtctggaatgcattgccttggagccaccctgaagagtagggctgggcctttagttagataactccaatgtctttatctttagctcatttatcttgggacaggcacatttcctataaaaaaaactttcccatcgcttgcttagagagaaagaggttctgaaagtcgtagtgcagacaagagctggtggatgtcagggtctactaggtaaaagtccctttatgtctcattttttggtgagcacccttgcctcatctatcaacattactctcacctacctgtaataacccctcagtctcatagcacttctttattcattttccaagcagtatagttatttgggggatataaagggtactttttcgaactattttctgtttctctaagattgctttacttgcgagagaattgctgtgaagctggctgggaaagaacaaaagacttttggatgctaagtcttctaaatgtagaacccactcatatcagtcagggttcaaccaatggagcatgactagtaggagataatatattgagatttattgcacagaattggttcatgcagttatggaggccaggtatgatgtctgaaatccactgggtaggccatcaggaagtgcagctggaactctcaggcatgagtggaagttgctgcccctaggtggaatttcttcttctttgggaagtcttaaaagccattctgctcataaggtcttgcaattgattgaatgagacccacacagattatctaggataatttcccttacttaaagtcaactgattgtggatgtcattcacgtttacaacatacctttacagcagtacttggatgagggcttgattgaataagtagggactatagcctgctcaatttgacacatcctcagaccattataataccctctctttattttttattgaagtgaaacgcacataaaattaaccattttaaagaatacaattcagaggcatttagtatatccacaatattttgcaacaattgtttctatctagctccaaaacattttcatcacacacacacacacacacacacacacacacacacacacaactcagtacccattaaacagtcacatctcatcttcacccctcctcttagctcctggaaaccactaagctgctttctgtctgtattgatttacctatttgagatatttcctataaatggaaccatacaatttgtcacattttgtatctcacttctttcacttagcatagttttgatatttataatattgcagcatgtaacagtactacattcctttgtatggttgaataatatgttgtatgcatatgtcagggtgttttttaaaaaatctattgtcctttgatgaacatttgaattgtttccatattttggctgttgtataaatagggctgctgtgaacatgtgtatatatgtatttatttaaatacctgtttttaattatcttgggcatatctctgggaggggatttgttgccttttgaaagccattaacacgcgagggctagcccagtggaatcaatcaaggaaattgtatattacaaactgtgcttcccacactcttaccattctccttgtcaaaacaaagagatacttaaagatgattctggttggatttattcttttaattatcctacatttgtgtatccaagatcagggatgccacactttaccctatcaattctcaaatataagttaatgaggataaggataatcatggggtaacatcccaaggttattctctaatatgtggttcaaggagattttgttaacaactagacttggggcaagtggtggaattggaggcaggagtgtctctgcactcatagagcactgtgacagtgagcagctgccttacatctcttggttgcaaatctatcctctttgaaatgtcagagactgccagatgatctttggagtttattctagttttgaacattatatgattttgtgatgcatgaaaatgttatgaactttggctttgaaaattctgatgtcaaatctgaccccaaagtcatatttcatgctactttttaaaaggggagaaaaagagaattgaaacccaatttgctgacccaaattgataaatttctgggctgcaagcaaacctacttttcagtaggtgatgaaaaagaaattgagcttgatgatatttacagttaaaacagtaacatgcatttaataatcacatgtaaacacaagtgtgaatatcttatgatattttatacttttatcctgtggaattccaaactccccctgcttacctcaccgggaggcatagttccttacctttataactgacacctgtgcatgtactgaccacatgtcctgggcttcccatggaagtgctcctttcattgactgctggctgcaaacacatacccagccactttgactgttaatgagctctcattctcatttgaaatatatcattacttctgtgtgtggtcatcctggatactcttaatctttttcctttttcttggcatagtgaaaaaaatatggaatttggagtcttatgccaccaacttccattgtagtctggactctgaagtatggttgttaagtggaccctgaaatctttttgacagaaattcctaatttatagtactgtggtgactgaagctgtgtaagctcttagttccaactttgagtcccagattccttcaacctgcccctcctaaagtgtggtctttgaaggcaggaacattttgttgtcaatattcttatcactcccactttgaaacatgggcctttgtgctttgtctatgcttctatgtgtttcataatacacttcttctgattagtaatgcatcacaggtggtagacatgttttcaattcaagggggaaatgcttgcactcctattcctgattttaggatccctactagtgtgaccagtcatgctagtctactcaagactgcgggattcccagggatgtgggattctaggcctcagttttcttatctgaaaaccaggaatcatcatagcaacctaccagagttgctctgaagattaaatagctgtgtatgtatgtattatatgcttttacacataccgcttagtgcacagtgactgctaaatatttaggtgccatatggaggcaattatagctggggaatctgaaaatgaggatgaaagaaggaactcctgtgaaattcattctagaaagaaaacttggcagaaaagaaacttcacacctcctattctctctgttttaccacattttcattcctggcatgggagaccccgtgtacagcctggtcttgcagagccaggccctgtaaagtcaggcagtggaggtggaatgggacagacaggcgagtccaagacctgaaaagccaggattgttttttgttttactttatctaaaatgcaatgagaagtcatcaatgattttttttaaagaagattggtttctttttcttttttaataattttaacttttataatattttagatacagagggtatatgtgcaggtttgtcacttgggtatattgcatgatgctcaagtttgggatatgattgacctcatcacccagtattgagtatagtattcaacagtgagtttttaaaccctttctcccttttaatagtcctcagtgtctattgttgccatctttttgtccatcctaatgtttagctcccacttattagtgagaacatgcagtgttttgttttctgttcctgtgttaattcattcaggataatgacttccagctgtatccatgttgctgcaaaggacttgatttcattctgttttatggctgcatagtattcaatagtgtatatgtaccacattttccctttccatccaccatcgatggacatgtagttcgattccatgtctttgctattgtgcatagtgctataatgaacatatgagcacatgtgtctttttggtaaaacaatttattttcttttttaatatatacctagtaatgggattgctgtgttgaatggtagttctgttttaatatccttgaggactctccaaactactttccacagtggctgaactaatttggatttctaccaacagtgaataagcttcttcttttctccaagcctcatcaatgtttgttgttttttgactttttaataatagctattctgattcatatgagatggtatctcattgtggttttgatttgcatctctctaacaattagtgatgttgagcattttttcataagtctgtcacttgtacgtcttcttttaagaaatgtctgatcatgtcctttgccctttttttttagtaaggttaactgtttttagcttgctgatttaagtttcttataaattctgaaaattagacctttgtcagatgcatagtttgcacatattttctcccattgtgtaggttgtctatttaccctgttgatttcttttgctgtgcagaagctctttagtttaattgggttacatttgtcaatttttgtttttgtcacaattgcatttgaggatgtggtcataaattatttgtcaagtctaatgtctgaaatggtgttcctagcttttcttctaggattcttatagtttgaggtctagcttttttttttttttttttttttttttttgagagaaagaatctcgctttgtcacccaggcacccaggctggagtgcagtggcaaaatctcagcttactgcaacctctgcctcccaggtttcaagtgattctgctgtttcagcctcccaagtagctgggactacaggcatgcaccatcatgcctggctaatttttgtatttgtagtagagacggggtttcaccatgttggtctccaactcctgacctcaagttatccgcccgccttggcctcccaaagtgctggaattacaggcttgagctaccacacccagccttacatttaatctttaatccaccttgagttaatttttgtatattgtgaaaggtaggggtccagtttcattattctacgtatggatagtcagctatcccagtgccatttattgaatatggagtgagataggattcttaaatatagcattttccttgtgttttcctagagagctcttttctaagctcttttctaaattttatgcttttgattttaatgtaaaatatttttgtaggcattcactcaagtgctcctttatgatatagctggtgtttattgattaaactaaaatgcaaacacacttcttgtctgttagtgctaatgccaataattgctatgataaaaatagtagcaagtgcttttgggttttattattatttcagataaggtttgtcctctggatcagtgatttttttttgtttttattaaagtatttgagtgatttaaaccaagacagtattatcgccactgttatatgtgctaggatgctgggaataaatatttcaaagacagtcacatactgtcattttttagaagaattactgagttttagtcaactggcatttatttcaccaaagctatttatccaactctattgacttatatctgtaaattctataggggtagaactttgggagtattagaaataatatacatagattttaggagaatagctctttagatttattatttttatcctgatttgagaggtgagaaaatccatgttcagtatcttgtccaagctttctctagtacatgctattggtgctctatcatagcccctgactttaccacttcaataccagctcagttacaacctccacacttgaaattttgctaaaatctttctctggtcatagaagcttgttttccctatctatatggcaatccggaagtgcccaggttttgcttcctcctgggaattatcttcagccaattataatgtgagctgatgcattaatatcttagctccctcaccatccatagagataagtctgattgtgttcttcactggctcctggagttttcctagtgagtttaagctctcgttgtccagtgctggttggttcccttaatgtttccttcccctccttatctctgccaccaccctatcagtgctttcttcacttctcaaataaactacttgcactctaatgcctgccttggtatctgcttcagagcaaatttaaactgtaacagtcaccatccattcgtcaattggttgacgtggtgtgcaaagccagatttgcttgatgccaacaatatgtttattccactatgtgatgtagccttaaataaaaggcatataaggcagaaaccccatttcgtagagcttctaattttatatagacaatacattagtgcaggaaggttgaaggagtaataaaaagagctgaatcaaagtaaaatgctagctgaaagactaattagaacagccttagtcataagctggtaagtgtatagagacatacatgggtggggagtctccttctaccgacagacatgttagatcttagaatatagtgtataaacaagtgctgtgtatttaccatgtgccaggcaatgagctaaaaagagctttaccttcattattacatttaatgttcacaaaaaaagtatgtggtagaatctattgtggtgtattaaaccacctcataatttagtagcttaaaccagtatccattttataatatctcaccattttgtgggttagaaagttaggcggatcctactagagttcttcagctacttgtgacattgactaagtctcagttgctaggtgatatatggctagtggctgggatagtctggaggatctaaatgaatttgctcacatgctgggtgccttgatggggatatctgggggctgagctcagttggcctttcttgctccatttagtctgaggacctctccacagtctctctagtaggcagaaagtaccagccctcttgaaagctagtctcagaactggcagggaataattttcaatgtgttctagtggagaaagcagtcacaaatcagctcagattcaagaggaagggaaatagaccccatcgctcagtgaagggcgtgatgacgatgatgattactgtcctttttgatctacaatatgcaggcactatattcatccccattttataaataagaaaattgagcccaaaagatatcatgtaatctgtccaaggatacaatgttaatgttgaaccctggaagtctgattccttggtgataaaaacctgttctaaaggggaaactgtgtacatatttaattgaaggcaggtgtagagaagaagaaagtttatttgttagaagagagttgaggcagggactgcctatccagcattcaatattcactatctttttcttaattaaatacagtggtgtttatggtttgttgtttttgtttttgaggaagtaatattcccaattagaaacagtacatttcctagcctccattgagttaataatggccatgtgacattgtcctggaccatgtaccaaaagcagaagtcacaagagttttccaattggcccggcttcacaattatgggcccttcaccgtccctgctttcttctccctggaacataggggtgatggctagagcttttaaagtcattaaggctatctaaggctacagtctatggagagggaagtataagtctagaaagaattctgggcctctgatgatctagaagcaagataccaaccttggactgcctaatatcagacttctcattaacctcaaatgaaataaactctgattttctttgagccactgttttcttcttgatatatgcagtcaaatgtaaatttaacttatgaggatgatttatgtttttgtactttctggaatcagatggagaaactgggaaggaaatgctacaattatagcaaaatcaacagctgtactagaagaacaatgatataaatttccaagaactgatgactctgtgagctggacaatcccttaggggttccttgccctacagaaaagtcagtggatgaatttatgtttgctcacatctgggtcactgaaaccagtttgagctccattatactggcagccacctcatcatgtagcaaagaaaaaaattcaagagacaaaacaagaaagtataacatgagttctgaagcaagagctctagataaagaattctgtaggaggcagagaagggaccgttctctttaaactgagctgggcgggaggttttctgcaggtggaggcttctggactgggccaagccctacaggtgagtgctatactgtaattgtggcatgcttgcttgaagagctaagcaggcaacctttatgcagacacaatatccaatgttttgttctcagttcgacctcaattagtatttaccgaattgaatttgtggtgtgatttgaagcgggctgcaaaacacactagttccaaaatgcctcctatacagaaatcccagaaatatgttttttctttgcatgaaggcgttgaagacttttaaaatataaatatgctgtcttgaagaagagcacagtaagcgatcatcacgcattatcaccttattaggttgccagtcagttaacaacttgtttcattaggaaggaagggtgtttgactctctgggatgggcaaagtttgctgaagaaggttaataagttcggggggaaaatgattgctaaattatgaaaaacgtgtatagaatataatttaaagattcattcactgggagcattaacaattacaaaaggaagccagtgtaccatcctacaggctgggactgggttcacagaggctgggttcaaatctcagctctgccactttctggctgctattttgggcaccttatttaatgtcttttgtttccatttctttgctttaaaatgggcagagtaacacagaagatggtccagtgtcatcaggcccttaaagcagaatttagtgcacattagagatcgatttgtgagaaatattatgcaaacagtcttcattttactcagtacagcaggatggtaaaactgaccacacaagctgaaactgggtaaagcgatcttaataagaactatggtagttccatgacctttaaaatttgtcatcaaagcagtgtgttgtctttccatgtcttaatgctactgtatgccatttctctgcatgatggtgtacttaacctggtggaagctccataattagtgtctcctagtattattatggagcaataactacaaagggcatcctgagtggaatgtaatattgccttgtagtatgagataacctgctacaggttagaatcagaatgcaggagacttggcactaaaaaacacagaaaggcaagtagcactggatactgtatataatggtcacctgtgggaccattctttttttaggctggactccagtcccagagaatagttccacttttccaaattgataacagccaaatttaggtcattcaacttaggctctctggatctttatagaggccagtatacgactcatcagaaataactgacttttaaattgtaaaaagtgtatttcataaaaatgtatatgataaaattacatatatatattagacatcagaatatgtatagcagttagatataactcatcaaaaatgaccacattttaaacacatacatcatatgtgttttattacatatgtgttaaaaaatctcacttggctttcaaagatgggcttacatgtgtgtaactgactgttggttgcctacccagcatccattttgactccctttcctttaccaagagtgctgttacttgttttagaaagacttttaacaaataaaatttgcaatatgcttacatctgtaataaaaagtagataatattaagtcactgaagatgcccagtatggcttttacatttttttggtgttcttaacttcacaacttataattcttcattggagtaggatatatttctatgattaattttaagctttgctaaaaaacctctcttggaatatgcagtacccttgtcttgctcatttcctttaataaagtaaacaacatagctgtaaaccagtacacatgagtcatttattctgactccacatcaagtaaataatgaacaacctaggaggaattatttttgtttctttcagtcccaaagaaatgagattttatatcaacgtgcaaatcctgctgttttttattttcttttttctttttcttttttttttttaagacaaaatcttgctctgtcaccgaggtgggaatgcaatggcctgacgatggctcactgcagcctcgacctccaagtttcaagtgatcctcccgcctcagccaactgagtagctgggactacagaaacacaccaccacacctgcctaattttaaaattctttatagagacgagtcttgacattttgccagggctggttttgaactcctgggatcaagcaatcctcctgccttggcttcccaaagtactgggattataagagtgagccacagcacctagccttcaagtcccagtcttaatgccaacaaagtgatttttatataaaaataagcagaattggcattaggagtataatacctaggagttttaaatttggttatgtagctaaggttttactgattcagcactcactgtcttacatccatccaggggcctttacataatgcatgttatcaagaaacccaattaaaaagtgaaaaattaatttagccaggtagttagtgttcagttgaaataatgaattctcaaatggtagaaggtttgtttactgaattgacttggttatattttttttacttcttgtatcattaatatctacctatcatctatctatttcttcatccttttatctgtcagtatgtgtgcatttttatataagaagactcatggaagacctgtgaagtgccagaccttatgcaatgtcgacccatttgatcattcaaaaacatttatttcccaacttctgtgtccaaggtactttgctaagaagtaacaccaggtatggtggctcacatctgtaatcccagcactttagaattctaaggtgggaggattgcttgagcccaggcttttgagaccaacttggcaacatagtgagaccctttctccacaacaaattttaaaaagtaaccaggtgtggtggcatgtgcctgtagtccctgacactgggttggctgaggtggaagcattcttgaacctgggaggatgaggctgcagtgaaccatgatcttaccatttcacttcagcctgggtgacagagcaagaccctgtctcaaaaaaatagagaaataggtggttagttacaagcaaaacaggaaccctttcttcaagaaactgatgatctagagtggtacataaaggaagacttgataaccacacacatggacacacatgcaattatgaagttagtggaagaatcagaagggaaatcaactgtttttagtgatagagaataagacagtgggaggagggaggggtgctccttaggaaggtgcccaaggaagtcctctgtgaggaaaggactttcagtctggcacctgaaaaaaaggagcctgtcatacaatgcttgggggaaggccaatgggcactgtgaagagtcggtgcatgggccatgccttgtaaggcttgtggagtcactgtaaacagaacagacatcgtgatgtgtggcaaccgggcttgcattgccattccggttccatatcaacagttcatttagttttaggtatcaaaatgctgagaataatgaagaggaatattccctgtgcactcctggcaaagttgtaagaaatattaatgaagttctaatcagaacttggtttgcttcatcaaagagagcgttctggataacatgttgtggatgtaaatgtaaaagtaaagaaaatatgtttatcaaggtcaagaatgaagaagtttgaaatgcatgcacacacacacacacatacatgaatgtcactgattagatgccattattgttgatattaagagatatttattttttcattcactaatttattttactaatattggcttgacacttactctgtattggacactgtgttctggttgatgtgaatgaagtcttgaaaaggacagcctttcttaaagcaagaaggggaggacagacaaaatggcaaagcaaaggcagcctaatagaattaagcaaaatgccttaggaatatggaagttcttttttttttggtttcttttgagacaattttgctcttgtcacccaggctggagtgcagtggcccaatctcagctcactgaaacctctgcctcctaggttccagtgattctcctccctcagcctcccaagtagctgagattacaggtgtgcaccaccatgtcccgctaatttctgtatttttagtagagacggggtttcaccgtgttggccaggctggtctcgaactcatgacttcaggtgatccacacgcttcggcctcccaaaattctgggattacaggcataagccaccgcacctggctaagaatatggaagttcttaacttgctttaactcctacctatctcttcagtgtcatcttttgccttatttcagacagagttaacttcatttttcagtgtcttaaacgtgacgcactacttctctctttactttgtaaaggttttgttttgtgcctgaaacatgtaaccatcttctattcatcatttaagcctttatttgaatatatttattccaagcaatcttttttaaatcagtgtttctcaaaatgtgttccacgaaccatctatatcataattacctgaaaatgtgttctttaaattgcaggtttttgcacacatccccaaccacaccctctgaatgagtagggaaccataaatatacatgttagtacattttcctgaaagttcttttgcattctcagtttgatcactgttaccctagatttgtcaggggtctcttttatgtttccatggacataatgatctccctctactataagatttattgcctgaaatctttgctggtctgctaaattaatccaccaatatgattgaaagctcacagagataggaggaatgtgtttgctagtcattgtaagtccactatcaaacatggagctgtgtctaggtggccaataattagatgtatgttttgcagagcaggtacagaagttatccaggtcataaagggacagaacagtcttccaggcagagagaatcatgtctgagcaagttagctcagatcatacacagcagacaggttggatgtgtagctgggagactgggtgttagtgagtgaatggctgttaagtcaggctagagaaataaaattgtgtttagcttatgaacaatccatacctacagaaaagtgtcacgcatagcataatagaaaaaaaagggtggagggggcctatggccatgaaacctaggtttcaggcctgaattggccttggactgattaatttactttaaacaattacttgaccttatgtgttttgtctttccaaactggaagttgtgtataattgtctcactttctcactttataaggaaaaatatttacataggacatacaaatgagcatactaagataaacataaaagcagtaagcaaatgccaagtgtgtgtgtgtgtgtgtgtgtgtgtgtgtgtgtgtgtgtgtatgtgtgtgtaactaaatttgacaatcctctttcaggattgaaagatttatttatttcttggattttgggtcctccttgtagttaagttttcaaactgtttgtcccttacctgaaagccacaatgaactccagagggaaaaatttttacttgtatatacttctcataccttccattaacattgattctgcttaactatattttaccttgatacaacattttactcttataagcccctgttgtatgggtctgtatggttttgtgttgttacacttcagaattcaagtgtcataagtaacttttcacacatagaaaatgtcatgttacaatccagagcaatgtctgtttttagcgaatttctgatcttttcgtgtttctttcatataaaaaaacacacatacacacacaaacctgcctgcacaaaattatcctggattcattctatcactctcttcctgtaaaacaattgcgaatgtgtaaagtgttgtgcattctgaggctacacttgactctttgctactttctctggcatcacagatctactagatttaatagaggagcatagctttacttacaagaaataaaggtgtttgcaaaataatgtagaaagtcaaattttaaatgcccaaaaacgttagtttaaaataagttaactaagtcattcaaaatttgagtgctacatttgttcaattgtgaatcagtagtaaatggaaatgtagtagagttccacagcaagcatattagtatctacaccatagttctaaatgcaacagtacttgggcatgttgaggggcactgaagccaggcaacagagcttggaactgatgaatagtaggaggagtaaaagattttactattactgctaactaccactccccccggcctcctcctcctaacagtatgctttcattatggcgatatgttagtcaaaggatgaacatttagttagactggagaataagttctggagaaaaaattcaagggacctattgtgcatcatggtgactgcagttaatatattatatatttgaaaattgctgacagtagattttaagttttttcacaccacacacaaatggtatataaggtgatccgccatgtcacgttaaacatcttgacttagccattctacaatgtatgcatatatcaaaacatcatgttgtgcaatataaatatatacaaaaaccaaacaaatacataaaacaccaaagctgcattaatggttattgagctataaatttgatttatattattgtatttatttctgacataattcatgtggtaggtactattatccctattttataggggataacattgaagaaacatggaaacagatatcatatgggcaagttcatgattcatcaacttaggtagacctaatttccaacctgtacctatcagcagctcgtgctgtttttacatcacccttggaggacatggggctaaaatcaaaagagaatcaagaaccttattttgatgatatttaaaatgtattgagtgacagaaactaagtcaatttcaaataagacatttggatatgctgttgttttttctttccaagatgcctttggtttcttaaggcagtgacaagacttttgaacattgtaattctttttttggataagatttttatgttagtagaaaatcttgggaaaaatgaaacagggaacactggtatttttcagtggtgtcgcctttgcttgcattcccattttgtcagcttttgaggagccatattcactattaagtttgtcttcaacatccattctctaacacagcacatgaaacagtccccttatctaactccacatgaatctaatgtaattttaacctaaaaacagaaaaatgaattaggaaatacatttgtctttaatgtaatacagagttcagtgaattctgtgaggcacttaaccaaaataacttgtgctttccttagtttttgcaacccattttttagataatttatgtaaaattattttactctatacaggagatattttggagggttttttttttggaggctgcattgcttaaatacagtttggcatttaaaatcataaagacttgggtttaaatctcaaccctgctacgtgatcttcagtacatctttgaacttcttcgagtcctagttacttcatttgtaaattttgaaggttgagaacacatatccggaagaacttttgaggggaatagaaataattcttcgacaacaattattgcagttgtatgtagctactcagtgagtggtgaatgttgagtattttgcagctttaaaagtattgtttttatcaaattattatagcatactacatatcagttaatgctattataagaaactaaaatcatttagaacctttctaacttttgtcttatttttgttttttttcctctccatctatgtaagaatctgagaaatcatgatctcgagcatcatgcagagcatattttctcctatcagggattcttgttctttgcatttcttttcagaaacacctcaaggtttctgtccttatagtacatctggaagaagcacacttccctagagatagggctttatttaaaacatctcttcattcaaggtgagaatgtcatttgctggcatttcccccgacttatcaatgtgcctattcttacatctggagtatgtcatgacagtcactatagtgatgtcctccaaggacctggacactatgtaggcttctttcccactgagtcctgggaatgagagctggcaatgttgacttagatccttcaggcagaactacaatgacttgccattttccatgttctgaaatcctacaatgcaaaaacctcatgatagtttatgctcctcttcccttgtcttctgcctcttcctctaaatatttctgatctttaactctaccaccaatctgtagctaatgcatattctgaattgtatctgggtacagtgagttctggtgccaccagcaaaaaacatctagtccattaaagttttttgtgagatgctttatgtgggacacagtcttttaatgctcatcataccaaacaaacatatgtgatcctttcatgaataagtagcaaatatataccaatgctgtaggagatttatttgaatatttggaagatagaagttttctcatacatctcagagtccttttatatttgaagaagtgacacttcacattattattggattttcattatcatttttgggaaagttctcacaaaatctcagacctgaagttgtagacagaattatagagcacaaagatgtctgtgtcctaatcctcagaacccaagaatacattaggccatgtgtcaaagaggaagtaaagttgcaaaagtaattaatgttgctcatcagctgtatttgaaacaggaagataatcctgtattatcaggatgaattcagtgtaatcaaaaaggtcctcaaaagtgaaagaaggagatagaagagaattataggttgaagtaagtatgaaagaaaggcacagagaaatgtaacattgcttgccttgaaatagagaaggagtctacagaagccatgggatgtgggtggcttctagaagctagaaaaggcaaggaaatataatattccccaagagtgtcaagaattaatgcagccttgctgatacttgatttttagcccaatgagatcgatggcagacttcaaacacacagaactgcaagatagcacacttgtgttttaagctctttaaagtcatttaagtttgtggcaatttgtcacaccagccacataacaatacacgatttgatttttttatgtgaaaagacagagatgataagttggctcagtttacatgggtgttgatggaggagagtaaaattagagcaaaacttagaaaaggcattattaaaggaggttaatttctcattttcctccatatccttatcatacctcttaatgttgccaacataatgcatgcttatagatcagtggaggctctttgaccatttatgaatcaaaataaaattataatctatgccagtagatgagagagtccctactgcctttcagaaaacaaacacattatcttaataaataaccatctcggtacgtgaagactattacaccttaggaaaaaagatggctcattatgcattgcagttttatataattgcatcatagcagtttgttcaattgactcttttaagaaaaagaaatggaatactgagtaatcttaccaccaatcttgaagaaaacaagacatttgatcttgctatgaatcccaaattattgcatgtccatcttttataaagtctcaaagatactttaggaagttgaatgctgtctgctgtcataaaaaacccatgcacaccaatcagttccatggacagaaccaagcaggtggaaatcttgaatagaaggtcagtctacacaggtggcttaaaataatttacacaataaatctttggaaggacaacattgacttctaatccctctacctctttattttttttctcttgctacatttttgagtgaagtgttgtaatgaacatcatagggtgcttgcactaatcaccagtatccaaagataaatgatgatgcagataatgatacaaattttataaagcacctaaaatacagaacagatttattgtctttgttacagttcataaaatacatgaatgaaaatttagaagttggggaaaatttttatctcaaagcagaaatggccctgacaattttctatgaaatgtagttgatatattgatgcttgcattgggagtggaggtggggaaaggagataaagagagatagataggggagggttttctttactcaaacaataacaaggtaatttctgtaattttagatactactcaaagaggacccagcatataatttggaaaaaacaaaaaaagtaaaggacttctgattatcttttacattgcagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcaggtacactcaagagcatgcacaagggagcttctgtcactagcactactttttgtgtcttcaagaagcttccagattaaagagttggctaatgtgactcagtttttactttgtataataacaggtggctaaaaattatgactgatatttcatgggtgattttatacatatttgatgtagttttatttttaatatgatgagtaattaaaactaaatgcatagttgtgtactttgcttattatgcacgtatataatgcattgtgtatgtgtgtgtgtgtgtttgtatacatagtcactactgttgaagtggatactgctccgagaattgaggtatttagagaacagggaggcagcaagctggtacctgaactaacatgataattcatgtgattaaaataaaccttttttagctttattaagaaataattgacaaataaaaattatatattttcaaagtgtaaattgtaataatctgataaacatgcgcattgtgtaattactatcacaattaaattaatcaacacatcactgcacagttaccctttgtgagtgtgtgtatgtgcatgcacatctgatgaggacacttaagattaactattttagcaaatgtcaagtaaacaatacagtatgaataactgtaatcatcatgctgtacattagttcaccaaaatttgggccaggtgtggtggcttatgcctgaaattgccgcactttgggaggcaaacgcaggaggatcacctgaggtcaggagttcgagaccagtctggccaacatggcgaaaccccatttctactaaaaatacaaaaattagctggccgtggtggtgggcacctgtaattccagctacttgggaggctgaggaatgagaatcgcttgaacctggaaggcagaggttgcagtgagccaagatcatgcaactgcactccagcctggggtatagagtgagactctgtttcaaaaaaaaaaacaaaaaaaaaaaaaccaaaatgtatcatcttctgactgaaagcttgtactctttaaccaacaactctccatttcctgcacacaccagctcctgacaaccgccgttctctctgtttctatgagtttgacttttttagattccacatataagttatatcatatagtatttgtctttctgtgtcttgtttatttcaaattggcataatgtcctctaggttattccatagtgtcacaaatggcacaatcttttttaatgctgaaaatttccaattgtttgtgtatatgccacaatatctttaatcatttaagcattaacagagagtttgtttccatatcttggcgattgtgaataatactgcagtaaacacaagtgcagaaagctgcaggcatctcactccctgatttcaaactatattgcaaagctgtagtaataaaaaaaaaagcataatactggcataaaacagacacatagactaatagaatggaatagagaagccagaaataaacccaggcttatttaatcaactaatctttggcaaaatttccaaaaatgcataatgaagaaaatgttgcttattcaataaattgtgatggggaaattgaatatccacatgcaaaagaatagaattggacctttatcttataccatataaaaattaacttgaaatggattaaaaccttaaatataagacctgagactgtaaactccaggaagggaacataaggacagatctccttaatattggtcttgaaaatatatatatatgtttacatgacaccaaaagtatgatcaacaagagcgaaaatttaaaaaatgggactgcatgaaactaaaaaaccctctgtacagcaaaggacacaatccacaaaaggaaaaggcaatctacagaattggaaaaagaaatgtttttaaaccatatgactgatgaagggttagtatccaaagcataaaaagaattaatataactcaatagcaaaaaaaaaaaaaaaaagaaagaaagaaaagaaaaacacttcaaaaaataggcaaaggatgtgaatagtttttttttgtttttttttgtttttttttttttccacaaaaggcatacaaacatccaacaggtacatgaaaaggtgcttaacatcactgatcgtcagggaaatgcaaaccaaaaccacaatgagatgtcacctcacagctgataatatgatggttagtatcaaaaagacaagaacaacaaatgttggagaggaagtacagaaaatggaacccttttacactcctggtgggaatgcaaattggtacagccattatggaaaagagtagagaggtttgtcaaaatattaaaactcgaatcctatttctgaatatgtaacgaaaataaattaaatcagcctttcttaaaagtagaaaaaacccacagcaccatcatccatacattctctgcttcactaccctctaagtgccttttctatcttttcttagtcactgtcattttgggtgtctgaaaatgtatctgggattttgtcttaatcaggtatgataaggtgacaggcatgagatgattgcctttgaaagaaaagtttatttcttacagttctcaagaaaaagagatacattctaccactcagagccacatggagaagtgctagggttggtcaggagggagaaagagaaaggggaaagtgtggtggggtggctgtgttgcagcttccatgggaaggaatggggtgaaccaggtaggcaagcttgagccagttagaattggatagtttgaataatgtgggcaggatctgcgctacaggggtggtctctagttatctaatacctaatacttggccttgagtgatttaaggcaagagaaatactgggttgtgaatgtgagttagataaatggattagtgtgggagatgggctctggattgattggtttgtgtataaaatgcatgcttgcaggcctattgtttgctatctctaggaatcagctagccctgagaggggcagtgtctccctggccagcaagatcctcaagatgtcaaagcatcataaatactgattaaaaaatgactaatacactgagataaaaccaagacatcaacatgtatcaacaagtcaatataatatagatagaaacagtgatagtgtcttcattctgattatgctttaaagtggtttgtatatgggtgagggagtattatcagatttttctaggatgctttttctaaatccatgggatatatattttgttcagattttgctgctaatattggtatgaaatatgggttttgcaagtagtggtgatgaagaggctaggtctgagatgtttgataaagctcccattttactatggtattgttttaccctccccttgcttcccagcacacactaagaacaatagtggtaggtgttgaagggttctggaccacagtaattttctattacaggcacaattcccccagcagtggtctacgataggtcatgatgtgttagtaggaagataaaaggtgggacatcttattgcattaaacaagtctaggagattttaatatcttgggaaatatattgagaaacacgcactctcttttatatggcaggactcttagccaagacttttagcctgagatctgtagtgcccagtccaatattttgtaaaaattgagaaataaattttttaacaaatttggtaacctgagtaggatatttaaatatttctatctatctactcttccagcaatgtattgcccactcctttactgttttatgtttcaccattttattcttcaaatatgattttgagttctttcaggtaattcttgtgattctcctgttaccttattcatcacacatcttttaagcagctacttagtgttaacttccatagttagtggagataacaaaaaataagaaacatttaaagtccctaattttagaaatctgtaaagatgatggaaggcaatggttcagggaattagggtgtgtcattggatgcccggcactatatcataatacagtgtgagcaatgctaaaggaaaaatatgaacagagttttgggttgtatggaaccaagaaaaggcagtaaatacattttagatgaactaatgatagatttataaataatctggtcatggcaatgcttagggagaagggtttgcaatgttcagaagacagaagcccattacaaaaggaaatatgtaagttaaaattcaaatttctggtacagtgtagcatatttagtaatcagtgaaaacccctcacaggtaaatcattaggtgcaagtgtagaagtccaacatatttcagtaatgaggagttcttatggaatgttagctctctctctatctctatatatacatagatatttcatagagatagatacagatagttgctcaatgtctatctatattattatagtatacaataaattctattctataagaatagatatatagatatagatatgtatgtataatatatacataatatatagatatagaatatataaaatatatagatcttgatctatatctataattatatctatatctatatttatagatcaagatctatatatatgatataaatagatagatacatttaagctgagtcattctttttttgagagggggattaaaactaaaagatagctctaaaattgttaaagacaatttagacacactgtgaagagagaagtactattgaaataaatgaataactaccccaagggttactttgccgaaggtgtccattaagcatggatataggcatggtatttttaacttttgtagtcatgttactgaagctgtcatcatactagatctgaagtattttatttgtagctttaataaatattagttagaattaacaagctgggttaatatatattaatgtatcattagcaaaatttgctagaaatggggaaatctgttgtgaaatcaatgttaagtaataaccaaggttattattttggttaataatgttaaaagtagtacatagactcaataagggagaaaccattgtaagtcggagtaagaaaaaaaagccatgaggctggatgcagtggctcacacctgtaatcccagcactttgggaggccaaggagggcagatcacaaggtgaggagtttgagaccagcctgaccaacatggtgaaaccccatatctactaaaaatacaaaaattagctgggcatggtggtgcacacctgtaatcccagctactcaggaagctgaggcaggagagtagcttgaacctgggaggcagaggttgcagtgagctgagatcacaccactgcactccaacctaaatgacagagtgagactcagtctcaataaaaagaaaagaaaagaaaaaaacaaaacaaaacaaaaaaacagaaaaaggtcatgatctaataaaccataatggatgattcagatttgaatacagtcatgtaccatgtaaagataatggtctgcatagacagtggtcctataagactataacggagctgaataatttctatgacctaatgaagttgtagcaatcataaggtcctagtacaacgccttatccacatgtttgtggtgactctggtatgaacttactcctcaataaaagcctcaggcattttcttcaggaaataactcagaagaaggcattgttatggtagcatgtggtacctcttgcatattgttggccttgaagacctttcagtgggacaacatgaggaggtggaagacaatgatattaacatcatgaatccacataagcctgatctactgtgtatgtttgtgtcttagttttcaggaaaaaagtttaaaaagtaaaaaataacagtaaataaatttaaaaatagaaaaaatcttctagcaaaaggatataaagaaagaaaatatttttgtatagttgtatgatatttgtgttttaagtgttatgacaaagaagtaaaaaagttaaaaaaataaaaagttcacaaagtaaaatagttatagtaagctaaggataatttattattaaagaaagaaaaaaagtcaataaatgtagtgtagcctaagagtaaagtgtttataaagcccgtagcagtgtagagtaatgtcctggaccttcaccacttactcactgacttgcccagagcaacttccagtcctgcaggctccattcatgataagtgccctgtgcaggtgtagcatttatttaaatctcatatttttactctgctctttctatgtttagatatgcttaggtacacatatactcacaaatgtgttatagttgcttatagtattcactacagcaacatgctatacaggcgtgtagcctgggggcaatagtctatactacatgtacagcctaggtgtgtcataggctgtaccacctaggattgtgtgagcacactctatgatttccacacaacgacaaaattgcctaatgacacatttctcagaatatattctcaccattaagctacacatgactgtatttataaagaagcaggaggcattttaagtaggtggagtagcacagggataaacaagaataacaagcacagtggacagtgtgatacaggagatctaataactaaatattttgaatttcctctcttcctgtctccctccctccctttctttcttctttctttcctccttgtcttctacccatcttttaccatacctcatcccctctctccctcccccttttattgactcctctgatttctcattttccttctctttatctgcccgctctctctctgtctctaacacccactatcatcattatcaccccatcgttatcaattggtgacatatatatatatatatatatatatatatatatgttcttctccatgtatgtatgcatgtatgtaggtcatccaggtgtacagagatgattaataatatcaatttccaactccaagttttttccaccagacccaccttatcaatgtcaccagttctgaatacctgctccatggccagcaccttctttaattacaatacccttcccatttgaccccatcagcctctctctcatgttgatttgtttctgctccgatttcaagagtcctaggaaaaggccacccctggacaccacaaatggcataaactaccacactcccttcacttgaagacacaataaatacttaccaaacatctttcacgtgtgtctccacatggctgtgtggcaagtgctgtggtatgaagaattgcgtgtcttggttttttcattagcaagcttgaggtcccactcgtgagactaggatgtgcatgtttatacacataaatgtgtatgtaattaatagtaagcaaaattataagaagaaacaagatttagtgagcacttacgttgtatcagccactgttgtaaaaacaagtatattaacttgtataattcttacaaaaccttttaaggcaaagactatcatttttaccatttgacagagaagaaagtttaaatgacacctgacaggactaatgatgtcatatgggggcttgagttctgttgctgcctgcacatcaccaatcttgatatttttcaagcagcagagaggagtaatagaaagactctgagtgcagtagttggatagctttggtgtgaattttgcctctttcatgaatgatctgtaggacttggacatgttatttgattgtttcaatctagtttccttatttgccaaaggggaacaacaatactcatgttgtagtcattttccaatgatcaaatgatacaacaataataatcatagtggctacttataagtgtatagtagccacaaggtcctgaaaatttagcatgcattatatacacacatataggtattactactctcctttaatacatgtgcaaatttatatttaaaaagaggtcttcctcaatgtcaccagaccaacaaacaacagagcaaagactcagattaaggcctgcgtacccttaaacttgatgctttttcttatatcatatatggtactgtacacacagtacaatttctctctcatcagtgaggcctgctcctgaaggtgttaattctccagcacttttgttctttactgtcaataaactcaggatccttttgcatctgaagaaaactctcaagcagagcagggcatcatgcataggaataggaactgtccagctaggcaacaggggacattaggagcagggtgagggcatgtggacaggataccaccatcctctgttttaaccccttatcttacaatttgcacataaacaaacagggccattgaactatggggtgtgagcagtgcacttcaaatgctttctgcttgtgcatgttttttgagttccttgcaacatatcaactcacaactatttgagggcacctggtgtaatgcacaggtgtgtcattccaggtgggccacactgtaggcttcttgccagtgctttgagtgagaagtaaagtcccatgtcttttactcctttcagatccttttgggaagacagatgagcgggaaccactcacaaatgctgttcgaagtgattcggcagtcatcggaggtaaacaattcattgttgttgaatgcaaaaagacataaacgatcctgtattctggagaaagttatctgaagctttccttaattatggccatccagcactcagagccccctacattacctgcaagactgtgggcttttcatgagtagtcctgtgtgctgaatgatcaaaagcaccctctgccgacaccagcagctctgcggattcatcttgcctctgattcatgaggcagctgagcactgagtcaacagctggagcatttacttacagacagcagctcacattctgctcatttcatacagttttcactgtttctaaaatgcaaacaaagcaaaccaataaaactaaattcggggaagaagccatgttggggcagacaatgggtgaagccgcagtcctgtggagtattccccaccaagtgatttgggttaggtctaatgagcagggtgaagcccacagaactgtagttgcaaatctcactgcacatatggttacagatgcagaccttgtctgctctgctgtgagctcagctctcctgcttttccattttctcattgcctgttggcctccccacttttttattctgcttcagcttggcttcctcctgctgtggcttgatttttccatctgggtctaccaacacagaatgattcccaagctttgcttcatgtaagatgcctgtgaaagaccaaactcatttctatctgagaaacataaccttagcaggtgccgccatccctgccttctggaagcctagatgaactgatccttggcagatggcgttttccttttaaaaacctgcagtacctctccatttagcttatatttaatgagccttgctatgggtcaggctctgtgctaagtagaggaatatggggatgaatgagccagcgaggagatgggtaaacagacaacaagacaaccagtgaagtctgttctgagggaggaggtacaaatggctatgggagcacagaggtgcactcctgagaacatgaagaaaggaaaaccacgcctttccttaaggaagttcctaaaacttctgacctgaatttttgctccagagaagctggaccaccttaatttttgtttggcatagagaaatgtgggaaagaattttgtgcctatttctctttcaataatttcccatttgacaagtggaaaaagaaagacttttgtgactgctgactcctctccagctatttacgtgctctatgagtctctttaaggacagggaagtcatctgaccccctaggaaaattcctggaggcttgcacagctgctgactctgactatcccatgcattgaaggagtaggaaccagtttcctatttcatctcttaatgcagcatcccactcatgggaatcactcactaccacccagtttattcatagacttgctaacttagatgattttactcttacttgttctaacatagttgtagaaaatgccacaaaatgatttaggaacatatatttataaaaataaatcttaatcatggcctcagttctaaaaaaaattggtggaagacatgcaatccatttatgaaacttacaaatgtccatgcttctgtaaatcataattcattatgcccaaaaatagctttctgaaatagacacttttcctcaatatctcctctccttagaaaaatgaaacagcaaaatatagaacttattacaagtaaattctttgcttatcatacatatttttaaatattttcatgctgaaatactacattcatgcagagacacatctgccgcttccatgttttcactattcctttattgatattgcctttcatgttccaagagccttcctggcaaaggtaggggtgagaccctagggtaagcaagaatagcttgcaacataatccagttaaatcacacacagtcagaataaaggggaatctgatgggtctggacagaggtttgccatctcagttgactttgagtttctcaagaacagaggcatcttgtcactgaatgagccttagtttaacagagttcagagcagtgtaaaaatgttctaaatttatagcgatcatttcattattaatgaaaatgttttagcaaaacaaacgtaacataaaacaaatttacatcaggagagcatgtgttaagatgtgagatatttaagtaccattttctaagatgctaaagtaactctgaaatacttagttgtgaggtgacaaaaaaatgggctaattacaaatgattctgacacattatttatagcagacttgaaaaatttacaaagaaaccccttgctagtccaattccatatgtataagatggtattctcagttctttaaacaaaaccttctatggttgaaagtgtctctcgcccccagttagtctgaaagaaggaggttttatagtaattgaagacagggcctttcagcaggtctttatttctgggcaggtggcagagttgcgtttgtgtgatttgttttgttttgctttctctcctacgcattcccctcatctggagggaatccactctcctgagcagatgactcatgacgatttccttctctctttccttcccctttctctccaggggtgatagcagtggtgatattcatcatcttctgtatcatcggcatcatgacccggttcctctaccagcacaagcagtcacatcgtacgagccagatgaaggagaaggaatatccagaaaatttggacagttccttcagaaatgaaattgacttgcaaaacacagtgagcgagtgtaaacgggaatatttcatctgagaaactgcagggttcctactactcttttttcttgttgttcaattatctcctccccctcttctctcctgtcttttgatttggtcattctctttattttctgcttgccatgtcttttctggaacatacttgcatccaccacagcatcaattcccttgatccagcccaagagaccaggcagccatggccactgccttcctctctgatgaacctatcgggtgaaaacgaccactcaagagactgacttcgccattcaagacaaggaagagacacatgtgtgcactcctgcatgttcagttctgtacttccagtttctaaaatgcactgttcagttttccaaccacttggtggttcaggcttgctttgaacctgagctcttaggcacatgacggtcattcctgacatcctccccagctcaagtctattcttaccatagaacccagggcagggagagaagaacctagaggcctggtttgctttggtggcattgtaaaaagagtaagagaggtttggtttgtggtggtttgctttctttaccataagcaatcccttgccttaactcatcaccctttttcactatgacccttagaccctgagtattttcaaatatatgattgctgatagtagtgaccaaaactactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaa

SEQ ID NO: 1866 - DNA, 35592 bp, Homo sapiens
tttccagtggcaataggtccagaaggaggtttaataagcagcaaatcaaatacaaactccaggcccccagacagaccctgctggagagcattcacacctctgaggtcaagccaaggtccgtgccattgcatcctctgcccagaggcccgcccaacccctgccccacacagaacagagtcgctcagggaaactgacatttggttttattgtgccaaggacattacagatggcggatcttgtcaacacctgcagggcacgggtgccccatctgccaaggctgctcccacactccctacactcaaatcccgggtggcagccataatccccaaagatgacccccaccccaagattccaaagaagctagtggtggtggaagcaaaaggaatgcagcaaggtcagggtttcattgtccaagccggcctgacacctgccgccctgcccttgcccagtgcacaccctagaccctgggccggcctccatgcagctggaggccagaagacagcaacccatatctttgcaccctcctccatgccccatggcctgcctgcccagaaagatgccaccttcacagagccagtgctgtcgtctatatcatttttgattagttgattttataagataaaagtaattttaataaagaaaaaattcaacattgaaggctcagacgttcttgggggtactgggaagggaaatttcccacttcttcctcccacctccctggcatcagtgtcggggggtggcggcaagtttttctcatcttggaaggaatgaggggcagggagactttcctctgtctgaatgtctctctcctctggggctgcctggctgccagttggtctgtctctgtgtgcctcttgtctatcttcggcacccttgcccgagtcccctgtggaatgcagggatggttctgtgcgggatggggtggggggcaacagggcacatcagctggcagagagacaggtgatagtggcagcggcaatgagagagagtgcaggggtgggctagccagagggaagtgaggaggagggaaaagaggggagagcagaaagaacagaaggaggcaagagggaagaagccaaagaaggtgaggtggcaccggagagcaggagtactggggttgggagatggtgtccaatccctgggtctccatcaactcttgtctgggggcgggtctctgtgcactttgtttttcttcatactgtctaggtattcctgttgggacactgccagcaccgaagctaggatctcatcatcatcccagtcattcagacctgctgggcgagaggaagaggaaaaggatgatggagcgctctcagcctgccttctcctcaccctgtgccgacatctggggctctggagaaatcccatagggcccttctcactcctttctcaaaacagaaggatctgctaggcctgtgaaaccccacttagaccccagacccttctggggcaaattccttggatctgaaaaatcccctccagtgcctctcccttcttttcttggggagatggccagaggctccagaaagcccctctcaggacttgccacttcttccagtctctcccagctcctagcagcctccatccccccagacaaaggaggcttaccaaaggcagagggggacatctgctgaatgagggcccggcactccaaagcagggtagagggacacaaggggggaagttgcccggtcggcccctgccgagaactgactgcttgtacctgaagcagacggacagtcaaaggtagggacccaggatccaggacccaggacccaggacgtgcctcctaactcccagcacattccctgtgggcaagtcactgacctggcgcacagggcgaaggaggtttggcaagagctaaaacagtgcctggggaagggggcttcatgcccaattcagcatgcagctcagggtgctcaggtgacgaggctgaactccgctgccgcggggaccggctagtccactcctccaggccactggaggctgctgctgtggccgaactgcatgtggcgctggctttccggggctgcagcggggaaggtaaatgcgttaaggaccaccagcagccatgaccttcttgtgacccatccctgaatgctggctcccttcccaggaccttggctatgatacagcttctatgtaggtcaacatcatccccactcacacggtggaccacaagactcctcacaggacagaggtggagctccttaccctttctctcacacccctacagccaatctgacaggaaaccctgttacctctatcttgaaaatagatctcaaatccaaccccttctcaccaactccactgccagcactggccaccagtcacctggcctactgcagtagcctcctcctcactggcccctgcttctgccctcactcaccagactccactggatgactagcaggcaaggcgatcttattaaatccccaaccacatcctgtccgtcctctgctcacaatcctcccatggtttctgcctctctgagagtaaatgccaaagtcctcgccacagcccacaagcccctacccaattggacccacaacctctctgacttcatctactactacattctgttcggatacaccggcctccctctgggctgtgcctgagttgtaccaggtgtgtgggcctgctgtcctcccctccatgtgcgctcagctaactctcaccttctgcaaggctcaaatctcacctgctctgaggcctaccctgactgcgctatttcataccgtgaacgcacattcctgctcagcccctttatcctggctctacactttccatccatagcacttcccaactaatttattcattatatttattattttatttcactctgcaaaactgtgaacatcacaaggacggggatcttggtctgctgggctcacctatgtatccccatatactgaaaacagggcctgccacagactggtagtaggtatttgtggaataaaactcagctccttcagccgggtgcggtggctcacgcctgtaatcccagcactttgggaggccgaggtggtcggatcacgaggtcaggagatggagaccatcctggctaacacggtgaaaccccgtctctactaaaaatacaaaaaattagccaggcgtggtggtgggcgcctgtagtcctagttactccgcaggctgaggcaggagaatggcatcaacctgggaggcggagcttgcagtgagccgagactgcgccactgcactccagcctgggcgacagagcaagactctgtctccaaaaaaaaaaaaaaaaaaaactcagctcctgccagccaacatctacaatcactccaaactccttgcgattttacaattcctcagatgcttgtctgccccgcccctccccgctcccctaacaattcaaccttcctctgtgaagactaaccggagcccccacctccactgatctcccagtcagggtcaaggaccccaccattgagttgtctctgccaacagacgagatcgttgagggcagagtagtccagatctgatgttacattctcagtagagacctggcacacaagggcagtcaacaaaagcttgtgtctctgaagctatccattattctcgtgtcaccagcagcatggctgccctcctctcactccttaagtgcctgttctgcacaagtatttaaagttccaaggtacaatgccaaaactaagaccaagatgagttacagatggtgctggatgcttccttccctcccagatgtcaaaactgcttaatttttttctgctcgcttgagggcaaagcatgagaagtaatgagtttttggccaagcctgtgacagagtccatgacccacctggctggggcctcggacctggcgagcctgtttctcctgatcccgcaaccactgcaggtaggattcccgagccacctgctcctcgatggcttcatttgtggcctcccagtctgtggcccgtttcttgtcttctagcatctgctgttcaatccatgactcctccgatgtttttatggcattcttcatcagagactgctctgcaaactgcaaggagggagaggaacagggatgtgcaataacacactgaacctgcccaagagccagaacaggctcagcgaggtaggcccacaggccccagaaaaaaaaggagacaggaaagcaggtactcccaaagagcaacactccacagactacctcttgattggggaccaggggaaagcaggcttgggatgtgggacctgtcattccaaactcctatgcttgtaagacctgactctaacccccaaaccacctcaactgaggcactgagactggagcagtcaggtgccttccaacctgggacttattttttttttttttctgagacgaagtatcgctctgtcgcccaggctggagtgcagtggggtaatctcggctcactgcaacctccgcctcccaggttcaagggattctccagcctcagcctcccaagtagctgggattacaggtgagtgccaccacccccggctaacttttttgtatttttagtagaaatggggtttcaccatgttggccaggctggccttgaactcctgacctcaggtgatccacccgactcggcctcccaaagtgctgggattataggtgtgagccactgcacctggccctgggccttaatttaaagaagccccatccagtgatgactgtttcataatgttgaggactttcacacacatgagcagatgagacacatacaaaaattagctatgtgtgcaccgggtggagggagtattcaagcatgtgaggggttgggggaagtagtgggtgtgtgagggaataagggggcagtatcaacatggtgtggggtgctatgagttacaggacactacatcagagtactgtttttcaggctgagatccaacagcatttttaaaaaatagaaaatatcagaatatatcccagggaataagtgcaaatgttgtttcatgaagctttagttaacattattttaatgcacatatacacatcacacacaaatgcatatatgctaagtaatcatgtaaaatgtattcttttctttttcctgcagaccttgcattcagataaaatgtaattttttactgtgaatagttaaaaacaattcgtaaaactatgttagaacaagccaattaaaaaaatagtcaaaaaatctaaccactctggcagtgttaaacacactccaagtgttttttctactctcactcaacaacaatcaacacaggagacttctgtgaccaagtgtgcgggctggggggagggtgttttcccacacagcaagcagcggacacctggtgtccatcctccaatgcaattcaatacccagagacagcctgggatcccacaggttgagggctcagtcccacaagactccccccaacccccttcgaacaccagtcgaaagtctgggcctccagaatttctgactgaccagctataaattgggattcccacaatacttttttgggggttcaactaacttgctagagcagctcacaaaacccaggaaacacgtctgccagtttattatagagaaaattacaaaggatacagatgagatgcacagagtgagatatgggggaagggacgtggagcttccatgccctccctggggtgccaccctctagaaacttccatgtattcagctacccaaaagctcccagaacccaatccttttgggattctttggaagcttcattatgcaggcattattgattatgccattggacactagtgatcaacctaatcttcagcctctctcccctccccaaaggctgggggatgggcttaaagttgcaaacctctaatcctgccttggtctttcaggtcaccagcccccatcctgaagctacctagaggctgccagccatcagtcacctcattagcatacaaaaaggcaacactttgcagattctaaggattttaggaattgtatgtcaggaagtcacaaacacaattcaccaaagaagctatacagatggcaaataagcatatgaaaagatgctcaacagcatttgccaataggcaactgcaagttaaaataatgagataccactacacacctaagagaatggctaaaatccaacacaatgacagtatcaattgctggtaatgctgacaacaggaacttccaaatcattatggtgggcatgcaaataatacagccacttgggaagacagtttctcagttcctcataaatcaaaacataatcttacaacgcaatccagcaatcttgctcccaggtatgtatacaactgatctaaaaaattacgtccacaaaaaaacctgcatgcacattacagaagctttattcataatcatcaaaaactggaagcaaccaagaatgtcttttaataggtgaataattaaactggtacctccataaaaggaacattaagtgataagaaagaaaccagctaacaagccatgaaagaacatggagaaaccttaatgcatactgctaagtgaaaagaagcagtctgtcacattgaccattttaatttcaggggggaaaaaagcaaattggctgcaggtggctcacccctgcaataccagcactttgagaggccaaggcgggaggatcacttgtccccaggaatttgagattggcctgagcaacacagtgagatcctgtctctacaaaataaaaatatttttaaagttagccaggcatggtggtgtgtgcctgtggtcccagctacttgggaggctgaggtgggaggattgcttaaacccaggaggtaaaggctgcagtgatattgtgccactgcactccagcctgggcaacagtgatacactgtctcaaaaaaaaaaaaaaaaaaacagtatgaaaaggctacatactgtatgattacaattatatgacattctgaaaaaggcaacccacaaagacaatagtgtttgcaggaagagggaggaagggaggggtaagcatatggagtatgaggaattttaagggtggtcaaactattctgaataatactgtaatagtagatacatgacattacacatttgtcaaaacccatagaatgtacaacacaaagagtggaccttaatatatgctatttaaaaaaaaattaggaaggctgggcacggtggctcatgcctgtaattccagcactttgggaggccaaggtgggtggatctcctgaggtcaggagttccagaccagcctggccaatatggtgaaacctgtctctactaaaaatcaaaaaaattagctgggcgtggtggcgcgtgcctgtaatcccagctactcgggaggcagaggcaagagaatcacttgaaccacggaggctgaggttgcagtgagccgagatcgcaccactgtactccagcctgggtgacagagcaagactctgtctcaaaaaataaataaataaataaaataaaataaaataaaaattaggagatctatggccagcgcggtggctcatgcctgtaatcccagcactttgggaggccgaggcaggcagatcacctgaagtcaggagttcgagaccagcctgggcaacatgatgaaaccccgtctctactaaaaatacaaaaattagccaggtgtggtagtgcatgcctgtaattccagctactcgggaggctgaggcacgagaattgcttgaacccaggaggtagaggctgcggtgagttgagatcatcgcaccactgcactccagcctgggcgacagtgagactctgtctcaaaaataaataaataaaaaattaggagatctgagatcccagcatagaatgcaaaaatgtgacaaaataatacaaatgtattacaaacatgaaacaaccttggccgggcgcggtggctcacgcctgtaatcccagcactttgggaggccgaggcgggcggatcacgaggtcaggagattgagaccatcctggctaagacggtgaaaccccgtctcttactaaaaatacaaaaaattagccaggtgtggtggcaggcacctgtagtaccagcttctcgggaggctgaggcaggagaatggtgtgaacctgggaggtggagcttgctgtgagccgagatcacgccactgcactccagcctgggcgacagagcgagactctgtctcaaaaaataataataataaaataaaataaaaataaacaccctcatttgaagggggtgggggtacaagtaggtcactttcaaaatgaatggagtctgtaacaccaaaggcaaaaaagaactatatgtagcattgagctatagtgataaagttgtttcccacgggggtacgggtgaacaagtgtgattctgctacgcgtgtatatggaaatgagcagttacataaatggatggtaggaaccagtgcatatacatctgatggcgtatctactgttggagagggaatttgcagatgaacaaggggagaaggctagaatgaagcatgtgataatggatctgagttggagacatcagtaaggattcatgtttaatataaatacagatggttacaggtagaaatatttatagatatgtgtacaaaggccactatacatacatgtagctccttgctctatcagctgacagggcctagaagcatggacaacctgatatcgaagagcacattcaacacctaggtcttgatttctgttaacagtctccaatacatgccagggctctctaaagaaatggctgattgagctgggcgcagtagctcacacctgtaatccctgcactttgggagaccgaggagggtggatcacctgaggtcaggagttcgagacttcagcctgcccaacatggtgaaaccccatctctactaaacaatacaaaaaacagctgggtgtggtggcgcatgcctgtaatcccagctactcgggaggctgaggcaggagaatcgcttgaacctgggaggcagaggttgcagtgagctgagatggcgcccttacactccagcctgggcaacaagagcgaaactccctctcaaaaaaaaaaaaaagaccatattgatgtacgtaataactggaaaaattaataaattaaggatgagttaaggatgagacacagatcctccttaaagatttccaaataatctatgtagatactctaccctcaaggggatggggcataaccatttcttaggcgtgggctgcacatagtgacttccttccacacagtacagtatggaaaaggtgggaaagagtaaccttaggtggagaaacctaacaaacactacttctgccagttgatcaagggtaacaccaacaggcataaatgacactcatagtataaacccttgaaatgatgtaatgacaatggcactttacctctgtgatcttcctccctaagacccacaaccctagtttaaacatgagaaaaagtccaaaagagacatttcctacaaaatatttgatcagtactccttaaaactgtcaaggtcatcaaaacaaaactgagaaactatcaaagataaaggggcctaaggaggcatgcagatttcatttaatagtaacgtattaggctgggcatggtggctcacgcctgtaatcccagcactttgggaggccgaggcgggtggatcacctgaggtcaggagtttgagaccagcgtggccaacatggtgaaaccccgtctctactaaaaatagaaaaattagccaggtgtggtggtgggcacctgtaatcccagctacttgggaggctgaggcagaaaaatcgcttgaacccagaaggcggaggctgcagtgagccgagatcgcctcattgcactccagcctgggtaacagagagaaactctgccttaaaaaaaaaaaaaaaaaaagtattaatgttggttcgcacattgtaacaaatgtaccataatgatttgaactgttaataacagcagaactgggctgggcgcgttggctcacgcctgtaatcccagcattttgggaggccgagatgggtggatcacctgaggtcaggagttcgagaccagcctttgacatggtgaaaccccgtctctactaaaaacacaaaaattagctgggcgtggtggcgggtgcctgtaatcccagctactcgggaggctgaggcaagagaattgcttgaacccgggaggcagaggttgcagtgagccaagattgcgccattgcactccagcctgggtgatgagagagaaacttcgtctcaaaaaaaagatgataataataataataataataataataataataataatagcagaactgtgtttgggaagagaaggatatgtgggaattctgtattatctcctcaattgttctgtaaatctaaaactgctctaaacaattaagtctattaaatacaaaaacttaaaacattcatttttattttttctttcagacagagtctcgctccgtcacccaggctgcagtgcaggggtcaaatctcagctcactgcaacctctgcctcctaggttcaagtgattctcctgcctcggcctcccaagtagctcggattacaggtgtgtgccaccacacccggctaatttttttttgtatttttagtagaaacagggtttcatcatgttggccaggctggtctcgaactcctgacctcaggagatcctcccatctcagcctcccagtgttgggattacaggcgtgagccaccgcacctggccagaacattcatatttttgaagaaagaaaaagaggaagctgggtgcagtggctcatgcctgtaattccagcactttgggaggccgaggcacaaggatcacttgagcccaagagttcaaggtcagcctcggcaatatagtgagaccttgtctctacaaaaaaaaaaaattttttttcatttttttacaaaaagtttttttaaaacactggccgggcatggtggcgagcacctgtagtctcccagctactcgggaggctgaggtgagaggcttgcttgagccagggaagtggaggctagctacagtgagcctagattgccccactgcactccagcctgggtgagagagtgagaccctgtctctccacccgcccaccaaaaaagaaaatgagccattaaaccaggacaagtcacagatgaatcttaaatgcatagtgttaagtgaaaaaagccagtctgaaaaagctacatactgtacatttccaattatatgacattctagaaaaggcaaaacgagagtcagtaaacagatcgaatacaaaaaacaagaaaattctgagaaactgtcacagccaagaggagataaaggggacacaacaactaaatataatatggcaccctggatgggatcctggaacagataaaggtcattagggaaaaactaaggtaatttgagtcaagtatggtctttagttaataatatgtcgatattggctcattaactatgacaaatgtactatgttaatacattaatcatagcgaggcatatgggaactctgtaatatatttgtaacttttttttttttttttgagacagagtctcattctgtcgcccaagctggagtgcagtggcacaatcttggctcactgcaacctctgcctcccagtttcaagtgattctcctgcctcagcctcccaagagtagttgggattacaggcacccactgccacacccagctaatttttgtatttttagtagagacagggtttcaccatgttagccaggctggtcttgaacccctgacctcaggtgatctgccagcctcggcttcccaaaatgctgggattacaggtgtgggccaccgtgcccagcctctttgcagtaattctgtaaatctaaacctgctctaaaattaagtttatttaaaaacaaaacaaaaaagaaccctatgttggagggtgtgttggtgttaggctatgtgtttccgaaaatgaagcaggagtactttgtgtttgtagaagtgaaacctgaatagaagataccaaaatcctcagcaaatgactgtaagagagagagagagaaatgaatgagaatctatcggtatgtgctgggaaaatgcactgccaccttctgaacacctactaggccccaggcccagtgggaggtgctttctgtatcagccaagctgccagcctggaatacttacagaatctgcctagatcacacagccagtgagtggtggggccaggcctgtaccccatgtctctgtgaccatggctgtctgtaaccactatgatcccaggagaaagatccatgccaagatgcccagagcaagccctggctcactgctccaaaataggactccacatcctaaaatgccagccctcaacgggcacaaaagataggtaagccaactcagacaggcaaaccaagaccaaagaacaagccctgagagatcaccttaagtaactccctattttttttttttttttttgtaagggtgagacctcaggggagagaggagacaggatatttttgtgagttaggggcaaaacagactccaacagaggtttctgacctctatatccagcagccattctgggcacagggacccactcacccctggtttgaatgatggcaggcccagccccacaccaatggtggccttgttaggattcaccactgaattatagtggatattccgatggtagctaacacgaatgggttcgtcctcgttttgatgtatcccatggaatgtgttgatgggttctgcagagaaagagaaggagggagcatccacagcaggccaggttgggcaggctcgaatgaggcaccatctttccctcacctacccactgcagaagtacctgtgctgtactggtacacctccacaggacggttgtacatctctgccatggcctgcatctcaatgtggttgccatggcaattgtttttccgcttcctgttaatgtaggtggtaaagtcctctgtgacatagttggagaagtagtcggcattcttcatctgcagaatagattggaaggttaaggtctgtgtggagaagaaatcctcccaccctgccccttccccaaaggcctccattttctcaccagatagtccatgcaatgctttcgcacaacctcatgcatgtcctggtctccatacacctggtcagctgtgggggcagaagaaagcagcagctagggtcagagatgccagagaagagctctgaatcatagaacatcctttggggaggaggaactgggggaccagggaaattcccttttctaccccaaggcctggagagttcttgcccttgtaggctagaacggggtcatggaaaaatatggcaggcagggccagacttgaagaacaagagagtgcaggtgagaggaacacatccacaggcctcttgggcagatgactttgtctagggtacacgtggccactcagagaaatcaacaacattctaagttccacaggttggcctcaaatgctattgattcccacaccccctttgctttccacatgaggaaactgaggttcagggggagtttgtggtttgtccaaggtcacaaagagtcagtctgtgacagagtcaactctgaattcagttttcctgactcctacaagtcaacatggcctttgtaggctgaaaaaaaagggaacaaagacaaaaaaaggaaagaaaaaaaaatgggctccaagcccagttctgccagatactagagagttgagtgaccagaggcaagtgacccaagtgttctgagcctcatatacctcatctgtaaaatgggaaaaagagggataacaggccaggcgtggaggctcacacctgttatcccagcactttgggaggccaaggtgggcagatcacttgaggtcacgagttcgagaccagcctggccaacgtggtaaaaccccgtctctaccaaaaatacaaaaattagccgggcatggtggcgggcgcctataatcccagctacttgggaggctgaagcaggagaatcgcttgaacccaggaggcagaggttgcagtgagccgagatcatgccactgcactccagcctgggcgacagagtaagactctgtctcaaaaaaaaaaaaaaaaaaaaagggataaccaaatggcaggccttttgtggggattaaatgagataacgggtataaaataactaccactgggcttgggacagagtagccacagagtaaatcagaattccttcctccgtagggaggcctgaatgtggggtactgtgaaggtgacagaggtgagtaaaatcctgcccctaccttcggggagcacacagtctagtaaaagagataagacacacatgcaactaactttagcttaactcaggatgggcagcctgtggcccgaatagtccaggcgtcgtgagatttggtcaaactaaggcgagaaggaaacacactccctctgcttcgcttgaggatcttcacacatgccgttccttctcttcaggacgctccttccatcctcgtcagctgcctacttctcaaacaccaatgtgttctttatttatttatttatttgagacaaggtctcgctctgtcgcccaggctggagtgcagtggcgcgatcatagttcactgcagccttgacctcctgggctcaagcgatcctctcgcctcagactcccaaagtgcctggattacaggtgtgagccaccgcgcctggcccaacatgttctttaatacagttccccactacccaggacacctctatcaccagatttatcaaaggtgtgcatagacttctgcccgaccacactgggctcccacagaaggcaaagggcagttcacaccaaagtccacccccagctcagggcccgatacagtaaaggaaatcaggaaaagtttactgagcaaatggataggctgggtaagccagggagctcttctccctgtgaaattaaagtgggcctgaagatcatgcaagtctgatttccactggttttgggaatttccctttgtttccccagaggaccactgctctgatgggatctccctggggcatggggctagggtcaggtcacacaggaacactcctgagttcttccctgtcagtctacctctctgaagaactgtcagaagaacaccttccctgccttccccttcctaccctggagtgttctgtgagaaaggctactctgagatagaaaatagggcccatgtttgtctccagtcctcttggaggtgaagagacctgaagggtaagggggtgtggaggttgtgaaggcgggaaggggggtagccccttcaccaatgtaaacaaggatgtgggttctgcggccacactctcccccgccctccccagcggcatttccagcaagtcacatgtcctgcgcacaggctgggggccccctgctgctgcctttcttagaagccaggaccacagagcccgcacagtgagctacttggggagctatttctgtagactgagcttggggtactgggaggcagtgctgttggcagctgcagtaaacaggaacaaagatgagaatgaaggggttaaataggggttggctggccaggctcagagagataggctgaggtgctggagaaagcccatctcctatggaaaggtcaacggtcatttccaggcctgggagttctatcttcaagagctagatgccagatgcaggaaaatggggaaagagaggagactgtggaacagggaagggatctgggggaaaaccccctgagggtcccatttctctgccactgacccctttgcctggcagaaaggctctgctgcctcctagctgtgtagcaatggataaggcctttaacctctctaagctgaaatgtcctcatgcataaggtggagacagtaactcctcttccatctgctgggtgttgtcaaaactacacaggaggtttgccaagcacctaaggcacagtaggtggtcaagaaacaggaacacaatttgtcatgacgacaatgattccttcatatgctagttacccacgagtcagccagaatgttgccataaccacttatgaagcccttcctcatttctgttgcaattcctcagccagaggaaagccccaaatgcagacctaggatgcatgtcctctcctggctctctacctttagcgaaaccaaaggtccacaagtctacctctaggccgttagttctaacaaaacttcagcagttaaattaatatcgaattaacaatacaggcttcataaaacagggtcctaaagtatggacgagttatgacacttctttacttatctgtaaaatgtaaaataccaccttctctcctcaatcctatgatggcactgataggtgatatggtataacatgtacctaatcacagcttttgaggggggaaacacaccacactgattataaggtataccctaagtttggaatcattaacgtggaagaaaatatacatctccaaaccaaggaaaacagcaatagtactatcccaacaagggagaatagaaggatttctccaataatataaggcaggaaaagcatctaagcacagagctaaacacataggaagtactcaacaagaattcatttttggccaggtgtggtggctcacgcctgtaatcccagcaatttgggaggccgacgcaggtggatcacctgaggtcaggagttcaagaccagccgagccaacatggtgaaaccctatctctactaaaaatacaaaaaattagccaggcggggtggtggatgcctgtaatcccagctatttgggaggctgaggcagaaaaatcgcttgaacccgggaggtggaggttgcaatgagccaagatcacaccactgcactacagcctaggcaacaagagcgaaactctgtctcaaaaaaaaaaaaaagaattcgtttttctgactttcctagctccacctctgtcctccagaaagccctcctcttcccagaaggctggcacacagggctgggggccaggcttgacttccctgtggaggggtctgaggttggggggatgacctgcagaggtaggggaattcagagaacttgttttgatagaaactgaaactcctcctcttgctgacgctgcacttgtgggcaatctgcacctgttctcccctcccagaggccagctggaagggggtcccccaccattctacctctgttcccatctcaaacagggctcagaaatcctcagtacaatactacaattggtcccacaccaaagacttttcacactccaactcattctatccttaccaaaacactcttactttacccaggagacacagaaatgtggcaaagcttgcctgggatcacagatttagggggagtgaaggggaggccaggctctcaaagggtaactgctggccccagctgatattaccaccttcaccccaatccagccaccatcttagtcaccttactccctggggcaggacctgatcttgtgtgcctcagtttccacaccagcacaagcaggaatcagctagaacccaggaaaggcatgggagagggcagagattatagatatcaggggctgcatctctccctagggccacagaggccaatatgaaccttaccctccccatacacaccccacttctttcctttttctggacacacagagacaccagtatagaaatgcacatgtgtatacacatacagcagagactgccaaagatgctccctgaggccaaatgctcacccaacaaatcccacaacagagaactatcacattcaatgagtagatgcccttgccacttcaggaaagactgaagatgtgaggctctataaactgagggaccccctaccccaccaacctccttcctggcctctggcagggtaggtggagggcaggggaaataaccaagagctctaacagactagcctcaacctctctcctctgttgcccgggggaagtccttatgtaactaatgtaatgtaaccaataatgtacccagatttatgttaagaagcaagacatgagagcctggattatcttcctatagggtcctaccatttgctttagagacatctgagaactgcctactccccaggtagctgcctgcctcccagaagagccacagcaagttccgctaagggcaaaaaaggaagctaggtgtctacagggaacctaaaaacaaaccacactaacgtgtgtacacacagctgcagagggagacagggacctggtctgctccccactaccctcctggtccagtgggaaccctggccccactgagaaccaatctcctgaggagatgagccaggacaaaggtctcacttgcctgtcaagcagctgtggtgtgacctggtctgtagccccaactaccccaactagcataccctcagtgggagagacagaactcatcccactggatagtctggttcctgagatgtgtgctcctctgctcaaggattcccactgcaaggatgagaaacctgaaggatacacgggagaggctgaaggaagctggtgtacaggaaatggcccgtgggaatcttctttctgtggcctggttcaacctcaaataccaatgttctgacactggttgtatgacctagatagggtagggtcttggctttctcttgaggcctcagtttccccatttataaaacaatcaaaattgatctcagatccatccctcctagtgctgatgttccaagaccaaaaggcccagaagagtgggcctagctaatgtttctgggcctcatcgtggtaacatgcacagcccttgccactcccccatggcccatgtagaaacaaccatgtggccttcactctgcccacagaagctagcaccaggaccctggtcagggttagaggtttctgctgagtcaaagccacatggagggagggagcaagggagagatgcagagtcatgtttccaggaggaggttatctgagcataacagggacagggtgggccacaggatacctctgaggctcaggttcccacctccactccacccaagccttcaatgatgctcatgaatccccaataagaggaggtgggagagaactgagcgcaagcaatggatattgcttaactcaggggaaccaatggcaggcaggcagctacctggggagtaggcaattctcagaagtctctaaagcaaatggtaggaccctataggaagataatccaggggaacagaaggcagaaagccacctgcctcaagactcccaacaacagagggccacgtgctcctacttggaggaggtaaggtccagagaagtcaaggaacacagccaaggtcatccagccagttgacaaccaagctaagaagctaaggatcctaggatcataaaaagaatgtgtcctggccggatgcggtggctcatgcctataatcccaacactttgggaggccaaagcgggtggatcacaaagtcaggagtttgagaccagcctgaccaacatggtgaaaccccatctctgctaaaaacacaaaaattaaccaggtgtggtggtgcacgcctgtaatcctagctactcaggaggctgaggcagaagaatcacttgaacccgggaggcagaggttgcagtgagccgagatcacgccactgcacattccagcctgggcgacagagggagactccatctcaaaaaaaaaaaaaaaaaaaaaaaagaatgcgtgtcctttggacacctctgggttcccaggccagctctggctaatggccctgagcatgtcatttccctttctatgcttcaatcttttcacctgtctcatgggataatgatccaagttttgcagtgagcctgaagcacccagctgaatgcctagcacacagcaggggtcaaggaaacagtgccctctatgtttgcagcccccgcccaactccaactctctgctccacgttccttccactattcaacacatggcaggaagtcagcctgtagggcttcacactacagtctaagctgactgccatctgtccccatccaggcgaggctggaaacgggggcagcaaaaagcccagggacaaagtccccttcccaggcacatgtattatgcactctgcaccaaggaaacctccagataaggtctagagaccaagggccatgtacttcgggggagaggccagaggacttctgaggttttacagagaaaagccaaaggcagcccagtcaggggaaatgtgtagccatagtgccgataaggaaaggccttcaacctgccctggtcagctcttcctgtaagtagaggccccttaccgaaggccccagtgggaggaagggtcgggagtatttggggagaacagctagatacatatagacacacacacacacacaaatactgctcttgatacgagttactacaacaagccaggtcctcactagctagccccaagggtcgggggtatttggggagaacagctagctagatacacacacacatacacacacacacacacacacacacacacacacacacacacagagaacagctagctagatacacacacacacacacacacacacacacacacacacacggctcttgatatgagttactacacaagccaggtcctcactagccagtcccaaggcttaccctcaatgactgcccaagactcagatgcccgctgcattctctaatcctaactccaccagaagccctgcttaccccacatctagcctgaggtctcaacacagggcctagcacctaacaggcccccacctattctttctttgcctttcttttgtccaagatgccccgaaacccagctcttcctctgggaaacatcccagggaaaacacaaacttgagccagaggggtaggagggataagttttttcccagtccaatagagcccattgcctgagcctcttctgcttggcagaatagagaggagaccattcactccaccctttcaacaaacacatgtgactctgaggcaccagtgaaaatggcatctgggttttacaaatgctactgttccatgagggtctactatatgtgtcaggcactaaagggatttaccaaagcaacttcattaaatcgttacagcattagggtcttttagccccattttacagatgaggaaacagcctcaggaaagaagagctgcttgcctaaggtcataccaagaatcagttgtgcagccagggatggagcctaaaacaccccagcccaccagtagacatggggggtacccacagacggagagaatagcagaccaagaaggaactcaaagaggcattgagaatcaacaccatttcacagacgggaagaccaaggccaagtgtcacagcagttatgagtcagggccagaactagaaggtaggtcttctgactcccagctcaaagctcctatcagagggcacttttccttggtagatatcagagaaccacagggaggatcaggtcacattcccagcttccccttcaccctagcacaggacctcacaactacttgttgggtcacagattcagagccaaaatggcctcaaagatctaactcagactggataacagatggtattaaggcattattaattctgttaggtgcagtaatggcattttgattatgttaaaaagaagagagtaagtctgtatctgtcagagaaacatacagaaatatttatgaatgaaatgatccaatgtcggggttttgctttaaaaatactcttctttcaggggagtgagaaagagtgggcgggatagtgatgaaacaaggctggccacgtattgactattttgaagctggatgatgggtacatgagggttcatcattctctctacttttatataagttgaaaaaaaattctatgatataagaaatttgtaaagatctagtctgatagcccccatacacacagattgaggaacagagacccgcaacacaccagagatgggatctgggtataaacctaggggtcatacagcccagggtggcagcagtgtgctatggttaagagcatgggcctcagactaatctaacccagacactgaatcccaactctaccacttattatttcactccagacaagtcacccaccatctctgagccacttttctcatctgacaaatggaagcaacagtagtccctacactcacctagcttagaggggaatcaaagaggtttcctgtagcacctgacaatgtgtcccaaaggatattattttctttatcattcttcttgctgttattatgcatattaatcttgcaccactacaatgtctcaagacccacggctagaggtcagataccaacttgaggctggagcctagagtccctaaaagattagctagctctgcctcaaccctgtctcaggggctattcctgataactgggacacagcttaggggcagccctaggcccttaaggactaaggcagagactcacctacagcccggaagagacaggcgccatcctccttcatctgcttgatgatgaagcccttcttgtctcgtagggccttttcaaaccaatgctcctgctggagggaagaggtgggggtcagcaacagggaaaacctgtactccctccccagggccccgacctcaagctcccgagaggcctagatcattgacagagaggacgctggccaaggtaaagttctcagccctgtttgaccactccatgcatgtgaagtaggagactcttttagggaattagttgctgagtgaaactaagacttacttccaaaagggtcctaggtgccctgagaacagtggccccatatgccttatggcttctgttgaccttgcagggcctggcccagggagccacactgcctcaggcagccagagactcagacccagcaagtgcctgggtggagaatgtggctctacctcaaggagtttcatctaggaaaggtggtgaagagggggtaactagcaagagcctagatcctgaacctgacaaagggctagaggattccaagatatgctgtaggccgggcatggtggctcacacctgtaatcccagcactttgggaggccaaggtgggtggatcacctgaggtcgggagttcgagaccagcctgaccaacatggagaaaccccgtctctaataaaaatacaaaagtagtcaggcgtggtggtgcatgcctgtaatcccagctacatgggaggcttaggcaggagaatcgttcgaacccaggaggtaagaggttgcggtgagctaagatcaccccattgcgttccagcctgggcaacaagagcgaaactctgtctcaaaaaaaaaaaaaagagatatactctagaaggcaaaagtgtgcaaacaatgttctcatctgtgactgaacacatttaacagatatctacacatatatacatatgtatgtatacaaacacacgtacacaaaattgggaaggctagacagcaaaatatccctaagtcctggtgttatcagcgattttattgcactttcccttttataaagttacactaaacccaaaaagctttgaaaatcaagtctttttttttttttttttttttgagatgcagtctcactcttttgcccaggccggagtgcagtggcactatctcggctcactgcaagctctgcctcccgggttcatgccattctcctgcctcagcctcccgactagctgggactacaggcgcctgccaccatgcctggctaattttttgtatttttagtagagacggggtttcaccatgttagccaggatggtctcgatctcctgatctcgtgatccacccgcctcggcctcccaaagtgctgggattacagacatgagccactgtgcccggcccaaaagtctttatctaattcatttggcatcataacctgaccagaactgacaagaatctatttatcccacttggggtaaatattcaaatatttcaatgcagaaaacattcaggtgtttgattatgaggtgctgcctcagaccctgctggaggtgttatgtaacacaaagtatacacaccaggtaagttttataaattgtttttttcctaaattccaaagcacacctggcaccacgaaggttcaacttaaatgaacctgtacaaatgcatatttttttattaaaaaaataatgaccatataacctcttaaaacataattttcatttcaaaacaaaaccaaccagaagcagcagacctttcctgggcccctcacgccctctgctggctaccagaagcagccagcctgacctagcaacaaggctgcaaactacaggatcccaagcctgctccttgtggacacaggcctgcccagggatttataggatctggggtattagagaccagacataggggcccacctatccgtaaggccatttttccccagctcaagcaaggggtggaacccatcccctaagaaagccagaggagaagcatctctggcaaagttgtaagcacaaggtttggaacgcaagagctctgggttccaaccccagctttgccacacacttgctgtctgttatcactctcagtttcctatagaatgggggatatgttgatctaccggacagagctgtgaggagtttcaggacctaaagaagctttgtaaataacgtaccatatactaggggaagttgtcgccaatcacagaaggggaggagatcagcacagagattatgcacaactgagagaccctcagaaagtcctaggtgagtagcgggacaggaggggaggaagaggtgacaagggaatacccagccagtcccatcatcagggcccacaccccaggaaaatgtggctggatttctagagatgacaaagacacctggaagcccttaatgagcttccatgcgcagcacaaggactcctgtttgtgcacaacattccagtagtccaggtgtccctccttgcccccaagcctgtggattaacacactccagccagttatgcccaagtccatcctggccacacatggtcagccatctcccagagtcatgggcctgccccagccaggggtctccagcagggatggtgcaaccacaactatagtcccaaacctgacacaagaataggttcttaaaaagaagggaacacagcgacttcctggctttggagagaggggaaaaagagaggagaaaaggagatcaaacaggagaggggctcctacttatccattcaagaaagacttaccaggtagctactaagtaagatactgggctgggcagtgaggacagtgaaatgaatcagacttagtctccactcttgataagctcacaaactacttagcagaggggtagggaaacaggtaaccaccacaaggtatgaacaaggctgtgaaaaatgtaaatgccaggtgttgtgaaacagaaagaggctgggcgaagtggctctcgcctgtaatcccagcactttgggaggccgaggcaggtggatcacttgagatcaagagttcaagaccagcctggccaacatggtaaaaccttgtttctactaaaaaatacaaaaaaaaattaactgggcatggtggtgcatgcctgtaatcccagctaaatcaggaggctgagggagaagaatcgcttgaacctgggagacagaagttgcagtgagccgggatcataccactgtattctagcctaggcgacagagtgagactctgtctcaaaaaaaagaagaaaagaaaagaaacacagtcattgggccaggcacggtggttcacacctgtaatcccagaactttgggaggctgaggtgggcggatcacctgaggtcgggagtttgagaccagcctgaccaacatggagaaaccccgtctctactgaaaaatacaaaattagccaggtgtggtggtgcatgcctgtaatcccagctactcgggaggctgaggcaggagaatcgcttgaacccgggaggcggaggttgtggtgagccaagatcgcaccattgcactccagcctgggcaataagagcaaaactctgtctcaaggaaaaaaaaaaaaaagaaaaaaagaaacacagtcattaaggctagcacctgagaggaggtgccacctgaccaaaggattaaaacaccaagacctccaaaaatgcttgttaactggatgagaaatgaagtcacttctgccacgaagtaccaggaatgcctggagcccagcaatgaattcagtagagctaaagttctgggtagtactaggcaggtaagcagggaggaccaggaagaaagatgaactcatattaactgaatacctgccccatgccagatgcaaagggtgacctcgtttaattttcctgaccacagcccaggtggcaggaaacattaccctcactttacaaaggcagaaaggaggccagacacggtggctcacgcctgtaatcccagcactttgggaggccaaggcggaaggatcatctgaggttaggagtttaagaccagcctggccgacatggcgaagccttgtctctactgaaaatacaaaaaattagcagggcgtggtggcgtgtgcctgtaatcccagttacttgggaggctgagacaggagaatcgcttgaactcgggaggtggaggttgcagtgagccgagatggcaccattgcaccccagccagcctgggcaacagagcaagactatgtctcaaaaacaaaaacaaaaacaaaacaaaaaacaaaaaaacaaaggcagaaagagaaaggagctggagtttggataccagcaaagcctagtgtagaggcaacagggaaggcccccacgagccacagcatggaggacataccttgcagcccatccacagaatatcctggtttgtctctaaacatgaaagagacctgaataggcccctcgcactgcagggtttgggtcctggggcagtcaaactggcatccaggcttggatctagaggctggactgctagccacccactggctttgtcatcagcagcctgaggagtttgggctctggcccttctctttctccttttggggagaaaatgttgctcaggaagggctagtaggggtggggggtaggggatagctcagccatagataagtttaagctccaacaatgccctggcctgaggagattgtgaaccttgcaaactcatcgctgagcctatgggaaaatccctccatatctttgagcctccacaaaaaggctgagtaaagctccctaacaccagaggatcccaggagctgaggcaagattctgtaacctagtggtctaagggcccaagtgaagttggagcaggctgtggaacccaactgacttaggttccaatctagctccaccaattattagccatgtgatgatgaactgctctgagccacagttttccaatctgtgaatggggataccaagcctcccaataatagggatgctgggcagactcaaatattacagggctttgcccagtaagagaccacttaatgagttcccttcccttccccaggagggaaaaaagcctctctagtaggctgattaatagccacgcaaagatatcaaaccctaacccccctggaacttgtaaatgttaccttataatgaaaaaggtagggccaggcgtcgtggctcatgcctgcaatcccagcactttgggaggctaaggcaggcagattgctttgagctcaagagttcaagactagcctgggcaacatggtgaaatctcatctctacaaaaaatacaggccaggtacggtgattcacgcctgtaatcgcggcactctgggaggccgaggcgggtggatcacctgaggtcaggagttcgagaccagcctggccaacatggtgaaaccctatctctactaaaaatacaaaaattagctggtcatggtagcaggcgcctgtaatcccaactactcaggaggctgaggcaggagaatcgctggaacctgggaggcgaaggttgcagtgagccgagatagcaccactgcactccagcctgggtgacacagcgagactccatctcaaaaacaaataaataaacaccaaaaattaaccgggcatggtggctcgcacctgtggtcccagctactcaggaggctgaggctggaggatcacttgagtccaggaagtggagggtgcagtgagccaagattacgccactgcactccagcctgggtgacagaggccagcactgtctgaaaagaaaagaaaagcccgggcacagtggctcatgcctgtaatcccagcactttgggaggccgaggcgggtggatcaactaaggtcaggagtttgaaaccagcctggccaacatggcaaaaccccatctctactaaaaatacaaaaattagccaggtgtggtggtgggcgcctgcaatcccagctactcaggagggtgaggcaggagaatagcttgaacccaggaggcggaggttgcggtgagccgagactgcgcctgggtgacagagtgagattccacctcaaaaaaaaaaaaaaaaagagaagagaaaagaaaaaaagtgtttgcagatgtaattaacttacattattaaatctggagatggggggttatcttagagtatcaggtaggacctaaatgcaatcacaagtgtccttataaaagagagacagagggaaatttgatacagacagaaaaggaaaccacatatacagagaaggcgatggtgaagatggaggcagagattagaatgatgcagtcataaaccaaggaatgttggcagccacgagaggctagagaaggtctaaattctccctgagagcttccagaaggagtgtggccctgccaacactttgatttggatgcagtgaaactgattgtggacttctggcctccagaattgtgacagaataaacttctctctctctttttttttttttttttttttttgagatggagtctcgctctgtcacccaggctggagtgcagtggcgcaatctcagcttactgcaacccccacctcactgcaacctccaatccgtctcctgggttcaagcaattctctgcctcagcctcccgagtagctgggattacaggcacccaccaccacacccagctaatttttatatttttagtagagatggggttttactatcttggccaggctggtcttgaactcctgacctcgtgatccacccgcctcggcctcccaaagtgctgggattacaggggtgagccaccgcacccggccaacttctgttgttttaaaccacccagtctgtggtaacatttgtcacaacagccacaggaaactaacacaccccccttggtagcactccttggtgtctgttccctagtgcctcacaggtgtgagacaatatggcatggatcccgctctgcaaggtccacctgcctaccatcctccagggtgggaggttagaattaaggcagcaggggcctggaatctcccttctcaccctgggaaactactgaccctgcctatggatggatgagctgccactgaagtgggggtggggtgggggggcaaaagatggcagcagcagtggcagttcatggacagatgtcttcccagagcctatggtcaaaaggtgtttagcattctgtgactcacagctctgtcccagcagccctggtgccaagaccaccccctccagcaaagcacccaggaacactagcctggctccatggacaaaacacagggggccaggcgtggtggctcacgcctgtaatcccagcactttgggaggccgaggtgggcggatcacgaagtcaggagatcgagatcatcctggctaacacagtgaatccctgtctctactaaaaatacaaaaatattagccagacgaggtggcaggcacctgtagttccagctactcgggaggctgaggcaggagaatggtgtgaacctgggaggtggaggttgcagtgagccaagatcgcgccactacactccagcctgggggacagagtgagactccatctcaaaaaaaaacacacacaggcaacccatccaacgaggaacatagacacactactctctaaggaccaacacaagccctccagggcagaaggggagaagagcaaggccccaacatttggctaggccactgagggcagggggattaaaaacctctaagattggcagggtgcggtgactcacacctgtaatcccagcactttgggaggccaaggcaggcagatcacctgaggtcaggagttcaggagaccagctttgccaacatggtgaaaccccatctctactaaatatacaaaaattagccgggtgtggtggcagatgcctgtagccccagctacttgggaggctgaggcaggagaatcacttgaacccggaagccggaggttgcagcgacctgagattgcgccactgcactccagcctgggcagcagagcaagactccgccttaaaaaaaaaacaaaaacaaaaacaaaaaccaaaaaacaaaaaaacccaaggtcctgttattcagtaatagaaaggaatgaagcactgatgtatgctacaacatggataagccttgaacatattatgctaagtgaaaaaagccaagtaacaaacaactgcatattctattattccatttacatgaaacatccagaacagacaaatcaatcaagccagaaagtagattagtggttgccagaggctggaaagggatgaggaaattgggggatcatagctaaagagtgctggatttctctttaaggtgatgaaaatgttctaaaatggactgtagtgatgtgatggacgcacaaatctgtgaatatactaaaagccactgaactgtacacttcaaagaggtgaatagtatggtacatgaattacatctcattaaagttgttaaaagaaacacacccaagggctcagcaccagccaaggacgctgaacactgcttgaaatgtcctagcacaatccccaaaggccaaggggtcccacttaaaactttcatgaagggtgaggggagtgggagcagggaggagactataacttgcttcagagcaatgagtccaacctccctcctcaacactacccatttcatggagggagaaaccaagaaccagaaaagagaactgcctgaagaccacagaaaagcttactgcagaaacaggactcaaatccacgttgcctgggcagagaccccttcctgcttccccaccagctagctacccaattccagttggggtaagaagagcccaagaaatcagcaggttcctagatgccaaatgaagggcctttgctatcaaagataggttactaggagtggacaaaggctcctaggaagaaccaagatgaccctggggcaaactgcccattctgggcaagaggaagaaccggccaaggtccaaggtgagcaaggtcagacacacctgggcatggacaaacttttgcaaaatgggcagctgagggggcaagtagtttgcctaaagctataaagcaggtaaggaggagatgctgaggtctggaggtgatgagagaattgagggatgatggctcaaagcttgccttgctccaaagcccaaactccacacacaactctacctctctacaccactatccaacaggcctcctgacaggaaatcccatcgagcttgttcattacaacatggctgcccacaaaaaatggctgttcatcaaccctgagcctcacacaaaacaggctgcttgtcctgcccaccaagcttggatggctgagagggaacagaggagccaggaagagaggggagaaacccagttcctcctcaaaagacatccaccattctttgccacctccaggtccagagaactttggactgagttccctaaaatcccaaagctaaacaacacctcaccagcattttgcctggccagtgaggaaactgaggcccagagagcataggtagaacctaccctggttcatccagcaaagccttgaaagacccagagttggaacccaggcaccaactaccgtgccacacccagctttttccaccacctcagttcacatgccccttctcaaagagctctgtggggtctccaaactcaggatgcttacaggccaaccttttcatagagcagactctcagcaaggcagccatgcctgggaacccctgacatcaccacccacccagcacctggaccccagagtgccaaaaagactcctaaaggaagtagggatacaagagaatcaggacaaagaggaagcccaagtagtcagaaccccagaatcgccatctagactccccctcaacgacgcctctcttcccaagggatccaactgacctccaggctacaaccacccccagtgacagtttaggaccaagactggggtggcaggaggaatcttccctcttctcatccccaaaagctctcaagttggaccaggtgaggcagggagaagaggatcaccttctttgtcctaagaagtgtggggacagaaagcctctcctgtcattgggaagggcaggtttcatgaacccacaaaacttgattttcatattcttttttttttattagtaaagatgaggtctcgctatgttgccaagcaggtcttgaactccagggctcaagtgatcctcccgcctcagcctcccgagtagctgggactacaggcatgcgccactatgcccggcttactcctatgttcttatggggacaagtataagggagggactgcaaggggcataaggaagtgtttttgagttaccatggcagcataggatgttctttctctctgtccctgggaccagggatgtatcgcaagggaggggagtaaggaggtgtttttgaattatcatggctgcataggatgtttttcctctgtccctaggaccagtgatgtatggctccctgcttctagaggaggaaagaaactacccaaccagagagagaagaaataactggtcctgacccttgagtacaaatggcttatcgtgccagaattaatgatgggaggaagggaccaagaacaaggagctcaagacaaggcttggggcccctgtgaagtacagaaagatttacctgagccaaggggaaaaggaatgtgggaggagaatttccccagagtggcgatgtcccaaacccctttcctgtccctgggaagaaaaaagcttgtcaaaagcagttcaaaacttattatatgacctagaggtgagaagcaagcatagctaggtcagggagagactcggaatcgctcttggtttcagaagggaggctccagactccatgtccccaggacctgacaatcttctcatagaaagtaggaggaccttcttggccctggccacgagggagctctggataaggggttcatatgaccctgaagagcatccaggtccttctgtccaatgggagaggatgacctcacgttcctctccctggacagaaaggattgcctggtgtggtaggaggagagcctcatgcccaagtgggagccaggcccccagtccctaaggcaaacggtatcttgtcccagagagaaagcttgggcccagactcttttcctcagaatcctaccctattcatgtccccaaaaggagttgggagtctaaggcccaagtccccgaggcaggaagtcttatgtccctaaatgacccctaagactagggtgtatgtaagttgtctgaggtgaggtgacagtaccctcagggcaggttcagaaatcaggtcctaaggtggggaacaggccttcacacacctgagttatgattcaaacccttggaggtagactcaggaccctgttccacagggatcctttatccatgccccaagggaagagtctcagggctcaggtctggggggaggagtcctcctgtttctcaggtgtacatcttaagttccttgaggaggaagctcagaccttacctctagacacacaagtcaccaaggtatgtatgagtctcctgtccctgaaggaaagctcaagtgtccttggcagagtgggtctcaggcccttaaaagtaggcaaagatctgtagggaggccccagacatcatctctgggatcccatgttgcccatgtcccctgagtagtcgtctcaggctcaagttcccaaggcatgggtcgtatgtccctgacaaaaagcttaggcccaaggtgggagggcctcaaacccctgttacagaggggaaaatgggatactgtatccccaaggtatgtttcagtcccttataattggggtaaaagggtcacatatgctcgtggggtggggagtctcagatccccaaaaccactcagacaccagccttgagaagaaggatctcctaaagacttcaccttgtctgagacctttgcagcaggacaccaggcccctgaagaggcctcagactcggtctctaaaaacctcagtccataagcaggtggatcttaggccctaggatccaacgctgtgagtctcattttcctgaagaaaggttcaggcccctggtgggggtgctgagggcccatctcttcttacaagaagcttaagatcctgaagcggttcaggcccttgtctcccaagaggtaggtctcaggccactgataggaaatgcagacctttgtcactcagaaaggagataagtaaagctgctggtcattgggtgttggttttggtccctgtccccaagggcaagggaatcatatctccctgtgaaaagtcttacatccctggaaaaagcttagaagatccctatccttaaagggggcgtgtgtgtgtgtgtgtgtgtgtcaggaccttgattctagaagcaggactctcaggcccctgaagacagacttaggacccttgaggtctcaggtctggctattcagtggtcctgtgcagtgttacccagcgaagcgggagaggattgtcctatatgcagagtgtctcagactcttgaaagggcttaggctccttggggatgttcagccccgatctccgaggtctccaccttatttgactttcctggaaggggaatctcaaacttctatcccagaggaaaagagctcttaagccactgaacacatacctaagtctcttgggagacctgagactcctactcaagaggggcgcgatcctacctgtatctcttggagaattcccacctattggccctatatgatgaggtcccagggactggaatgacgactatagaccttaaaagagacctcggatctttaagtctgacaccttaccgtaggcctctagccccaaaatcctggaggggaggaaagaaggtgtctcacatccctaccgccagagaagactgtcaggcccagtgaaaacgcctagatcccttggggcgatctcaaacagccttccttgagtcccttcacagtctgggggtcccatctgccgtggccgctcacccctcaccccacagctcttacctgctcgacagtggcagggtccatagcctcgatgcgtgctgcagccgcctcatactcgtcctcactgttgtagcctgcgccgacctcctcacgctcgggactgcccccgccaaccgcgccaaccccgggagcttgacgtcgccgcttgctgtgcccaggcccggagcagcagccgcccacgcctacggcaccacccacacccaccaccacgcccgcggcacccacacccgccgccgctgcgcccagcgcgtcgccgggaccgccgccgggaccacctgggcccccgcaaggaggtggagaagcctgttgtggccggggacccgccactgcaccaggcggcacggccagcgcccagcgatgaagagcgcccggcggtcctggtagcgggccttgaggcggtggcgaagctcgcggacgggcccccacgacgccggagtcacggtcgcgatcgccgccgcccacgcccgtgccgccgccgcccacgcccacacctccgccgcgccgcggcgccgggggcatcggcccgggcggcggcggctcgttggcggggtcggcgtcgggaggcggcggcttctttttggggagtatagtcatggctgcactgccgagtaccccccaacaaacccggcgcggggcacgccgggagagaacccgg

SEQ ID NO: 1867 - DNA, 28543 bp, Homo sapiens
agtgggtgggcccgtctggccagatggtattttggctgcatagcctttacacacacacacacacacgtgttgctagaacgctgaacatggaccacacacccacccagcatccccaatcccaaatgcagagtagccaggctccagacataaattaaaaaataaaataaaataaaataaaaaagagttggtctctgggaaggagagctcatgcagagatgaagacagaagcccttgggagccaggaccaagaagaaggagaaatccctgccccttccctcaggatccccactccctggtggcctctgccctaagacaggatcattaacactaaccatcaggcctctagcccctttaatgtccagtctcccaagctatttgattttggctccagccctcatttttccaccacagcccaagggaatagcatcctagggggtaggaaggggaggaggtgggtgcagcctgcaggtctttagctggtttctcctggctctaggtctgggtcaggaggccccacgcactccttgctgagccgcacaatttcctgggacagaacttccatatcctaagaaacaaatgaaccatcaggggccagagaaggggacaggctgctcccttgccaaacgtagggtatcatctgtgatttccctcacaccctttcattaatcaatgctcagctgtgtctggcctgggatgagaaggtacttggagaagctcacagcacccccaacagtgggcagggctcagaaaagtcatgaggatgggtggggagctacagataatgggagtgggatgcctcctgtggcatggtgctgctgcaggatacaccaccactctggccacctgctcttctaagtgtgagcttgcttctcaaaggcaggagctgggtctgacccctttctaactctcagagatggggaaagtccttgggtggcagtttgggcagaaagatgtgtgtgtggacccatgggcatgggggatctatggtagacaaattggtggacgaatgaattgtccagaggacagatggagatcaacaggtgggcaggcaggtaactgggtgggtgaaaggtaacacaaggggcaattgatgagtagataagagaatgatatgtcaagaaatgggtggcaggacatggggtagacaatgagataagtaagtagtagattgggtagatggacagatgggcaaatggttgggtgaatgtgtagataaatggatgagcgggtacatggaaggaatgaatggataataagttgatgagagggtggaagatgagagcatgatggagtagttgatgagtgggtaggaggatagctgggaggacaggctgggtgggtgggcaaggggactggcagatgacccaggggctatgtggctgggtaggcaggtggctgggtgaacagatgggtaggctggcaggccacacttgccttgtgcaagtgcatattcttggtgagctgctcctccagcatgttctgcagcttcttgttcatctcccgaaggttctcgtcgcctggcttcactaggtctctcaggacgctgcccagcccgctgcggtctgtgtggcctgctgccacagacacatctgcaagggcccaggctgaaaaccaccccctcggcagagccagaggagagccaggcagagccagaggagaaaagagggagacgaataccaggggagaaggcagcaggaaaagccatgtcatgtaggacagaggctttgacatacaaaacctagctctgtcactcactagctctatggccccgagaaatgaggataactaacttgtggaactggaaagatgcacatgactgtatgtgaagcacagagcacacagaaagtcctcagcacatgttggtcagtatgattctgattaataaagaaaaatctgtgaaggagaaagtttgaaagaaagcaaaagcaatgaagatacagagaaggaaaacaatatagacagcgagacaagatgaaggagtggggtgaaaaagagaaacggagaagagagaagggagagagagaggagaggaagatgaggcacagggagaggaaaggagaaagtggacagagagacacaatggagaatggagagtggagagatgacagagaaagagagaagagggaggaggcgagatcaagagacagtgctttcctgttctcccctccacaggccatggtcttgtcagtagcttcgctgagttccgagaggagaggagagaagccgcagcacagaatggagagggagggccaggtgaaggctggaccagggctgagggccggggaggggacactgaccgatccggctgtccatgacgtaggtctcaatgatggcgctcttccggcagaggtcctctgccatggaagcactgctcacttccaggtgcttcacctgcaagatggcccagcccacctgagacccctctactgtacatgttcacacatgaggcgggcccgggcagaccccacacccacaagggcacttcaagtggggatgggcaggcaggcaggcaggcagcaccttctcctccagcatccatttctcctgctgtgtctctgccagccgctgaaagagctcagccacttcctcatctgacagctctgctggccgagggggctgggcttgagggctgctggataaggactgcaggaaagagaaggggagaggccagccccgggctcagcaccaccgaccccagacaggtgtcagggactggggaggagaaccaggccagaggtgggtgagagaacatgggccctgaagctgggactgttggcccatcttggtaccctcagactctgttttctcctctgcctaaatgggggtagagagtaaccacatcagagccttgtggagaggattgaaggaagatcccaaagcaaatgagatctaactttcagctgacaggaaaactggaagagagggacatgttaaatcataccaccaggaagccagcagaaaaacccaaaaggtagcatacttcctgtggggtgactgggctggcctcttcaacaaattggtctcaggaaaaaagggaccgcactaaagagatttaagggccataaaacaaccagatgtaacatgtgctctgaatctgaatgctagttttcataaaaccagcaagaaaggacattctggggccaactagagaaatctggttaaggtcaaagtatcagacgacatgaattttttttttttttttgagacagaatttcactcttgttgcccaggctggagtgcaatggcaagatcttggctcactgcaacctccaactcccaggatcaagcgattctcctgcctcagcctcccgagtagatggaattacaggcacgcgccactacgcccagctaatttttgtatttttagtagagatggggtttcaccatgttggccaggctggtcttgaactcctgacctcaagtgatctgcccgcctcggcctcccaaagtactgggattataggcaggagccaccgcacccagccaatgacatgaaaattgatcaaattgggaaggtagagacaacagttgaataaaaaacaggttaatctcatctaggttttaaaaagagagagaattctggaagggtatgaactaagaatttattttatttatttattttttgagatggagtttcactgttgcccaggctggagtgcagtggtgtgatctcggctcattgcaacctccacctcccaggttcaagcgattctcttgcctcaacctttcgagtagctgggactacaggcacgcaccaccacgcccggctaatttttgtattttagtagagatgaggttttgctatgttggccaggccagttctcaaactcctaacctcaagtgatctgcccgcctcagcctcccaaagtgctagggttacaggcatgagccaccgcgcccagccctgaactaagaatttataatggtgacgtctggatggtgaaaatattatttttttttgacatttaaggtttttttgtttttgttttttttttaaatagagtcggagttttaccacatttcccaggctggtcttaaactcctgagctcaagtgatccgcccaccttggcctcccaaagtgtaggattatagggatgagccaccacacccggccagacatttaaggttttaaaaaaatctttgctcatttgtggtttttaaaaaatgtactacaatgagcacatactatttgtggaacaataaaaaagttatttccaaaggaaagtggctggtaaggaggctgacatgacagccggcaataataattagtgatcattacaagttggaaaaagggaccttctccttggatggtgcacctactatgagccacataatttatggcaccagagaagggggaattagcccacagatgattaaacagaaagtcagagagagagaatgactggcctgtcctgcatgtcgcaatctgaatccaagttggtgggcttggggaaaagttgacaagaaaatatgtgtgctgcgcccaaagtaggagatgggtttaggtgaggagaaaaggggaggggttctcagatttttgggttgagagaagctggagctgtaggttcttcctttccccttaccctggctggaacagccgagctctccttttcccgcaagatctcccggtagctgaaggaggagatgctactgctgtcccctgtctgggtccggcttggtgagttcatctctgagagaaccagctcctcaaggcctgggtggtggagggaagagaaacttgagccccagtacccctgagtcccagggcagcaaccagcaggaagaggcagaaatagatttaacagagatggaaagagagacacctgggcatggggaaaggcagaagcagacaggaggacagggagagacagagacagaaaaaagagctgaggctgggcgcactggctcacacctgtaatcccagcactttgggaggctgaggtgggctgatcacttgacgtcaggagttcgagaacagcctggccaacatgaagaaaccccgtctctactaaaaatacaaaaattagccaggtgtggttgtgtgtgcctgtaattccagcgattcaggaggctgaggcaggagaatcgcttgaacccaagcaggcggaggttacagtgagccgaaatcgcaccattgcactccagcctgggtgacagagtgagactcttgtctcaaaaaaaaaaaaacaaaaaacagaaagaaaagaaagagctgcctttctggagaaacacatacaaaatgagagggagaaaatggaagaggttggagaaagagaacgacatgggtacacatgggtctcaagtggcagacacacttggacacagggttcagagaaaggaagacagctagagagggcacagggcacatccacttgcagaaagaaaatgccagagatggaaagccagagcagatgatagaaactgagaccctggtgaaagaagtgagccagagcagagacagagagaaaaaaagatgccgggcgcggtggctcacgcctgtaatcccagcactttgggaggccgaggcgggcagatcacgaggtcaggagatcgagaccatcctggctaaaacggtgaaaccccgtctctactaaaaatacaaaaaattaggtgggcgtggtggcgggtgcctgtagtcccagctacttgggaggctgaggcaggagaatggtgtgaacccgggaggcggaggttgcagtgagccgagatcgcgccactgcactccagcctgggcgacagagcgagactccgtctcaaaaaaaaaaaaaaaaaaaaaaaaaaaaaaaagatgcaagcaggctctcgtacccacgcacctaaatctcagtttaatctaatggacaaggtgaatgtattgaatgtatggtatacgattgtaacgtttcccaagattattattattattattttttagacagagtttcagtcttgtcgcccaggctggagtacaatggcgcaatctcggctcactgcaacccctgcctcctgggttcaggcaattctcctgactcagcctcccgaagtagctgggattacaggcgcccgccaccacacccagctaatttttttgtatttttagttgagacggggtttcaccgtgttggccaggctggtcttgaacccctgacctcaggtgatccacccaccttggcctcccaaagtgctgggattacacctttcccaagattcttacattcatctgtgataaaacagaaacaaaactcctttttaaagaaaggttacttcaggagaccgagtgcctcagagagaaattgatttggtgagagatacacatctgttttgccacatcacttaaagccctcgaggatctctggcaagggtggggtgactgagtggggatccgtaggtatcccgagtgggggaataagggaccaagttttctctgagtctgtaatctaagagatgcaccagagccatcactgcattttacttacttaaatgtatttataggccatccccgtcttaaaaaaggctgaagcaactaaagttgtgtgtgtgtgtgtgtgtgtgtgtgtgtgtgtgtgtcttctgcttgaagtggcagaaataacagattggattagctgtataatgaaaacaccacagcgttgctgactatgtataagtctgtctccgtagctcaactgggggcttctagagggcagagactcagggagttttatatcagggaccctgtacttgagcagggagatttatagaatgagagattgtatacaatagatttagaaatgccaagtgaggtgtgggagtgtgtaatgtagtacatacagtgaggagacagacagagatataaacagaagagacgaagaggacacagagtggcgggaagagataaagggacagagaaaagaaagggcgggggccgggcccagtggctcatgcctataatcccaacactttgggaggctgaggcgggcggatcacctgaggtcgggagttcgggaccagcctgaccaacatggagaaaccccgtctctactaaaaatacaaaattagctgggcgtggtggtgcatgcctgtaatcccagctactcaggaggctgaggcaggagaattgcttgaatccaggaggcagaggttgcggtgagccgagatcacaccattgcactccagcctgggcaacaagagcgaaactctgtctcaaaaaaaaaaaagagagagaaaaggagaaaactagagaaagaaagcaaggagataaaggcaaacatagaggaaagagagagaacaaactgagacagaggcagagacagaaacagagaagagacagggcaaaaacgagagaaagatagaaataaagagagaatgcagagaaagaatcagaggagagacagagaaaaggtaaaagatggagttccagagcgacagaagcaggaaagcacagctgaggaagaggcaggactaacctgcagcctgcaggcccaggccctacctcccccatgcctcagcctcctctccctgtcctagtccctcacctgagcggctcttgctgttagtgaggatgtcctgcagtcgctcctgcagcttatctgcccgtttccgctccaaatgcagctgccgcttgaggtccttgagctgtgggggacaggggtaacatgaggactgaggcccagtgggcccataggagggaggctacaggtaggagggagccgtgcttgggcaccgctctgtcttaccgcagcactgcccttcttctccaggatcctctgcccatccactgtgtccttcacctcctgtgggagaaagcaggcatggctggtagatgccggaagggctgcctgaagcatgctccctccctgcccctcctgtacgctgaggatcaggggtgtgtctggggctgtgcagtgaccactgacctgcttcaggctgctaatggtcttcaggtggcagtcccgctcctcctgggcctgctcgagctgatcccgtacatcctgtagctcctcctccttgccctgcaaagcagaaagcagcttaggcattggcttgggaagcctctgtcctcccaggagggcccgtcactgtctggagagaggaacaccatcatgcgagaggcaccttcagctcggcagcgtgctgctcccgacactgcttgagggcttcctcttgttcctgctgctgctgctgcagggattcctacaagacaagtcccaggtctggccacagccccccagaaggtatcatgcccagttaggggtatgagggactgcaatgggggcccagaggtatgcagaaatgaccctcctgcagggaaccccacacgcccttaggcaatatgctgaagtgtcacatctaaagttgcaccattcgcatggttgacttagatttgcatttacattttattttatttaacaaaacatagcgcttactacatgccaagaatgttctaagagttttacatatattaactcattttctataatcctcccgtaatacctagatggtagatattattgttaccccctttttaccattgatgaaaacaggccacagagaggtcagataacttgcccaaggtcacacagctaggaaatggcccagccaggattcaaacctagacaaacaactggctccagcctgtgctcttcactgctacatgacaatgcctttcagtgtattatgagatttccagaaaatggcaacaaaggttctttttccgagacagagtctcactccgtcacccaggctggagtacagtacacgatatcagctcactgcgacctctgcctcctgggttcaagtgattcttctgcctcagcctcctgagtagctggaattacaggcgccagccaccatgcccggctaatttttgtatttttagtagagacagggtttcaccatgttggccaggctggtcttgaactcctgacctcaagtgatccgcccacctcggccttccaaagtgctgagattacaggcgtgagccaccgcacccagcaggttcttgttcaataacatcagtgtattgcattaatttcctgacagaagtacagtttcaggagaaagaggtgcctttccaaatttgcacaaaggcagggcagccttaacacgtgacagtctgtcctatctgatggccatcccctgatccactccagagggctgctattgagccaggggactgtggggatatccctaagtccagaaaatctcgggaagttccagggcctgaccactcctgcttctgtggtttgacatgagggccccaatcagcctctgttcctcaccaggcatcaccaactcacctcggcttccttcaagcgccgttcaaaccagcccttggctccatccatggaatgtacctgagcttgaagttcttccactgtctgctggagagtctccagctcccgtgtccgggcctgggatggggcagactgtcatgggccaggaaggcagaggagcgggcacctgatgcatgccacccactggcctatcagcaacgctgtggttcccaggttttagaggaagaagggcatcatcatctacccacccaccttctcctcccggatctgcccacggagctcctcctcctgacgcttcttgtcttcatgcagctctcggagctcacgctcatagcgggcacgcacccccagcacctccttctcatgccgtagacgaactgctcccagctcttccttgtgctgggacttctcttgcagcgtttccattgctagctcatccagcatggccttccgcttctccgcactctgggggccaggacgatggcagtcaacttccttccacaacatcgaaaaaaggcctccaaccctcttcccatgcccaaggaactagccaaactccactccctcccatccccactgaactggctaaggcactcacccatccttatagaactggtcactttctttctttcccctcccactctcatggatttggccaagaaactggtcaaccagaaaccagtcaattttcctttccctcctatccccacatgtttggttatatcacctcctcccatccccatggactgagccaattcctaccccccatcctctcccttcaaccctcatgttcccctaccttccgagcctcctgtaattcctgggtcaactgctccttctcctgccctatttcttgaagttgttccagcagtcgactattggcccgtaatgactcctaatgcagacaccaaagggaaagagtttgataaagagcatccagtaggtgctagtcacccaggaccatctggtagaccatctcccttctccctggtaaagttggtattgtgatctcaatttctggataggaaatatagcagagactgctagttgctccccagtattcattcttccttacttccctagcaataaaatttatcatcgggcatacagctgtctagcagatgtttcccctcctcccttatggttaggtgtggccatgtgatttatttctgtatgtggaagtggtgagtgtaatttaggttatgctcttaaaggaaaggggcacactcttccctgcccctttcctccttccttccagatagaatacaaacatgatggtcggggagtttcagcaaccgtcttggatgccaagataaaagtcttgtgttgaaggtggaggaacagcaatggagaaagaacctgggtcacagatgactggaaagccatcattccatccctgaataacctacctggacttttaatgagagggaactaaatttgtatcttatttaatctactattattctggtttctattatggaatcagaatggatattgcttgggaggctgagccgggtagatctcctgaggtcaggagtttgagaagcctgaccaacatggtaaaaccccgtctctactaaaaatacaaaattagctgggcgtggtgccaggcgcctgtaatcccagctactccggaggctgaggcaggagaatcgcttgaacccaggaggcggaggttgcagtgagctgagatcgcgctactgcactccagcctgggcaacagagtgagactccatctcaaaaaaaaaaaaaaaaaaaaaaaaggaggccgggcgtggtggctcacgcctgtaataccagcacttcgggaggccgaggcgggcagatcacgaggtcaggagatcgaaaccatcctggttaacacggtgaaaccccgtctctactaaaaatacaaaaaattagccgggcatggtggcaggcgcctatagtcccagctactcgggaggctgaggcaggagaatggcgagaacacgggaggcggagcttgcagtgagccgagatcacgccactgcactccagactaggtgacagagcaagactccatctcaaaaaaaaattaaattaaattaaaatttaaaaaatgaaaaagaattgatatcctaactaactgaagaggctcagtttcagagaagtgaaatgacttgtcccagaacacacaggtgctaataagttagggagccagactggaacctaggtcctcctgactccagtcttcccactccaccttactggggacttcactgggccattactagggaactaggaagagacaggccagagccaaaggtgttacctggagctgggagttgaggtcatctttctgtcccataaggtcctcgtactcagcctgctgctgctgcaactcagctgccagcccagtggtctgttcccggagcatattcagttcttgggtctttgctgtttggatctggagaaagtagtggtgatgagaagtagagtgaaagggaccccaggggccagggacagggtatgagccccctagttccagggaaacagggagggaggtgggaagagaaccaggaagagagaggaaatttcaaacagaaaaacaatgaagagaatgggtaaatgtggtatgttcatacaatggaataccacacaacagtaagagaacagatctgtgctgccacgtggataaacttacatagtgctgccagaaagaagtcagagacaaagagcagctgattccatttatatgaagttaaagaacaagcgaaatgaatcttatgttgctagagatcagaataatggttacttctgggggagtactgactttgaaggggtaaaggggaccttctggggtactaaaagtgctttatactttgatctgggtggtggctatggtggcggggagagagagagaaaaaaaagagagagacgaagagaggattcactgagtgtacacttaagattagtacatttcatgcactttactagagagaaactagaaacaaagaaaagcagaagccgggcgcggtggctcatgcctgtaatcccagcactctgggaggccgaggcgggtggatcatgaggtcaggagttcgagaccagcctggccaagatggtgaaaccccgtctctactaaaaatacaaaaattagctgggcatggtggcacacggctgtagtcccagctatttgggagggctgaggcaggagaatcgcttgaacctgggaggcggaggttgcagtgagccgagatcgtgccatagcactccagcctggacaacaagaccgaaactccgtctacaaaaaaaaaaaaaaagcagagataggccaagcacagtggctcacacctataatcccagcactttggaaggccgaggtgggaagatagcttgaggccagaagtttaagccagtctgggtaacatagtgagaccctgtctctacaaaataattttgttttctcttttttgagatggagtcttactctgtcacccaggctggggtgcagtggcacaatctcggctcactataacctccacctcccaggttcaagcaattctcctgcctcagcctcccgagtagctgggattacaggtgtgcgccaccatgcccagctatttttttttgtatttttagtagagacggggtttcaccatattggccaggctggtctcgaactccgaaccccaggtgatccgcccgtctcagccttccaaagtgctgggattataggcgtgagccactgcgcctggcctaatttttgtatttttagtagagacaaggttttgccatgttggctaggctggtctcaaactcctgatgtcaggtgatccgcccacctctgcctcccaaagtgctgggattacaggtgtgagccatcatgcccggccaataagttttttttcgttttgttttttgtttttttgagacagagtttcactcttgttgcccaggcttgagtgcaatggcacgatctcggctcaccgcaccctccacctcctgggctcaagcaattctcccacctcagcctcccgagtagcttggattacaggtgcccaccaccacacccagctaattttgtatttttagtagagacggggtttctctatgttggtcaggctggtctcgaactcctgacctcaggtgatccgccctcctcggcctcccaaagtgctaggattacagaattgagccaccatgcccggctttttttttttttttttttttagacggagtctcgctctgttgcccaggctggagtgcaatggcacgatctcggcttactgcaacctccgcctcctgggttcaagagattctcctgtctcagcctcccgagtagctgggattacaggcacacaccgccacacccagctaattttttgtattttagtagagatggggtttcaccgtgttgcccaggctggtcttgaactgagctcaggccatccacacatctttggcctcccaaagtgctaggattacaggcatgagccaccacgcccttttttttttttttttttttttgagacagagtattgctctgtcgcccaggctggagtacagtggtgcgatctcggctcactgaaacctctgcctcctgggtcctggttcaagcaattctcctgcctcagcctccccaataaaatttttaaaagttaaaaaaaaaaaaaagtagggatggatggccagagagaagagggctggacgccaacagaaaggagcaacagaaacaaagacaggagaacagcatggggtccagaccaccctaccctgatgtggaccagaagcagatggagatgggggaactggagagggatcagcaagggcccccaggtgttctttacctgctccagggcagccaggctagtcctcaaggcattgttctcagccaaaagcccttccacttgttcctgtgcatctgcactctggatggatacctggccccacgtccacagcaggtgagagtgggtccagaacagggggacaggacctacccacgaccaagaaagaaaggacacacacacacacacacacacacacacacacacacacacacacacacacacacgaaggcctgggggaagcaggatccctgggaccttgcctgactatgtagtacccactcaggctgcccccatcctgaaccccagctccctgagcccacgcagtacaatatacctgatcttgtagggcccgcaaagctgctgcatgttccaggcgctccccctgccgctgatctctcagctctgccaagctctgtggagaccaggggagcccattttacacctcagcctctcctggggtgcatataaccgtacagactctctgtttgaccacccagcagcatgttctcagcacctgtgggtctcagactatccagccaacagcaatctcaggttcacccagacgccaggtcactaccctcaggggcctcagacacagtcaacccctctatcccagcgtacaagatctcaggcacgactagactcctggccctagctgctacgcggttcaaactcactcagctcccatccataagaagtctcatactcacccagattctagcttgggagctccaggattctcagacacagtcagccccatggatctcagatgtagtcagcacccaaggatgacagtttcacccagcctcccaatcccaaccaccaggggtttcagacacactcatctcccacgtccctacttcccaggtgagatccacccaaactcatagtcccagatcctagaggtctcaaactcacaacctcctagtttccaggtcctggtgaactctcagactgaccccttcacctgtcactctgctccccagtctcttggaatcttcagacccagttaaccaccagttcctgggggtctcagctttacccagactcccgtctcagaccccatgttcccagtttctagggacttcagaaccacaagccaccatatcctccattccaagggacctcagactcaccttttctagaaggaaacccagaggcttcagaaccatccagcccccagtcctcaggagcctcagacccacctaaacttctgctccagcccctggaggtctcagactgaccagctttttgttcacagccctcaaggatctcaggactacctagcccatatgatcccacttcctaggtgtcttaggcccaagccagcgcccagatcctgaggatctcaaatgcactcagccttcagccccaactatctcacccttgaaagttgtatatctacccagccatgtcctcagcccttgggagtcccaaatttactgacatcccagcccctaaagatttcaaagtcacccagcacccagggagttcagacttaccccagttcctggtcctaggccctagtgaccacagattcatccagactgtggtctcaaacctccaggagtttcagatttacacaaacttatagcacacagccccctaagtccttagccccctgagatcttacactcatgaagactcctataacaattcctagggctctccaattcccattttcctagctcctggggggccccagaacccatttccaacacaggaaatctcagactccccagccagcctccatggacctcagacctctccaggctcccagtcctggcccctaccccagggatctcagaacccagtccccatcacctgattggcagcctcaagttcctgctgcagcttctgggttcgagccaactgggctttgtgatcagcttccttccgttgttgtaattcctcaatcttgttcctaggagtgatggggagggggtgtgttggacatggcttgaggcccagtctcctagctctgcccctgtaatcttcactgggcactgtcccaattgtccaccaatacccgcaaatctggcagttacctgctgtcattaaacagagtctccttttctgtctgcagacggcaaaaactgggcacagaaggacagatgtagatgggtcagttccgtaagttaattcccccctcggcccccagtacccttgggaaaaagaaatttacctttcttgtttctttttcagtttctcggagagctggggagagaggtacagacaagtgataacattgagaataatataaagacaaacctaaaattaataaatatagacacttcttattaagtcatttttggaagccaggatttacttatgttgtcttgtggaatcctcaaaatagccctgacaagtgagtagtaccagttttacaaatggggaaacagagtcttggaaaggttaagtaatttggttgctcagcgggtcagcaacaacaatattatctccacccagatccttcaggttccaaagcccggtatttatgctcccaacatagtggccaatggccatgttatagattggctaggctgggaggcctggaaagcaggatatcatgactgggtgccgcacccctgggtctccaggtcctaagataagagccaggagtctgtaaatgcttgcatgaatgaatgaatgagtgaatgggcaaagctgagagatggatgggatgaaacttatcatgcacaagatatagtgggaccacattaactcattccatactgaaagtaactctgagacataggtgtgagtctctccatttcacagatgatgaaacctaggctttgatggggtacaatgccccttctgccctaggattgggaatggaatgggaaagaatccagcagattgggagcagaatgggaaagagccaagcagccgcaccttagcaagttcctcctgcagcctggatgtttcggcctgctttgagctctgcagggaaggatgagggatgggagggttgttgttagcaaggacaaggagaagccttcccctgccctcctgcctccctcaccccatcagcccacaagatggtgatgtcacagccatctccgtgggactatagacagaggtagaacatctgccctgccttctggcattccagctccaacagactcagattcacctctaagccttgcagctgttcccagagcaatctcttctcctctttctccatttcccatttcagctccacctctgccaacggcatgggggccaggacggtgggggccgggccccctgggggatccccctggccctcactgacagctgagaacttcccggcttctttcccatagcgttcctgcagggctggtgagtagaacagggatatatgatggatgaggtggtctctgaagtcccttgccatgcctcgaatagagggagaactggccttcaacccctcaggtggcagagtccctgtgccaaatgaccacatgcctaaaagacgaaggttcagctctatccatgcctctcacatttttttctttttttttttgagacagggacttgctctgtcacccaggctggagtgcactggaatgatcacagttcactgcaaccttgacctcctgggctcaagtgattctcccacctcactctcccaagtagctgggatcagaggtgtgtgccatcatgccgggctaattttttgatttttttgtagagacaaggtctcgctacattgcccagactggtcttgaactcctgagctcaagcaatcctcccacctcagcctcccccaaaaatctttttccgtggctgggcacggtggctcacgcctgtatcccagcactttgggaggccaaggcaggtggatcatgaggtcaggagttcaagaccagcctgaccaatatggtgaaaccccgtctctactaaaaatacaaaaattagctgggcgtggtggcgcacgcgcttgtaatcccagctactcgtggggctgaggcaggagaatcgcttgaacccaggaggcagaggttgcagtgagccgcgatcgagccattgcactccagcctgggtgacagagtgagactccgtctcaaaaaaatctttttccctagacagtcttgctctgttgcccaggctggtgtgcagtggtgcaatcatagctcactgcaacctcaaactcctgggctcaagcgatcctcccaagtagctgggactacaagtgcacaccatgcccagttaattttattttattatttatttatttgtttattttcttgagactgagtctttctctgtcacccaggctggagtacagtggtgtgatctcggctcactgcaacctctgcctcccaggttcaagtgattctcctgcctcagcctcccaagtagctggaattacaggcatttgccatcaaacctggctaattattgtatttttaatagaaatggggttttgccatgttggccaggctggtcttgaactcctgacctcaggcgatctgcccaccttggcctcccaaagtgctaggattacaggtgtgaaacaccgtgcctggcctaattattttatttttagtacacacaagttcctgctatgttgcctaggctggtcttaaactcctagcctcaagagatccttctgcctcagcctcccagagtgctggaatcaaggtatgagccactgtgcccaggctctcacaaatattttaagccctatcaaccactaagattctgtttactattaaattagcccaagctggtttcacaaatcccattctcaatccttgaagccccacccatagcccttgaaggccatgcccaccatatgctaccactgacttacagctgaatccctcctagagcctcctaattcctactcacattctactaagtctccctcctggtcatggaaccagcatccatcaccacagaagtcccagctgctctccaaagttccacacaccacatgctcccacactctatcaagctttctttcagctttcatcccagaccccacttacaatctgggctcagaatcttcccaacactccattcactttttcacttagcaaatatctcctttttttttttgagatggagtctcgctctgtcacccaggctggagtgcagtggtgtgatctcggctcactgcaagctccacctcccaggttcacaccattctcctgcctcagcctccagagtagctgggactacaggcgcccgccaccgtgcccggccaattttctgtatttctagtagagacggggtttcaccatgttagccaggatggtcttgatctgctgacctcgcaatccgcccgcctcagcctcccaaagtgctgggattacaggcgtgagccaccgcgcccggccgcaaatatctcctttttgacattcaagctgctaatctgtaacatctgctaggtaccagacactgaactaatgcagaatgatatcaccttttatctctactacaatcttctgggtgacagacatcactacatgcactgtgtagatgataaggctttggctcagagaggtgaaatggcttgtccaaagccacacagggcatgggccaaccctatttctgaagcccttctccttcccctgagaggatgacggccttccttgccctactcaagccccaatgtctccgcatccccaggagggcctctatgcacctgccacgttcttctgcaaggctgtgttttcagcctgtagcctcagcagctccccatccacgaggggcccagcttgggcaacccctgctcctgcagccccctccttcagttgctggttctcttgctccagctgttccatctggctgcagagctgaacagaggaagagaaggggcagagaagcagagaatcagagcagtatttgctgaaacctacatagcatttgtccatgtactttacaattcacttaattcccataatgaccctatgatataggtgccctcccactttacaaataaggacattgaggcacagagatgttaaacaagttcaaattcacacatcttttaagtggcagagtcagagaataccaagagcataccaagtatgaggacaccaaaaaccattttcctcttcctactcccaacctcagagatgcaatccaagacctcaggctcctctggaagttgttagtgctacagacagcctcactgcaacccctcttctgtggagggctggatcctgggcccagagatagctccctctcatcctaagcaccacaaagagctcgcagggcatttccagggccaacactgatgacagctcctgcattgccagccgttagtcttggagaggtatacaatgccaatacaactaagccagccccctgcccaactcctggctgaagtacacttctcaaagcagtcctgagaaaattccttgtccccattttcagatgagaatatcgaggcctacagagaatttttattttattgcctgcaatattttctttctttcttttttttttttttttttgagatggagtctcgctctgtcacccagcctggagtacagtggcacgatttcagcccactgcaacctccgccacccgggttcaagtgattctcctgcctcagcctcctgagtagctgggactacaggcatgcgccaccgtgcccggctaatttttgtattcttattagagacggggtttcgccatgttggccaggctggtcttgaactcctgacctcaggtgatccacctgcctcggcctcccaaagtgctgggattacaggcatgagccaccgcacccggcctgcttgcaatattttctacccagaacaccaatcctctcatccagttcttcacctaactggcttctttgcatccctcagtgctctgctcagatgttgcctttaaagtagtatccctcaacacagaaaattccagtactctctgtcacagcactgttcatttctttcttacctagtactaatcaaaattttcttttgtaacaagcacagattctgaaaccagactgcttgaatgtgaatttctgctctgccatttactagctgtgtgacaaattacttaatctccctggaactcagttttcctcatctgtcagatagggatactaatatctcacaggcttatttcaaagattaaatgagtgaataatgtagagtacttcaaacaggacttggcacacagtaagcaccatataaatgtcagctatcactactagtattatttgtttactgttatcatctttctcctcatcccacccccagaatgtaagctacccaagagtggagatcattctgtgctgcttacaactgtatttccagaacatagagcatgtggtgggtactcagtaactatttgtcgaaggaacaattaagctgaaatgtcttgatgaataaggggtggtggcaggtttaacgtagctctctctgagagcacttccagttcctgggaggagttggaggaggaaggggactatgtaggaagtctctacgactagcccagtgctggcccagggcagatgcagggaaacaagctggatttatggaagaatgtctgcccctgcctcactctgcaagaatcatgataccatggaggctggaggcaggaagcagtgaggagtcagtcagtgaagccagcagttatgtgaataccaggggctctgaactaggagcaggactggggcactggaatgtattaagtaaaggagtgatgtcataagatctgcaggtcagaacagcctctgtggtgtgaactaagtagaagaaactagaagtgaagagaccagggaggcggctgtagaaacagcagatgataagtggtagaggctaaggcaaagcagggccacagggtggatataaaactttttttttttaaattgagacagagtcttgctctgtcgcccaggctggagtgcagtggtgcaatcttggctcactacaacctccgcctcccgggttcaagcgattctcctgcctcagcctcccgagtagctgggactacaggcacgtgccaccacacccggctaattttttgtatttttagtagagacggggttttaccacgttagccaggatggtctccatctcctgacctcatgatctgcctgccttggcctcccaaagtgctgggattacaggcctgagccaccacgcccggccataaaacttttaaaaagtcaaatattttagagggaagatgagttaatagaaggataatattataactaatgcttccatagctgatactatgtgcaaggctctgttttaagtgatttacgtacatttattcatttaatcctcacaaaagccctgtgaagaggcaggtactgttattatcatgacttccattttaaacatttgggaaccaagaaccaggcaagttaagtaacttcctcaaggttacagttagtaaaaggtagagccaagattttaatctaggccttctggttccagagtccctgctggtacctactacttgctcaactgcctctcctggtattgtacctgcttaaaggttattttcggttttgtttttttaaggtcataggcactatattctcagatggagccttagaaataccatttttgggccgggcgcggtggctcacgcctttaatcccaacactttgggaggccaagacgggtggatcacctgaagtcgggagttcaggaccagcctgaccaacatggtcattttctctactaaatgtcctctcccacccatgtcattttctctcatctctactaaaaatacaaagttagccaggcatggtggcatatgcctgtacttccagctacttgggaggctgaggcaggagaatcgcttgaacccaggaggcagaggttgcagtgagctgagatcatgccattgcactccagcctggacaatgagagtgaaactccatctcaaaaaaatttgctgccatgagacttttttccttaaaacacactaaaaacatagacaattatcaactgtggatacagaagatagatgagggaacaaaagacaatgtctccaactgcccagtagatttagaaacagacaggacactaaaatcaatggggagatagaattagtagctccaggatgaattatctggaagaggtagaaccccaggctcatgtcagatgaagagaagaaagagaaaagggaagaagctcgaacacttttccatcctatattaagcataagaactctgcctaaaaccccccaacaccttggagcaccacagcatcaaccccacattatacacatggagacttgaagctcaaataaaaggagtgacttggccaggaaccaggtgacctcagggctcaaagccttctaatcccagcagagtgagcggccccatctgtcaaattactgccccccagcagcaatccaggacctgtttcagcaccacggacagtgctccagggccagaccctgtccaatcactctctgccgctgttaggtttcagcccagatgacccctacccctcatttcccctttgactatcccaggcaccagcaccttgctgaactcggccattagtgtgctgttctgcaaacggaagtcctcctcctggctgtgcagctttgcctgcagcatctcattttcactcagcaatacctcgacttcctgcagtggcagacaagggccaggactccagcaagggcaaaaaggatagggaggtagggcaaagaaacagagagagggagaaaatgacatgggtgggagaggacatagggtacagagaatgaggtgatataggagaaagagacatggggagggataaaatgagagacagggaaaggaagataaagacatgggaaggtagagagaagggaatacagggaggaagagagcggaggaaaagacaggaagataatgattggggagagaggaagtagagatggggaaagggggagagatagaaaaggggagagggattgggagggagagagtgaaaaagacggagagaagaacaaacagaaatcaacagggagagaacagaacagggagaagaggaggggtcaggaaaagaaatgagttaggaagagagaggaatggggtggaagaaacaaggagttagagagagaaagcagaaaaaagagaaatcaccgagacaggaacaggagggggagagacaaagagaagattgggaagagaaatgagtcagagagacaggaacaggaaaacagacagagacagaaagagactcagagaaaagaatggaaagagagagaaggaaagagacacagagttaggacaaatacagggaaacaaggacagatacagcaacacatggcagtgaggtagtagcagatgtaaaggcacacaaagaaagaaaggccagtacaaggaaatatcagcatacagaaatagcccaccaagacatctcccagtcacactcacccacaagggatccccttacctgagctttcttgctcttgctcagtgcctaaagtgggggtgggtgggaagagagctaaagtgaacagagatggactgccttactaggatatggagacaattgtgccaagcgttttgggaggacaaggatgacaggggttgcaggatgggagcatcttcaaccacagaacatgtgtgacaatttggagcccaaaggaatgatggaatgagtgtgtgagtgagtgaatgaatgcaagtcttgccctggggccccagcacacataaatcatcctttcttggaagctcttgaggctggtggggggacaggggaggtagggagatgccctggtatttaaccatttatgggctggatctccagactcagaaactgtggcttcattgctacatctgtccatacatgtctctgtgggtccctcccacgcagtgtggaaactgtcgctcccctactgggcagccaagagcattgccagcttaggggaatcagcatcctaccaaagagaagtgcagcttcctgactgtcggattttctgcatactgtattcgttcatccaacaaatatttattgagcacatattatgtattaacattgtgctaggtatggctagatatggggacagagcagtgacaaaggagcacctcgaatgtcttgaggggccacaataggttatatcctatctcatctttagaggatctgagaggtgggtttgctctcattttcccaactggaccaggacagagatgggaagtaggagcacaaggcaggagtgtgagtagaggatgggaggcagattcgaggtagatttactgatagatttgaatatttaattaaaagtcagtgaatgagaatgagtaactgaaattagaaatgaattaaaagtaaattaaaattaatcactaaattaagcaggattaggtaaaattagcaactaaagagaattccattgagaatcctttaaatgactacgtgaaaacagcatgcaacattaggtctggttcactgtaggtgctcactggagggatgaatgagtcagataggtagaagcaagggtggatgggtaggtggatgggtgggtggagggaggtaccttctgagctttgctgaactccttatccaagtaggcgaccttctgtcgaagactggtgagttctggtgtcgggaaagcagggaaactcagcctcagccagtggcaagaaactgaaaggccttcctgccaggcctctgagggaaaacctcggacaccattccccaaagccacccccatctaataaggccctcctggctcaccaacaccattcttgcgtagttcatctgaaagctggtagttgtttgtccggagttccaggagctgagcctttgggggaggcaggaagggaaaagacttggtcaggaaagcgcccctacccctaccatgagggaaccaagcccctaagctccacagaccttacgccctccatgtgcctctgtagctactccttaagacctgtatgtgctacacccaaagtgaccttccaggccctcagaccctggctcaccttttccagctccacttataaccccagccagcctcacccctccatctcacactacaatccacgctgcactcaggccatcccagagcactgcccccagtcagggtcttgcttgtgtgagttccctggctctccatgcccacaggataaagttcctcctcctcatcctggctgacctctccacacactgaacacacactgtcaggggtgttgtccatatttctgaccagacctgggggcctctgatggcagggggttaagggcctgtcttcctccctctttcctaagggaaaagggtcaagtattctgcccaactttcattgagtcagggggctttccagggtccccccacctccaaggctctcaaaatacatccaggcccccttcaataattaagggaggaccaggtgcggtggctcacacctgtcatcccagcactttgggaggccaaggcgggtgggtcacgaggtaaggaattcaaaatcagcctgcccaatatggtgaaaccccgtctccactaaaaatataaaaaattagccgggtgtggtggcgcacacctgtagtcccagctactcgggaggctgaggcaggagaatcgcttgaacctgggaggtggaggttgcagtgagccgagattgtgccactgcactccagcctgggtgacagagtgagactctgtctcaaaaaaaaaaaaaaaaaaaaaaaaaaaaagaattaagggaaagtgccaggcgcagtggctgacacctgtaatccaaacactttcggaggccaaagtgggcagatcacttgaggtcaggagttcaagaccagcctggccaacatggtgaaacctcatctctactaaaaatacaaaaattagctgggcgtggtggtacgcacctgtaatcccagctactagggaagctgagataggagaatcacttgaacccgggaggtggaggttgcagtgagctgagatcgtgccactgcacactatagcctgggtgacagagaaagactctgtctcaaaaaaaaagaaaaagaaaaagaattaagcatcctcctccctaccagccctataggaccctgaggctggttctacccagcaaggccggttccttcccattaaggaacttactgttccttcccctaccaggacttttccctccctcccacgccaccagcctccactcactgttctctggtagtctgctcaaggtcagagggcttggccttcacagaatctttcctactcctgtcctctccaggacccagtgatctgtctctccaagtactggtccaagtggaatatcctttgtaccccccgagacttgccccccaacaaagcccagtagttctccctcattcatggcccagtgggatcaatgttcctcattcaagggtattcccactcccctcaagatctccccagtcatgatccattgggaatggccctacacccttcagggtaggcctctacaaggccttgggtaggccagttggatgactcttactcacttagaatccctttcagatgacagtggtcttccccattcatgggttaatcaactcgcccttccattctcagtgtccctcacacagggacagctggtttccctcattcaaggaccaattggattacctgtcctccctcagagttcctcccctccccatgcaggaccctgttcagaccccccccccagtgaggaaccctctcaacaagggcccattcatagtgcaatgctatggcctttcattgcatctcagagtccccccaaaagaatcaagtgggggtacctccccaaagcccagtgatcttccctccttgtagtccaaggtatcaatcttttacccctctggtcctccccccagttaatgggattaatggtattacccattcatggccttcttcaccccaggcctaatgggatcacccttaatcatccaatggtgccgccccctcttaggatgcactaccaaccaccaatggcacaggatctccacctcccaggaacaatgacaacatctggggtctttccccaatccccgggcacagtggtatctcccccaaaacttaccacctcccacccgctaatggttctgccctctcaagggctcccaccaccatgacgcaaacgacccaacacccgcttccttcctctccagacaaaatggtttcgccttctcaggatctccttccctcaaagcccattatcatcacccgccgacggtgtcccctgcacgggcccaaaagtctcgtcccctccaggtctgagtaaggtaccgcctacttaatggcgctctcccagcccacaatgctaacagagtccaaccttcaaagccgcagagtatctcggaatccaatagtctcaccactccgagcctcagtttcccttctccagacccaccccataaactcagggtccatcccaaccaaccccttctcagagctgatagcacgacctctcgctaccccgcccccggtcgcctagccgggtggtctttcccaccgcgagcggcacctgcatccgctgaaactcctcctcagacagagcttgcgccatgttcctccccccacccccccgccagctttctgcgc

SEQ ID NO: 1868 - DNA, 36347 bp, Homo sapiens
tttccagtggcaataggtccagaaggaggtttaataagcagcaaatcaaatacaaactccaggcccccagacagaccctgctggagagcattcacacctctgaggtcaagccaaggtccgtgccattgcatcctctgcccagaggcccgcccaacccctgccccacacagaacagagtcgctcagggaaactgacatttggttttattgtgccaaggacattacagatggcggatcttgtcaacacctgcagggcacgggtgccccatctgccaaggctgctcccacactccctacactcaaatcccgggtggcagccataatccccaaagatgacccccaccccaagattccaaagaagctagtggtggtggaagcaaaaggaatgcagcaaggtcagggtttcattgtccaagccggcctgacacctgccgccctgcccttgcccagtgcacaccctagaccctgggccggcctccatgcagctggaggccagaagacagcaacccatatctttgcaccctcctccatgccccatggcctgcctgcccagaaagatgccaccttcacagagccagtgctgtcgtctatatcatttttgattagttgattttataagataaaagtaattttaataaagaaaaaattcaacattgaaggctcagacgttcttgggggtactgggaagggaaatttcccacttcttcctcccacctccctggcatcagtgtcggggggtggcggcaagtttttctcatcttggaaggaatgaggggcagggagactttcctctgtctgaatgtctctctcctctggggctgcctggctgccagttggtctgtctctgtgtgcctcttgtctatcttcggcacccttgcccgagtcccctgtggaatgcagggatggttctgtgcgggatggggtggggggcaacagggcacatcagctggcagagagacaggtgatagtggcagcggcaatgagagagagtgcaggggtgggctagccagagggaagtgaggaggagggaaaagaggggagagcagaaagaacagaaggaggcaagagggaagaagccaaagaaggtgaggtggcaccggagagcaggagtactggggttgggagatggtgtccaatccctgggtctccatcaactcttgtctgggggcgggtctctgtgcactttgtttttcttcatactgtctaggtattcctgttgggacactgccagcaccgaagctaggatctcatcatcatcccagtcattcagacctgctgggcgagaggaagaggaaaaggatgatggagcgctctcagcctgccttctcctcaccctgtgccgacatctggggctctggagaaatcccatagggcccttctcactcctttctcaaaacagaaggatctgctaggcctgtgaaaccccacttagaccccagacccttctggggcaaattccttggatctgaaaaatcccctccagtgcctctcccttcttttcttggggagatggccagaggctccagaaagcccctctcaggacttgccacttcttccagtctctcccagctcctagcagcctccatccccccagacaaaggaggcttaccaaaggcagagggggacatctgctgaatgagggcccggcactccaaagcagggtagagggacacaaggggggaagttgcccggtcggcccctgccgagaactgactgcttgtacctgaagcagacggacagtcaaaggtagggacccaggatccaggacccaggacccaggacgtgcctcctaactcccagcacattccctgtgggcaagtcactgacctggcgcacagggcgaaggaggtttggcaagagctaaaacagtgcctggggaagggggcttcatgcccaattcagcatgcagctcagggtgctcaggtgacgaggctgaactccgctgccgcggggaccggctagtccactcctccaggccactggaggctgctgctgtggccgaactgcatgtggcgctggctttccggggctgcagcggggaaggtaaatgcgttaaggaccaccagcagccatgaccttcttgtgacccatccctgaatgctggctcccttcccaggaccttggctatgatacagcttctatgtaggtcaacatcatccccactcacacggtggaccacaagactcctcacaggacagaggtggagctccttaccctttctctcacacccctacagccaatctgacaggaaaccctgttacctctatcttgaaaatagatctcaaatccaaccccttctcaccaactccactgccagcactggccaccagtcacctggcctactgcagtagcctcctcctcactggcccctgcttctgccctcactcaccagactccactggatgactagcaggcaaggcgatcttattaaatccccaaccacatcctgtccgtcctctgctcacaatcctcccatggtttctgcctctctgagagtaaatgccaaagtcctcgccacagcccacaagcccctacccaattggacccacaacctctctgacttcatctactactacattctgttcggatacaccggcctccctctgggctgtgcctgagttgtaccaggtgtgtgggcctgctgtcctcccctccatgtgcgctcagctaactctcaccttctgcaaggctcaaatctcacctgctctgaggcctaccctgactgcgctatttcataccgtgaacgcacattcctgctcagcccctttatcctggctctacactttccatccatagcacttcccaactaatttattcattatatttattattttatttcactctgcaaaactgtgaacatcacaaggacggggatcttggtctgctgggctcacctatgtatccccatatactgaaaacagggcctgccacagactggtagtaggtatttgtggaataaaactcagctccttcagccgggtgcggtggctcacgcctgtaatcccagcactttgggaggccgaggtggtcggatcacgaggtcaggagatggagaccatcctggctaacacggtgaaaccccgtctctactaaaaatacaaaaaattagccaggcgtggtggtgggcgcctgtagtcctagttactccgcaggctgaggcaggagaatggcatcaacctgggaggcggagcttgcagtgagccgagactgcgccactgcactccagcctgggcgacagagcaagactctgtctccaaaaaaaaaaaaaaaaaaaactcagctcctgccagccaacatctacaatcactccaaactccttgcgattttacaattcctcagatgcttgtctgccccgcccctccccgctcccctaacaattcaaccttcctctgtgaagactaaccggagcccccacctccactgatctcccagtcagggtcaaggaccccaccattgagttgtctctgccaacagacgagatcgttgagggcagagtagtccagatctgatgttacattctcagtagagacctggcacacaagggcagtcaacaaaagcttgtgtctctgaagctatccattattctcgtgtcaccagcagcatggctgccctcctctcactccttaagtgcctgttctgcacaagtatttaaagttccaaggtacaatgccaaaactaagaccaagatgagttacagatggtgctggatgcttccttccctcccagatgtcaaaactgcttaatttttttctgctcgcttgagggcaaagcatgagaagtaatgagtttttggccaagcctgtgacagagtccatgacccacctggctggggcctcggacctggcgagcctgtttctcctgatcccgcaaccactgcaggtaggattcccgagccacctgctcctcgatggcttcatttgtggcctcccagtctgtggcccgtttcttgtcttctagcatctgctgttcaatccatgactcctccgatgtttttatggcattcttcatcagagactgctctgcaaactgcaaggagggagaggaacagggatgtgcaataacacactgaacctgcccaagagccagaacaggctcagcgaggtaggcccacaggccccagaaaaaaaaggagacaggaaagcaggtactcccaaagagcaacactccacagactacctcttgattggggaccaggggaaagcaggcttgggatgtgggacctgtcattccaaactcctatgcttgtaagacctgactctaacccccaaaccacctcaactgaggcactgagactggagcagtcaggtgccttccaacctgggacttattttttttttttttctgagacgaagtatcgctctgtcgcccaggctggagtgcagtggggtaatctcggctcactgcaacctccgcctcccaggttcaagggattctccagcctcagcctcccaagtagctgggattacaggtgagtgccaccacccccggctaacttttttgtatttttagtagaaatggggtttcaccatgttggccaggctggccttgaactcctgacctcaggtgatccacccgactcggcctcccaaagtgctgggattataggtgtgagccactgcacctggccctgggccttaatttaaagaagccccatccagtgatgactgtttcataatgttgaggactttcacacacatgagcagatgagacacatacaaaaattagctatgtgtgcaccgggtggagggagtattcaagcatgtgaggggttgggggaagtagtgggtgtgtgagggaataagggggcagtatcaacatggtgtggggtgctatgagttacaggacactacatcagagtactgtttttcaggctgagatccaacagcatttttaaaaaatagaaaatatcagaatatatcccagggaataagtgcaaatgttgtttcatgaagctttagttaacattattttaatgcacatatacacatcacacacaaatgcatatatgctaagtaatcatgtaaaatgtattcttttctttttcctgcagaccttgcattcagataaaatgtaattttttactgtgaatagttaaaaacaattcgtaaaactatgttagaacaagccaattaaaaaaatagtcaaaaaatctaaccactctggcagtgttaaacacactccaagtgttttttctactctcactcaacaacaatcaacacaggagacttctgtgaccaagtgtgcgggctggggggagggtgttttcccacacagcaagcagcggacacctggtgtccatcctccaatgcaattcaatacccagagacagcctgggatcccacaggttgagggctcagtcccacaagactccccccaacccccttcgaacaccagtcgaaagtctgggcctccagaatttctgactgaccagctataaattgggattcccacaatacttttttgggggttcaactaacttgctagagcagctcacaaaacccaggaaacacgtctgccagtttattatagagaaaattacaaaggatacagatgagatgcacagagtgagatatgggggaagggacgtggagcttccatgccctccctggggtgccaccctctagaaacttccatgtattcagctacccaaaagctcccagaacccaatccttttgggattctttggaagcttcattatgcaggcattattgattatgccattggacactagtgatcaacctaatcttcagcctctctcccctccccaaaggctgggggatgggcttaaagttgcaaacctctaatcctgccttggtctttcaggtcaccagcccccatcctgaagctacctagaggctgccagccatcagtcacctcattagcatacaaaaaggcaacactttgcagattctaaggattttaggaattgtatgtcaggaagtcacaaacacaattcaccaaagaagctatacagatggcaaataagcatatgaaaagatgctcaacagcatttgccaataggcaactgcaagttaaaataatgagataccactacacacctaagagaatggctaaaatccaacacaatgacagtatcaattgctggtaatgctgacaacaggaacttccaaatcattatggtgggcatgcaaataatacagccacttgggaagacagtttctcagttcctcataaatcaaaacataatcttacaacgcaatccagcaatcttgctcccaggtatgtatacaactgatctaaaaaattacgtccacaaaaaaacctgcatgcacattacagaagctttattcataatcatcaaaaactggaagcaaccaagaatgtcttttaataggtgaataattaaactggtacctccataaaaggaacattaagtgataagaaagaaaccagctaacaagccatgaaagaacatggagaaaccttaatgcatactgctaagtgaaaagaagcagtctgtcacattgaccattttaatttcaggggggaaaaaagcaaattggctgcaggtggctcacccctgcaataccagcactttgagaggccaaggcgggaggatcacttgtccccaggaatttgagattggcctgagcaacacagtgagatcctgtctctacaaaataaaaatatttttaaagttagccaggcatggtggtgtgtgcctgtggtcccagctacttgggaggctgaggtgggaggattgcttaaacccaggaggtaaaggctgcagtgatattgtgccactgcactccagcctgggcaacagtgatacactgtctcaaaaaaaaaaaaaaaaaaacagtatgaaaaggctacatactgtatgattacaattatatgacattctgaaaaaggcaacccacaaagacaatagtgtttgcaggaagagggaggaagggaggggtaagcatatggagtatgaggaattttaagggtggtcaaactattctgaataatactgtaatagtagatacatgacattacacatttgtcaaaacccatagaatgtacaacacaaagagtggaccttaatatatgctatttaaaaaaaaattaggaaggctgggcacggtggctcatgcctgtaattccagcactttgggaggccaaggtgggtggatctcctgaggtcaggagttccagaccagcctggccaatatggtgaaacctgtctctactaaaaatcaaaaaaattagctgggcgtggtggcgcgtgcctgtaatcccagctactcgggaggcagaggcaagagaatcacttgaaccacggaggctgaggttgcagtgagccgagatcgcaccactgtactccagcctgggtgacagagcaagactctgtctcaaaaaataaataaataaataaaataaaataaaataaaaattaggagatctatggccagcgcggtggctcatgcctgtaatcccagcactttgggaggccgaggcaggcagatcacctgaagtcaggagttcgagaccagcctgggcaacatgatgaaaccccgtctctactaaaaatacaaaaattagccaggtgtggtagtgcatgcctgtaattccagctactcgggaggctgaggcacgagaattgcttgaacccaggaggtagaggctgcggtgagttgagatcatcgcaccactgcactccagcctgggcgacagtgagactctgtctcaaaaataaataaataaaaaattaggagatctgagatcccagcatagaatgcaaaaatgtgacaaaataatacaaatgtattacaaacatgaaacaaccttggccgggcgcggtggctcacgcctgtaatcccagcactttgggaggccgaggcgggcggatcacgaggtcaggagattgagaccatcctggctaagacggtgaaaccccgtctcttactaaaaatacaaaaaattagccaggtgtggtggcaggcacctgtagtaccagcttctcgggaggctgaggcaggagaatggtgtgaacctgggaggtggagcttgctgtgagccgagatcacgccactgcactccagcctgggcgacagagcgagactctgtctcaaaaaataataataataaaataaaataaaaataaacaccctcatttgaagggggtgggggtacaagtaggtcactttcaaaatgaatggagtctgtaacaccaaaggcaaaaaagaactatatgtagcattgagctatagtgataaagttgtttcccacgggggtacgggtgaacaagtgtgattctgctacgcgtgtatatggaaatgagcagttacataaatggatggtaggaaccagtgcatatacatctgatggcgtatctactgttggagagggaatttgcagatgaacaaggggagaaggctagaatgaagcatgtgataatggatctgagttggagacatcagtaaggattcatgtttaatataaatacagatggttacaggtagaaatatttatagatatgtgtacaaaggccactatacatacatgtagctccttgctctatcagctgacagggcctagaagcatggacaacctgatatcgaagagcacattcaacacctaggtcttgatttctgttaacagtctccaatacatgccagggctctctaaagaaatggctgattgagctgggcgcagtagctcacacctgtaatccctgcactttgggagaccgaggagggtggatcacctgaggtcaggagttcgagacttcagcctgcccaacatggtgaaaccccatctctactaaacaatacaaaaaacagctgggtgtggtggcgcatgcctgtaatcccagctactcgggaggctgaggcaggagaatcgcttgaacctgggaggcagaggttgcagtgagctgagatggcgcccttacactccagcctgggcaacaagagcgaaactccctctcaaaaaaaaaaaaaagaccatattgatgtacgtaataactggaaaaattaataaattaaggatgagttaaggatgagacacagatcctccttaaagatttccaaataatctatgtagatactctaccctcaaggggatggggcataaccatttcttaggcgtgggctgcacatagtgacttccttccacacagtacagtatggaaaaggtgggaaagagtaaccttaggtggagaaacctaacaaacactacttctgccagttgatcaagggtaacaccaacaggcataaatgacactcatagtataaacccttgaaatgatgtaatgacaatggcactttacctctgtgatcttcctccctaagacccacaaccctagtttaaacatgagaaaaagtccaaaagagacatttcctacaaaatatttgatcagtactccttaaaactgtcaaggtcatcaaaacaaaactgagaaactatcaaagataaaggggcctaaggaggcatgcagatttcatttaatagtaacgtattaggctgggcatggtggctcacgcctgtaatcccagcactttgggaggccgaggcgggtggatcacctgaggtcaggagtttgagaccagcgtggccaacatggtgaaaccccgtctctactaaaaatagaaaaattagccaggtgtggtggtgggcacctgtaatcccagctacttgggaggctgaggcagaaaaatcgcttgaacccagaaggcggaggctgcagtgagccgagatcgcctcattgcactccagcctgggtaacagagagaaactctgccttaaaaaaaaaaaaaaaaaaagtattaatgttggttcgcacattgtaacaaatgtaccataatgatttgaactgttaataacagcagaactgggctgggcgcgttggctcacgcctgtaatcccagcattttgggaggccgagatgggtggatcacctgaggtcaggagttcgagaccagcctttgacatggtgaaaccccgtctctactaaaaacacaaaaattagctgggcgtggtggcgggtgcctgtaatcccagctactcgggaggctgaggcaagagaattgcttgaacccgggaggcagaggttgcagtgagccaagattgcgccattgcactccagcctgggtgatgagagagaaacttcgtctcaaaaaaaagatgataataataataataataataataataataataataatagcagaactgtgtttgggaagagaaggatatgtgggaattctgtattatctcctcaattgttctgtaaatctaaaactgctctaaacaattaagtctattaaatacaaaaacttaaaacattcatttttattttttctttcagacagagtctcgctccgtcacccaggctgcagtgcaggggtcaaatctcagctcactgcaacctctgcctcctaggttcaagtgattctcctgcctcggcctcccaagtagctcggattacaggtgtgtgccaccacacccggctaatttttttttgtatttttagtagaaacagggtttcatcatgttggccaggctggtctcgaactcctgacctcaggagatcctcccatctcagcctcccagtgttgggattacaggcgtgagccaccgcacctggccagaacattcatatttttgaagaaagaaaaagaggaagctgggtgcagtggctcatgcctgtaattccagcactttgggaggccgaggcacaaggatcacttgagcccaagagttcaaggtcagcctcggcaatatagtgagaccttgtctctacaaaaaaaaaaaattttttttcatttttttacaaaaagtttttttaaaacactggccgggcatggtggcgagcacctgtagtctcccagctactcgggaggctgaggtgagaggcttgcttgagccagggaagtggaggctagctacagtgagcctagattgccccactgcactccagcctgggtgagagagtgagaccctgtctctccacccgcccaccaaaaaagaaaatgagccattaaaccaggacaagtcacagatgaatcttaaatgcatagtgttaagtgaaaaaagccagtctgaaaaagctacatactgtacatttccaattatatgacattctagaaaaggcaaaacgagagtcagtaaacagatcgaatacaaaaaacaagaaaattctgagaaactgtcacagccaagaggagataaaggggacacaacaactaaatataatatggcaccctggatgggatcctggaacagataaaggtcattagggaaaaactaaggtaatttgagtcaagtatggtctttagttaataatatgtcgatattggctcattaactatgacaaatgtactatgttaatacattaatcatagcgaggcatatgggaactctgtaatatatttgtaacttttttttttttttttgagacagagtctcattctgtcgcccaagctggagtgcagtggcacaatcttggctcactgcaacctctgcctcccagtttcaagtgattctcctgcctcagcctcccaagagtagttgggattacaggcacccactgccacacccagctaatttttgtatttttagtagagacagggtttcaccatgttagccaggctggtcttgaacccctgacctcaggtgatctgccagcctcggcttcccaaaatgctgggattacaggtgtgggccaccgtgcccagcctctttgcagtaattctgtaaatctaaacctgctctaaaattaagtttatttaaaaacaaaacaaaaaagaaccctatgttggagggtgtgttggtgttaggctatgtgtttccgaaaatgaagcaggagtactttgtgtttgtagaagtgaaacctgaatagaagataccaaaatcctcagcaaatgactgtaagagagagagagagaaatgaatgagaatctatcggtatgtgctgggaaaatgcactgccaccttctgaacacctactaggccccaggcccagtgggaggtgctttctgtatcagccaagctgccagcctggaatacttacagaatctgcctagatcacacagccagtgagtggtggggccaggcctgtaccccatgtctctgtgaccatggctgtctgtaaccactatgatcccaggagaaagatccatgccaagatgcccagagcaagccctggctcactgctccaaaataggactccacatcctaaaatgccagccctcaacgggcacaaaagataggtaagccaactcagacaggcaaaccaagaccaaagaacaagccctgagagatcaccttaagtaactccctattttttttttttttttttgtaagggtgagacctcaggggagagaggagacaggatatttttgtgagttaggggcaaaacagactccaacagaggtttctgacctctatatccagcagccattctgggcacagggacccactcacccctggtttgaatgatggcaggcccagccccacaccaatggtggccttgttaggattcaccactgaattatagtggatattccgatggtagctaacacgaatgggttcgtcctcgttttgatgtatcccatggaatgtgttgatgggttctgcagagaaagagaaggagggagcatccacagcaggccaggttgggcaggctcgaatgaggcaccatctttccctcacctacccactgcagaagtacctgtgctgtactggtacacctccacaggacggttgtacatctctgccatggcctgcatctcaatgtggttgccatggcaattgtttttccgcttcctgttaatgtaggtggtaaagtcctctgtgacatagttggagaagtagtcggcattcttcatctgcagaatagattggaaggttaaggtctgtgtggagaagaaatcctcccaccctgccccttccccaaaggcctccattttctcaccagatagtccatgcaatgctttcgcacaacctcatgcatgtcctggtctccatacacctggtcagctgtgggggcagaagaaagcagcagctagggtcagagatgccagagaagagctctgaatcatagaacatcctttggggaggaggaactgggggaccagggaaattcccttttctaccccaaggcctggagagttcttgcccttgtaggctagaacggggtcatggaaaaatatggcaggcagggccagacttgaagaacaagagagtgcaggtgagaggaacacatccacaggcctcttgggcagatgactttgtctagggtacacgtggccactcagagaaatcaacaacattctaagttccacaggttggcctcaaatgctattgattcccacaccccctttgctttccacatgaggaaactgaggttcagggggagtttgtggtttgtccaaggtcacaaagagtcagtctgtgacagagtcaactctgaattcagttttcctgactcctacaagtcaacatggcctttgtaggctgaaaaaaaagggaacaaagacaaaaaaaggaaagaaaaaaaaatgggctccaagcccagttctgccagatactagagagttgagtgaccagaggcaagtgacccaagtgttctgagcctcatatacctcatctgtaaaatgggaaaaagagggataacaggccaggcgtggaggctcacacctgttatcccagcactttgggaggccaaggtgggcagatcacttgaggtcacgagttcgagaccagcctggccaacgtggtaaaaccccgtctctaccaaaaatacaaaaattagccgggcatggtggcgggcgcctataatcccagctacttgggaggctgaagcaggagaatcgcttgaacccaggaggcagaggttgcagtgagccgagatcatgccactgcactccagcctgggcgacagagtaagactctgtctcaaaaaaaaaaaaaaaaaaaaagggataaccaaatggcaggccttttgtggggattaaatgagataacgggtataaaataactaccactgggcttgggacagagtagccacagagtaaatcagaattccttcctccgtagggaggcctgaatgtggggtactgtgaaggtgacagaggtgagtaaaatcctgcccctaccttcggggagcacacagtctagtaaaagagataagacacacatgcaactaactttagcttaactcaggatgggcagcctgtggcccgaatagtccaggcgtcgtgagatttggtcaaactaaggcgagaaggaaacacactccctctgcttcgcttgaggatcttcacacatgccgttccttctcttcaggacgctccttccatcctcgtcagctgcctacttctcaaacaccaatgtgttctttatttatttatttatttgagacaaggtctcgctctgtcgcccaggctggagtgcagtggcgcgatcatagttcactgcagccttgacctcctgggctcaagcgatcctctcgcctcagactcccaaagtgcctggattacaggtgtgagccaccgcgcctggcccaacatgttctttaatacagttccccactacccaggacacctctatcaccagatttatcaaaggtgtgcatagacttctgcccgaccacactgggctcccacagaaggcaaagggcagttcacaccaaagtccacccccagctcagggcccgatacagtaaaggaaatcaggaaaagtttactgagcaaatggataggctgggtaagccagggagctcttctccctgtgaaattaaagtgggcctgaagatcatgcaagtctgatttccactggttttgggaatttccctttgtttccccagaggaccactgctctgatgggatctccctggggcatggggctagggtcaggtcacacaggaacactcctgagttcttccctgtcagtctacctctctgaagaactgtcagaagaacaccttccctgccttccccttcctaccctggagtgttctgtgagaaaggctactctgagatagaaaatagggcccatgtttgtctccagtcctcttggaggtgaagagacctgaagggtaagggggtgtggaggttgtgaaggcgggaaggggggtagccccttcaccaatgtaaacaaggatgtgggttctgcggccacactctcccccgccctccccagcggcatttccagcaagtcacatgtcctgcgcacaggctgggggccccctgctgctgcctttcttagaagccaggaccacagagcccgcacagtgagctacttggggagctatttctgtagactgagcttggggtactgggaggcagtgctgttggcagctgcagtaaacaggaacaaagatgagaatgaaggggttaaataggggttggctggccaggctcagagagataggctgaggtgctggagaaagcccatctcctatggaaaggtcaacggtcatttccaggcctgggagttctatcttcaagagctagatgccagatgcaggaaaatggggaaagagaggagactgtggaacagggaagggatctgggggaaaaccccctgagggtcccatttctctgccactgacccctttgcctggcagaaaggctctgctgcctcctagctgtgtagcaatggataaggcctttaacctctctaagctgaaatgtcctcatgcataaggtggagacagtaactcctcttccatctgctgggtgttgtcaaaactacacaggaggtttgccaagcacctaaggcacagtaggtggtcaagaaacaggaacacaatttgtcatgacgacaatgattccttcatatgctagttacccacgagtcagccagaatgttgccataaccacttatgaagcccttcctcatttctgttgcaattcctcagccagaggaaagccccaaatgcagacctaggatgcatgtcctctcctggctctctacctttagcgaaaccaaaggtccacaagtctacctctaggccgttagttctaacaaaacttcagcagttaaattaatatcgaattaacaatacaggcttcataaaacagggtcctaaagtatggacgagttatgacacttctttacttatctgtaaaatgtaaaataccaccttctctcctcaatcctatgatggcactgataggtgatatggtataacatgtacctaatcacagcttttgaggggggaaacacaccacactgattataaggtataccctaagtttggaatcattaacgtggaagaaaatatacatctccaaaccaaggaaaacagcaatagtactatcccaacaagggagaatagaaggatttctccaataatataaggcaggaaaagcatctaagcacagagctaaacacataggaagtactcaacaagaattcatttttggccaggtgtggtggctcacgcctgtaatcccagcaatttgggaggccgacgcaggtggatcacctgaggtcaggagttcaagaccagccgagccaacatggtgaaaccctatctctactaaaaatacaaaaaattagccaggcggggtggtggatgcctgtaatcccagctatttgggaggctgaggcagaaaaatcgcttgaacccgggaggtggaggttgcaatgagccaagatcacaccactgcactacagcctaggcaacaagagcgaaactctgtctcaaaaaaaaaaaaaagaattcgtttttctgactttcctagctccacctctgtcctccagaaagccctcctcttcccagaaggctggcacacagggctgggggccaggcttgacttccctgtggaggggtctgaggttggggggatgacctgcagaggtaggggaattcagagaacttgttttgatagaaactgaaactcctcctcttgctgacgctgcacttgtgggcaatctgcacctgttctcccctcccagaggccagctggaagggggtcccccaccattctacctctgttcccatctcaaacagggctcagaaatcctcagtacaatactacaattggtcccacaccaaagacttttcacactccaactcattctatccttaccaaaacactcttactttacccaggagacacagaaatgtggcaaagcttgcctgggatcacagatttagggggagtgaaggggaggccaggctctcaaagggtaactgctggccccagctgatattaccaccttcaccccaatccagccaccatcttagtcaccttactccctggggcaggacctgatcttgtgtgcctcagtttccacaccagcacaagcaggaatcagctagaacccaggaaaggcatgggagagggcagagattatagatatcaggggctgcatctctccctagggccacagaggccaatatgaaccttaccctccccatacacaccccacttctttcctttttctggacacacagagacaccagtatagaaatgcacatgtgtatacacatacagcagagactgccaaagatgctccctgaggccaaatgctcacccaacaaatcccacaacagagaactatcacattcaatgagtagatgcccttgccacttcaggaaagactgaagatgtgaggctctataaactgagggaccccctaccccaccaacctccttcctggcctctggcagggtaggtggagggcaggggaaataaccaagagctctaacagactagcctcaacctctctcctctgttgcccgggggaagtccttatgtaactaatgtaatgtaaccaataatgtacccagatttatgttaagaagcaagacatgagagcctggattatcttcctatagggtcctaccatttgctttagagacatctgagaactgcctactccccaggtagctgcctgcctcccagaagagccacagcaagttccgctaagggcaaaaaaggaagctaggtgtctacagggaacctaaaaacaaaccacactaacgtgtgtacacacagctgcagagggagacagggacctggtctgctccccactaccctcctggtccagtgggaaccctggccccactgagaaccaatctcctgaggagatgagccaggacaaaggtctcacttgcctgtcaagcagctgtggtgtgacctggtctgtagccccaactaccccaactagcataccctcagtgggagagacagaactcatcccactggatagtctggttcctgagatgtgtgctcctctgctcaaggattcccactgcaaggatgagaaacctgaaggatacacgggagaggctgaaggaagctggtgtacaggaaatggcccgtgggaatcttctttctgtggcctggttcaacctcaaataccaatgttctgacactggttgtatgacctagatagggtagggtcttggctttctcttgaggcctcagtttccccatttataaaacaatcaaaattgatctcagatccatccctcctagtgctgatgttccaagaccaaaaggcccagaagagtgggcctagctaatgtttctgggcctcatcgtggtaacatgcacagcccttgccactcccccatggcccatgtagaaacaaccatgtggccttcactctgcccacagaagctagcaccaggaccctggtcagggttagaggtttctgctgagtcaaagccacatggagggagggagcaagggagagatgcagagtcatgtttccaggaggaggttatctgagcataacagggacagggtgggccacaggatacctctgaggctcaggttcccacctccactccacccaagccttcaatgatgctcatgaatccccaataagaggaggtgggagagaactgagcgcaagcaatggatattgcttaactcaggggaaccaatggcaggcaggcagctacctggggagtaggcaattctcagaagtctctaaagcaaatggtaggaccctataggaagataatccaggggaacagaaggcagaaagccacctgcctcaagactcccaacaacagagggccacgtgctcctacttggaggaggtaaggtccagagaagtcaaggaacacagccaaggtcatccagccagttgacaaccaagctaagaagctaaggatcctaggatcataaaaagaatgtgtcctggccggatgcggtggctcatgcctataatcccaacactttgggaggccaaagcgggtggatcacaaagtcaggagtttgagaccagcctgaccaacatggtgaaaccccatctctgctaaaaacacaaaaattaaccaggtgtggtggtgcacgcctgtaatcctagctactcaggaggctgaggcagaagaatcacttgaacccgggaggcagaggttgcagtgagccgagatcacgccactgcacattccagcctgggcgacagagggagactccatctcaaaaaaaaaaaaaaaaaaaaaaaagaatgcgtgtcctttggacacctctgggttcccaggccagctctggctaatggccctgagcatgtcatttccctttctatgcttcaatcttttcacctgtctcatgggataatgatccaagttttgcagtgagcctgaagcacccagctgaatgcctagcacacagcaggggtcaaggaaacagtgccctctatgtttgcagcccccgcccaactccaactctctgctccacgttccttccactattcaacacatggcaggaagtcagcctgtagggcttcacactacagtctaagctgactgccatctgtccccatccaggcgaggctggaaacgggggcagcaaaaagcccagggacaaagtccccttcccaggcacatgtattatgcactctgcaccaaggaaacctccagataaggtctagagaccaagggccatgtacttcgggggagaggccagaggacttctgaggttttacagagaaaagccaaaggcagcccagtcaggggaaatgtgtagccatagtgccgataaggaaaggccttcaacctgccctggtcagctcttcctgtaagtagaggccccttaccgaaggccccagtgggaggaagggtcgggagtatttggggagaacagctagatacatatagacacacacacacacacaaatactgctcttgatacgagttactacaacaagccaggtcctcactagctagccccaagggtcgggggtatttggggagaacagctagctagatacacacacacatacacacacacacacacacacacacacacacacacacacacagagaacagctagctagatacacacacacacacacacacacacacacacacacacacggctcttgatatgagttactacacaagccaggtcctcactagccagtcccaaggcttaccctcaatgactgcccaagactcagatgcccgctgcattctctaatcctaactccaccagaagccctgcttaccccacatctagcctgaggtctcaacacagggcctagcacctaacaggcccccacctattctttctttgcctttcttttgtccaagatgccccgaaacccagctcttcctctgggaaacatcccagggaaaacacaaacttgagccagaggggtaggagggataagttttttcccagtccaatagagcccattgcctgagcctcttctgcttggcagaatagagaggagaccattcactccaccctttcaacaaacacatgtgactctgaggcaccagtgaaaatggcatctgggttttacaaatgctactgttccatgagggtctactatatgtgtcaggcactaaagggatttaccaaagcaacttcattaaatcgttacagcattagggtcttttagccccattttacagatgaggaaacagcctcaggaaagaagagctgcttgcctaaggtcataccaagaatcagttgtgcagccagggatggagcctaaaacaccccagcccaccagtagacatggggggtacccacagacggagagaatagcagaccaagaaggaactcaaagaggcattgagaatcaacaccatttcacagacgggaagaccaaggccaagtgtcacagcagttatgagtcagggccagaactagaaggtaggtcttctgactcccagctcaaagctcctatcagagggcacttttccttggtagatatcagagaaccacagggaggatcaggtcacattcccagcttccccttcaccctagcacaggacctcacaactacttgttgggtcacagattcagagccaaaatggcctcaaagatctaactcagactggataacagatggtattaaggcattattaattctgttaggtgcagtaatggcattttgattatgttaaaaagaagagagtaagtctgtatctgtcagagaaacatacagaaatatttatgaatgaaatgatccaatgtcggggttttgctttaaaaatactcttctttcaggggagtgagaaagagtgggcgggatagtgatgaaacaaggctggccacgtattgactattttgaagctggatgatgggtacatgagggttcatcattctctctacttttatataagttgaaaaaaaattctatgatataagaaatttgtaaagatctagtctgatagcccccatacacacagattgaggaacagagacccgcaacacaccagagatgggatctgggtataaacctaggggtcatacagcccagggtggcagcagtgtgctatggttaagagcatgggcctcagactaatctaacccagacactgaatcccaactctaccacttattatttcactccagacaagtcacccaccatctctgagccacttttctcatctgacaaatggaagcaacagtagtccctacactcacctagcttagaggggaatcaaagaggtttcctgtagcacctgacaatgtgtcccaaaggatattattttctttatcattcttcttgctgttattatgcatattaatcttgcaccactacaatgtctcaagacccacggctagaggtcagataccaacttgaggctggagcctagagtccctaaaagattagctagctctgcctcaaccctgtctcaggggctattcctgataactgggacacagcttaggggcagccctaggcccttaaggactaaggcagagactcacctacagcccggaagagacaggcgccatcctccttcatctgcttgatgatgaagcccttcttgtctcgtagggccttttcaaaccaatgctcctgctggagggaagaggtgggggtcagcaacagggaaaacctgtactccctccccagggccccgacctcaagctcccgagaggcctagatcattgacagagaggacgctggccaaggtaaagttctcagccctgtttgaccactccatgcatgtgaagtaggagactcttttagggaattagttgctgagtgaaactaagacttacttccaaaagggtcctaggtgccctgagaacagtggccccatatgccttatggcttctgttgaccttgcagggcctggcccagggagccacactgcctcaggcagccagagactcagacccagcaagtgcctgggtggagaatgtggctctacctcaaggagtttcatctaggaaaggtggtgaagagggggtaactagcaagagcctagatcctgaacctgacaaagggctagaggattccaagatatgctgtaggccgggcatggtggctcacacctgtaatcccagcactttgggaggccaaggtgggtggatcacctgaggtcgggagttcgagaccagcctgaccaacatggagaaaccccgtctctaataaaaatacaaaagtagtcaggcgtggtggtgcatgcctgtaatcccagctacatgggaggcttaggcaggagaatcgttcgaacccaggaggtaagaggttgcggtgagctaagatcaccccattgcgttccagcctgggcaacaagagcgaaactctgtctcaaaaaaaaaaaaaagagatatactctagaaggcaaaagtgtgcaaacaatgttctcatctgtgactgaacacatttaacagatatctacacatatatacatatgtatgtatacaaacacacgtacacaaaattgggaaggctagacagcaaaatatccctaagtcctggtgttatcagcgattttattgcactttcccttttataaagttacactaaacccaaaaagctttgaaaatcaagtctttttttttttttttttttttgagatgcagtctcactcttttgcccaggccggagtgcagtggcactatctcggctcactgcaagctctgcctcccgggttcatgccattctcctgcctcagcctcccgactagctgggactacaggcgcctgccaccatgcctggctaattttttgtatttttagtagagacggggtttcaccatgttagccaggatggtctcgatctcctgatctcgtgatccacccgcctcggcctcccaaagtgctgggattacagacatgagccactgtgcccggcccaaaagtctttatctaattcatttggcatcataacctgaccagaactgacaagaatctatttatcccacttggggtaaatattcaaatatttcaatgcagaaaacattcaggtgtttgattatgaggtgctgcctcagaccctgctggaggtgttatgtaacacaaagtatacacaccaggtaagttttataaattgtttttttcctaaattccaaagcacacctggcaccacgaaggttcaacttaaatgaacctgtacaaatgcatatttttttattaaaaaaataatgaccatataacctcttaaaacataattttcatttcaaaacaaaaccaaccagaagcagcagacctttcctgggcccctcacgccctctgctggctaccagaagcagccagcctgacctagcaacaaggctgcaaactacaggatcccaagcctgctccttgtggacacaggcctgcccagggatttataggatctggggtattagagaccagacataggggcccacctatccgtaaggccatttttccccagctcaagcaaggggtggaacccatcccctaagaaagccagaggagaagcatctctggcaaagttgtaagcacaaggtttggaacgcaagagctctgggttccaaccccagctttgccacacacttgctgtctgttatcactctcagtttcctatagaatgggggatatgttgatctaccggacagagctgtgaggagtttcaggacctaaagaagctttgtaaataacgtaccatatactaggggaagttgtcgccaatcacagaaggggaggagatcagcacagagattatgcacaactgagagaccctcagaaagtcctaggtgagtagcgggacaggaggggaggaagaggtgacaagggaatacccagccagtcccatcatcagggcccacaccccaggaaaatgtggctggatttctagagatgacaaagacacctggaagcccttaatgagcttccatgcgcagcacaaggactcctgtttgtgcacaacattccagtagtccaggtgtccctccttgcccccaagcctgtggattaacacactccagccagttatgcccaagtccatcctggccacacatggtcagccatctcccagagtcatgggcctgccccagccaggggtctccagcagggatggtgcaaccacaactatagtcccaaacctgacacaagaataggttcttaaaaagaagggaacacagcgacttcctggctttggagagaggggaaaaagagaggagaaaaggagatcaaacaggagaggggctcctacttatccattcaagaaagacttaccaggtagctactaagtaagatactgggctgggcagtgaggacagtgaaatgaatcagacttagtctccactcttgataagctcacaaactacttagcagaggggtagggaaacaggtaaccaccacaaggtatgaacaaggctgtgaaaaatgtaaatgccaggtgttgtgaaacagaaagaggctgggcgaagtggctctcgcctgtaatcccagcactttgggaggccgaggcaggtggatcacttgagatcaagagttcaagaccagcctggccaacatggtaaaaccttgtttctactaaaaaatacaaaaaaaaattaactgggcatggtggtgcatgcctgtaatcccagctaaatcaggaggctgagggagaagaatcgcttgaacctgggagacagaagttgcagtgagccgggatcataccactgtattctagcctaggcgacagagtgagactctgtctcaaaaaaaagaagaaaagaaaagaaacacagtcattgggccaggcacggtggttcacacctgtaatcccagaactttgggaggctgaggtgggcggatcacctgaggtcgggagtttgagaccagcctgaccaacatggagaaaccccgtctctactgaaaaatacaaaattagccaggtgtggtggtgcatgcctgtaatcccagctactcgggaggctgaggcaggagaatcgcttgaacccgggaggcggaggttgtggtgagccaagatcgcaccattgcactccagcctgggcaataagagcaaaactctgtctcaaggaaaaaaaaaaaaaagaaaaaaagaaacacagtcattaaggctagcacctgagaggaggtgccacctgaccaaaggattaaaacaccaagacctccaaaaatgcttgttaactggatgagaaatgaagtcacttctgccacgaagtaccaggaatgcctggagcccagcaatgaattcagtagagctaaagttctgggtagtactaggcaggtaagcagggaggaccaggaagaaagatgaactcatattaactgaatacctgccccatgccagatgcaaagggtgacctcgtttaattttcctgaccacagcccaggtggcaggaaacattaccctcactttacaaaggcagaaaggaggccagacacggtggctcacgcctgtaatcccagcactttgggaggccaaggcggaaggatcatctgaggttaggagtttaagaccagcctggccgacatggcgaagccttgtctctactgaaaatacaaaaaattagcagggcgtggtggcgtgtgcctgtaatcccagttacttgggaggctgagacaggagaatcgcttgaactcgggaggtggaggttgcagtgagccgagatggcaccattgcaccccagccagcctgggcaacagagcaagactatgtctcaaaaacaaaaacaaaaacaaaacaaaaaacaaaaaaacaaaggcagaaagagaaaggagctggagtttggataccagcaaagcctagtgtagaggcaacagggaaggcccccacgagccacagcatggaggacataccttgcagcccatccacagaatatcctggtttgtctctaaacatgaaagagacctgaataggcccctcgcactgcagggtttgggtcctggggcagtcaaactggcatccaggcttggatctagaggctggactgctagccacccactggctttgtcatcagcagcctgaggagtttgggctctggcccttctctttctccttttggggagaaaatgttgctcaggaagggctagtaggggtggggggtaggggatagctcagccatagataagtttaagctccaacaatgccctggcctgaggagattgtgaaccttgcaaactcatcgctgagcctatgggaaaatccctccatatctttgagcctccacaaaaaggctgagtaaagctccctaacaccagaggatcccaggagctgaggcaagattctgtaacctagtggtctaagggcccaagtgaagttggagcaggctgtggaacccaactgacttaggttccaatctagctccaccaattattagccatgtgatgatgaactgctctgagccacagttttccaatctgtgaatggggataccaagcctcccaataatagggatgctgggcagactcaaatattacagggctttgcccagtaagagaccacttaatgagttcccttcccttccccaggagggaaaaaagcctctctagtaggctgattaatagccacgcaaagatatcaaaccctaacccccctggaacttgtaaatgttaccttataatgaaaaaggtagggccaggcgtcgtggctcatgcctgcaatcccagcactttgggaggctaaggcaggcagattgctttgagctcaagagttcaagactagcctgggcaacatggtgaaatctcatctctacaaaaaatacaggccaggtacggtgattcacgcctgtaatcgcggcactctgggaggccgaggcgggtggatcacctgaggtcaggagttcgagaccagcctggccaacatggtgaaaccctatctctactaaaaatacaaaaattagctggtcatggtagcaggcgcctgtaatcccaactactcaggaggctgaggcaggagaatcgctggaacctgggaggcgaaggttgcagtgagccgagatagcaccactgcactccagcctgggtgacacagcgagactccatctcaaaaacaaataaataaacaccaaaaattaaccgggcatggtggctcgcacctgtggtcccagctactcaggaggctgaggctggaggatcacttgagtccaggaagtggagggtgcagtgagccaagattacgccactgcactccagcctgggtgacagaggccagcactgtctgaaaagaaaagaaaagcccgggcacagtggctcatgcctgtaatcccagcactttgggaggccgaggcgggtggatcaactaaggtcaggagtttgaaaccagcctggccaacatggcaaaaccccatctctactaaaaatacaaaaattagccaggtgtggtggtgggcgcctgcaatcccagctactcaggagggtgaggcaggagaatagcttgaacccaggaggcggaggttgcggtgagccgagactgcgcctgggtgacagagtgagattccacctcaaaaaaaaaaaaaaaaagagaagagaaaagaaaaaaagtgtttgcagatgtaattaacttacattattaaatctggagatggggggttatcttagagtatcaggtaggacctaaatgcaatcacaagtgtccttataaaagagagacagagggaaatttgatacagacagaaaaggaaaccacatatacagagaaggcgatggtgaagatggaggcagagattagaatgatgcagtcataaaccaaggaatgttggcagccacgagaggctagagaaggtctaaattctccctgagagcttccagaaggagtgtggccctgccaacactttgatttggatgcagtgaaactgattgtggacttctggcctccagaattgtgacagaataaacttctctctctctttttttttttttttttttttttgagatggagtctcgctctgtcacccaggctggagtgcagtggcgcaatctcagcttactgcaacccccacctcactgcaacctccaatccgtctcctgggttcaagcaattctctgcctcagcctcccgagtagctgggattacaggcacccaccaccacacccagctaatttttatatttttagtagagatggggttttactatcttggccaggctggtcttgaactcctgacctcgtgatccacccgcctcggcctcccaaagtgctgggattacaggggtgagccaccgcacccggccaacttctgttgttttaaaccacccagtctgtggtaacatttgtcacaacagccacaggaaactaacacaccccccttggtagcactccttggtgtctgttccctagtgcctcacaggtgtgagacaatatggcatggatcccgctctgcaaggtccacctgcctaccatcctccagggtgggaggttagaattaaggcagcaggggcctggaatctcccttctcaccctgggaaactactgaccctgcctatggatggatgagctgccactgaagtgggggtggggtgggggggcaaaagatggcagcagcagtggcagttcatggacagatgtcttcccagagcctatggtcaaaaggtgtttagcattctgtgactcacagctctgtcccagcagccctggtgccaagaccaccccctccagcaaagcacccaggaacactagcctggctccatggacaaaacacagggggccaggcgtggtggctcacgcctgtaatcccagcactttgggaggccgaggtgggcggatcacgaagtcaggagatcgagatcatcctggctaacacagtgaatccctgtctctactaaaaatacaaaaatattagccagacgaggtggcaggcacctgtagttccagctactcgggaggctgaggcaggagaatggtgtgaacctgggaggtggaggttgcagtgagccaagatcgcgccactacactccagcctgggggacagagtgagactccatctcaaaaaaaaacacacacaggcaacccatccaacgaggaacatagacacactactctctaaggaccaacacaagccctccagggcagaaggggagaagagcaaggccccaacatttggctaggccactgagggcagggggattaaaaacctctaagattggcagggtgcggtgactcacacctgtaatcccagcactttgggaggccaaggcaggcagatcacctgaggtcaggagttcaggagaccagctttgccaacatggtgaaaccccatctctactaaatatacaaaaattagccgggtgtggtggcagatgcctgtagccccagctacttgggaggctgaggcaggagaatcacttgaacccggaagccggaggttgcagcgacctgagattgcgccactgcactccagcctgggcagcagagcaagactccgccttaaaaaaaaaacaaaaacaaaaacaaaaaccaaaaaacaaaaaaacccaaggtcctgttattcagtaatagaaaggaatgaagcactgatgtatgctacaacatggataagccttgaacatattatgctaagtgaaaaaagccaagtaacaaacaactgcatattctattattccatttacatgaaacatccagaacagacaaatcaatcaagccagaaagtagattagtggttgccagaggctggaaagggatgaggaaattgggggatcatagctaaagagtgctggatttctctttaaggtgatgaaaatgttctaaaatggactgtagtgatgtgatggacgcacaaatctgtgaatatactaaaagccactgaactgtacacttcaaagaggtgaatagtatggtacatgaattacatctcattaaagttgttaaaagaaacacacccaagggctcagcaccagccaaggacgctgaacactgcttgaaatgtcctagcacaatccccaaaggccaaggggtcccacttaaaactttcatgaagggtgaggggagtgggagcagggaggagactataacttgcttcagagcaatgagtccaacctccctcctcaacactacccatttcatggagggagaaaccaagaaccagaaaagagaactgcctgaagaccacagaaaagcttactgcagaaacaggactcaaatccacgttgcctgggcagagaccccttcctgcttccccaccagctagctacccaattccagttggggtaagaagagcccaagaaatcagcaggttcctagatgccaaatgaagggcctttgctatcaaagataggttactaggagtggacaaaggctcctaggaagaaccaagatgaccctggggcaaactgcccattctgggcaagaggaagaaccggccaaggtccaaggtgagcaaggtcagacacacctgggcatggacaaacttttgcaaaatgggcagctgagggggcaagtagtttgcctaaagctataaagcaggtaaggaggagatgctgaggtctggaggtgatgagagaattgagggatgatggctcaaagcttgccttgctccaaagcccaaactccacacacaactctacctctctacaccactatccaacaggcctcctgacaggaaatcccatcgagcttgttcattacaacatggctgcccacaaaaaatggctgttcatcaaccctgagcctcacacaaaacaggctgcttgtcctgcccaccaagcttggatggctgagagggaacagaggagccaggaagagaggggagaaacccagttcctcctcaaaagacatccaccattctttgccacctccaggtccagagaactttggactgagttccctaaaatcccaaagctaaacaacacctcaccagcattttgcctggccagtgaggaaactgaggcccagagagcataggtagaacctaccctggttcatccagcaaagccttgaaagacccagagttggaacccaggcaccaactaccgtgccacacccagctttttccaccacctcagttcacatgccccttctcaaagagctctgtggggtctccaaactcaggatgcttacaggccaaccttttcatagagcagactctcagcaaggcagccatgcctgggaacccctgacatcaccacccacccagcacctggaccccagagtgccaaaaagactcctaaaggaagtagggatacaagagaatcaggacaaagaggaagcccaagtagtcagaaccccagaatcgccatctagactccccctcaacgacgcctctcttcccaagggatccaactgacctccaggctacaaccacccccagtgacagtttaggaccaagactggggtggcaggaggaatcttccctcttctcatccccaaaagctctcaagttggaccaggtgaggcagggagaagaggatcaccttctttgtcctaagaagtgtggggacagaaagcctctcctgtcattgggaagggcaggtttcatgaacccacaaaacttgattttcatattcttttttttttattagtaaagatgaggtctcgctatgttgccaagcaggtcttgaactccagggctcaagtgatcctcccgcctcagcctcccgagtagctgggactacaggcatgcgccactatgcccggcttactcctatgttcttatggggacaagtataagggagggactgcaaggggcataaggaagtgtttttgagttaccatggcagcataggatgttctttctctctgtccctgggaccagggatgtatcgcaagggaggggagtaaggaggtgtttttgaattatcatggctgcataggatgtttttcctctgtccctaggaccagtgatgtatggctccctgcttctagaggaggaaagaaactacccaaccagagagagaagaaataactggtcctgacccttgagtacaaatggcttatcgtgccagaattaatgatgggaggaagggaccaagaacaaggagctcaagacaaggcttggggcccctgtgaagtacagaaagatttacctgagccaaggggaaaaggaatgtgggaggagaatttccccagagtggcgatgtcccaaacccctttcctgtccctgggaagaaaaaagcttgtcaaaagcagttcaaaacttattatatgacctagaggtgagaagcaagcatagctaggtcagggagagactcggaatcgctcttggtttcagaagggaggctccagactccatgtccccaggacctgacaatcttctcatagaaagtaggaggaccttcttggccctggccacgagggagctctggataaggggttcatatgaccctgaagagcatccaggtccttctgtccaatgggagaggatgacctcacgttcctctccctggacagaaaggattgcctggtgtggtaggaggagagcctcatgcccaagtgggagccaggcccccagtccctaaggcaaacggtatcttgtcccagagagaaagcttgggcccagactcttttcctcagaatcctaccctattcatgtccccaaaaggagttgggagtctaaggcccaagtccccgaggcaggaagtcttatgtccctaaatgacccctaagactagggtgtatgtaagttgtctgaggtgaggtgacagtaccctcagggcaggttcagaaatcaggtcctaaggtggggaacaggccttcacacacctgagttatgattcaaacccttggaggtagactcaggaccctgttccacagggatcctttatccatgccccaagggaagagtctcagggctcaggtctggggggaggagtcctcctgtttctcaggtgtacatcttaagttccttgaggaggaagctcagaccttacctctagacacacaagtcaccaaggtatgtatgagtctcctgtccctgaaggaaagctcaagtgtccttggcagagtgggtctcaggcccttaaaagtaggcaaagatctgtagggaggccccagacatcatctctgggatcccatgttgcccatgtcccctgagtagtcgtctcaggctcaagttcccaaggcatgggtcgtatgtccctgacaaaaagcttaggcccaaggtgggagggcctcaaacccctgttacagaggggaaaatgggatactgtatccccaaggtatgtttcagtcccttataattggggtaaaagggtcacatatgctcgtggggtggggagtctcagatccccaaaaccactcagacaccagccttgagaagaaggatctcctaaagacttcaccttgtctgagacctttgcagcaggacaccaggcccctgaagaggcctcagactcggtctctaaaaacctcagtccataagcaggtggatcttaggccctaggatccaacgctgtgagtctcattttcctgaagaaaggttcaggcccctggtgggggtgctgagggcccatctcttcttacaagaagcttaagatcctgaagcggttcaggcccttgtctcccaagaggtaggtctcaggccactgataggaaatgcagacctttgtcactcagaaaggagataagtaaagctgctggtcattgggtgttggttttggtccctgtccccaagggcaagggaatcatatctccctgtgaaaagtcttacatccctggaaaaagcttagaagatccctatccttaaagggggcgtgtgtgtgtgtgtgtgtgtgtcaggaccttgattctagaagcaggactctcaggcccctgaagacagacttaggacccttgaggtctcaggtctggctattcagtggtcctgtgcagtgttacccagcgaagcgggagaggattgtcctatatgcagagtgtctcagactcttgaaagggcttaggctccttggggatgttcagccccgatctccgaggtctccaccttatttgactttcctggaaggggaatctcaaacttctatcccagaggaaaagagctcttaagccactgaacacatacctaagtctcttgggagacctgagactcctactcaagaggggcgcgatcctacctgtatctcttggagaattcccacctattggccctatatgatgaggtcccagggactggaatgacgactatagaccttaaaagagacctcggatctttaagtctgacaccttaccgtaggcctctagccccaaaatcctggaggggaggaaagaaggtgtctcacatccctaccgccagagaagactgtcaggcccagtgaaaacgcctagatcccttggggcgatctcaaacagccttccttgagtcccttcacagtctgggggtcccatctgccgtggccgctcacccctcaccccacagctcttacctgctcgacagtggcagggtccatagcctcgatgcgtgctgcagccgcctcatactcgtcctcactgttgtagcctgcgccgacctcctcacgctcgggactgcccccgccaaccgcgccaaccccgggagcttgacgtcgccgcttgctgtgcccaggcccggagcagcagccgcccacgcctacggcaccacccacacccaccaccacgcccgcggcacccacacccgccgccgctgcgcccagcgcgtcgccgggaccgccgccgggaccacctgggcccccgcaaggaggtggagaagcctgttgtggccggggacccgccactgcaccaggcggcacggccagcgcccagcgatgaagagcgcccggcggtcctggtagcgggccttgaggcggtggcgaagctcgcggacgggcccccacgacgccggagtcacggtcgcgatcgccgccgcccacgcccgtgccgccgccgcccacgcccacacctccgccgcgccgcggcgccgggggcatcggcccgggcggcggcggctcgttggcggggtcggcgtcgggaggcggcggcttctttttggggagtatagtcatggctgcactgccgagtaccccccaacaaacccggcgcggggcacgccgggagagaacccggatgagggggctagtgtagtgcgcgaggcacgacgggaacggcgagacccggataaagggatcgcggcaccggttcgagaaccctcggcggcggaggcggcggcggcggcggcggcggcggtggcggcgcgcgggtcacgccgagaggagaacccggatgtaaagtccaagatgaaggcagtgcggcgagtttgtcttagccttctctccaagtccagcaagtttattgctacgcttgttccggccttctgcttcaaaggaaacagaaccaaaacaagcacctcttcgctccgccccctcgcaggttcttgcactaccgggtggggccccggggcgctgcgcacgcgcgccagggcacagccccgccccttactcggaagtacgtgggcaaaatcgccgccgccgccgccacaacaattgcaacaccaaccaattgagcagctgcgtgggacctcgacgacgcccacgggccaatcacaggcgagtgctcgccctccggtgccctccgtctcaaatttcagtcaaagtcgacaccctggttcccagcctttctccccgtcagttccgtcttgctcttcacttttctccccgaagctctgacctgcaggcgtcggtactgcggacggacagcgtggcctgtcccacgtacgacaggaaaaacacctcccctccaggattccaacttgaacgctgtcagccggaatgactggaaaacatcaacactcccgggagcatagctggcccctgtagcgtcac

SEQ ID NO: 1869 - DNA, 9614 bp, Homo sapiens
tcctcatctctcctctcaggttttattgactgatggaaactacatctttgtcagccaccagctccatggggacagtgctggggacagggaacctgagatgatgccagatttcagcctgagagcagagttttggaaggtcacccaagagggagaagaaaggaatatgtgaaaaggaattgtaggggaggaggaggaggagaagttcctcctgtctcctataactcccaaagttcagaaacatcccaggccggagcccctgatgcttctggactgttgcccaagaacatggaatcagcccatgatctccaaatacagcccagctcttgctggttgccaggctcttatctcagccagtccagactccagcccaacccaggaaggacgcaaaccagaggagaagagaggaggaggaggagttagaggtggcccctctgattagggcagatgtaaatgctgcagcaaactggtcagaggctttgcataatgacacggcagcagctgctattgctagagtttgctgggggcccagcagaggacagggttgcggggtccatttccagcagccagggaaggggatggtagaatttgtgctatctgagtgtgtgttgggagaggcagcctgacccctcaggcaaggcctggggatggcaggtcgctgcagaggccacagcccatgaagcctgtgtttgcattccaagcttcagaatctgggaattgttgggccagatggagatgaggacctctcgtagaggccagatcagaggtgagggttctcttctctgaacctccaaagctccatatcccagccagagggaggaggaaatctcaactctccttcttaggctagagctcagatgtcggatcaaagctttgccttcatctgagagcccaaggggaggagcatgcaggagtccagctgggagagtggggccagtcccagtgtgctagggcaaggaggccaggggcctgtggaagcccagtgcttcagctcccaccaggaaaaatgtctggggtgggaggaagtttctcatttcctggctacttccccactatgtggaccatttcatgaaactccattgcatagttctcagtggggggggcagaaggggtgcccaagcctgcccctctctgcctcccaaaaatatggctttggaaaggagttcccaaaaatgaagaggaccctctgaatcagcaggcctacccctcacagggatgagatcttgacagtctcggggaagaggcaaggggtacccaggctggagttcctgagggtgctgccggccctgccaccgccgccaggggaggaaggttggctctcatctggggtgttggcaggaggggtagggatgctgataatggcagccacgaagtcccggctgtcgcagttcaggtcaaggctgtcatggggcttggcattgaggctggagcggctgtggacaagggtggagaagatggaaggctcttaaaaagttatcttaggccgggtgcggtggctcatgcctgtaatcccagcactttgggaggccgaggtgagtggatcatctgaggtcaggagttcgagaccagcctgaccaacatgatgaaaccccgtctctactaaatacaaaaaattagctgggcatggtggcgcatgcctgtaatcccagctactcgggaggttgaggcgggagaattgcttgaacccggcaggcagaggttgcagtgagctgagattgcaccactgcactccagcctgggtgacggaatgagactctgtctcaacaaaaaaaaaaaaagaaaaaaagttatcagccgggtgctgtggctcatgcctgtaatcccagcactttgggaggccgaggcgggcggatcacgagatcaggagattgagaccatcctggctaacgcggtaaagccccatctctactaaaaatacaaaaaattagccaggcgtggtggcaggcacctgtagtcccagctactcaggaagctgaggcaggagaatggcgtgaacccaggaggcggagcttgcagtgagctgagattgcaccactgcactccagcctgggtgacagagtgagactctgtctcaaaaaaaaaaaaaaaattaatacttgccacagcaatcatggcatttattgagcacctactgggtccctggcactgtgctaagtacttaagtacttctcctgcatccccaattatggtggtaaagagtgaggactctagagtcagatagtcctgggttcaaatcctggtcccactttaaccactccaaacctctctcttctctcatctgtagcatgggacgaacactatctcccacctcatagggttgctgtggagattaaatgagattaaaaatgatacgaagtgctcagagcagtgtctggaacacaatgtgcatacatatgaaaatgctatctctcatggttactcctaacagtgtccaagtccttacaaactgtccatagtaggatctaaggtgggaccctcgctcctttctgagtttgcctcttaccagtctcccccagctcactctcctccacccatgatagcttccttgctatgtctctaatgtggacccacatctgcctcaaggcctttgcacaggctgttcactctgcttagaaagctcttcctctagttatctgcatggcccactcctttgcctccttcaggtcttggctcagttgtcacctcagtaaagccttctctgaccacactactaaaactgcatcaccagccaagagtggtggctcacacctgtaatcccagcactctgggaggccgaggcaggtggaccacctgaaggtcaggagtttgaggccagcctggccaacatggtaaaaccccatctctactaaaaatataaaaaattggctgggtgtggtggctcatgcctgtaatcccagcactttgggaggtcaaagtgggcagatcacaaggtcaagagattgagaccagcctggccaacatggcgaaaccctgtctctactaaaaatacaaaaattagctgggcgtggtggcgcgcacctgtagtctcagctacttgggaggctaaggcagagaattgcttgaacccgggaggcggaggttccagtgagccaagatcgcgccaccgcactccagtctgggcgacagagcaggactctgtctcaaaaataaataaataaataaaaataaacataaaaaaataaaaatataaaaaactagctgggtatggtggcggacacctgtaatcccagccacttaggaggctgaggcaggagaatcgtctgaacccgggaggcagaggttgcagcagtgagccgagatcacgccactgcactctagcctgggcaacaagagcaaaacttcgtctcagaaaaaaaaaaaaaaaatgcagccaggcgcggtggctcacgcctgtaatcccagcactttaggaggccaaggcaggtggatcatgaggtcaggagatcgataccatcctggccaacatggtgaaaccccgtctctactaaaaatacaaaaattagccgggtatggtggcacgtgcctgtagtcccagctacttgggaggctgaggcaggagaatcgcttgaacccaggaggtggaggctgcagcgagctgagatcccgccattgcactccagcctgggtgacagtgagactccgtctcaaaaaaaaaaaaaaaagaatggatgaagaatgagttccagacaagataagcccaagcttccagcatggaggggtttgggttcgagcttgacttgctaggcctggagttatgaaatctcagagctactggtctaagctctgagcttccccaggtgtggctagcaggtaggagggctgcttacctctgaggggcatggctcctgcgcagccctgccagcatgtccagctcctgcatgctgccacggctgactgaggcagtggagttggcaaggcggatggcgcggcgcttggccctgcgagggcagcaagaagacagcaggcttccgggtcccactggctgggaagacacagaggtgctacggctggtgcggccacccggcgagacggctcccagggcttcactgaaggtgagctcatctgtgaactcatggcactatgggcagaagggaggcagggtcacggggcatcccatgggagctgatcccaccctcaagcctttgctcaggctgttttctcctttctggacattgttccctcttcccttcccttgcccattcttcaaggcttggctctcctgtagcctcttccaggaagctctgtgtgatttccacaatttgtagtgagcctcccatccaagggagagagctggcatggccgcagagggaccccctctattctgctatatcacctcacattaggcctcaccgttgtcttctctagacagtgcagcaagtggtgatgttgctgttcaaaggcagaacggttcctgacacaaagagcctgttcctcgccactgccgctgtcctggagtagatggagcagagcgataagggcagcaccttcctccccgttatggctcaccccaaccctatccaggccccgacccacctcaaggcccccattctgcttgtactgcaggaaggcattggtggtaccactctttgccaatcggatccttgccaagcgcaccttctgcagagagaggagataaaaggtcaggtgggtaagccccaaagtagactggcttggggtgtggggagtaggaggtgctcggatggaaagtgcggttacctgctgtgctcggcgcttgtcagcccgctggttctggtggtagatgcggctaaagttggacacaatgactggcacaggcagggcaatgaccaagacgccactgagtgagcagatggacccgaaaatcttgccagcaatggtgctgggcaccatgtctccgtagctggagcgaggggaggtaggccaaggtcaggaaaagtgcccacctacctttcagtcccccactccatcccatctaatccggactagctctgtgaccctggccaggcactcaaaccttctgagtccctcagtttcttgctctgtaaaatgctgggtggccaagtgagaaatgggcctggccctcaacccctaccatctgctgcccctgtccaagctacataccaagcacctgagtcagctagaaatctatgaaaaccaagcagaggggagcatgaggaagtcacaggcagtgaacacagcctcctggggagagagtcccagcaccacaggccagccgaagggcttcaagtcccgggaggagtgttttgttggttttggctgcctctgtcttacctgctctaggtaggaccccttttcattcccctataggggaatccttgaaaactgtccacatatgacaaaatagggaggagccttgaaaccctcctgcctttctccatgccacccacctcccacagagacagagcagagccaaccttactaacttgttcacagagagctcccctgaagatcagggagattctgtaactgactcgcccaagatcacactgcatactcttgttctgaccgcagaaccaatcagaactcctccagagaaacacagcctctgcagtcttcagcctctaagccttttctcaggctgtgccctaggatggctgttccttatttcggtattttcactcattttaagcattcaggactctgctcaaaagtctttccaacttggccattgctggctctgtgatgtgtcatctcagagcgtgtcctcaactgtgagacatgggcagccatccaccatcacagagttgttgtgaggacttgaatagagtaaaagccatcaaaatactcagttccagcccactgtcagcgctcagtatttgtttgtcagtctgatcctggacctccaaccagaattggggtttctacgctttagaaaccccaaatcaacttttttttgtacctctatgaagaaactgagcaaacccaattcattcagtcattccttcaacagatactgagcaccaactgtatacccaatcccagtgatggaaacttagagaaggatcacagcatctgccctagacagtatctttggaaagctcatgagttcgatgattccatttgatacttttatcccaactctgtttcttctgcagggatcgacaaaaaaataataataataaaaatgctgaaaacatcttgttctgggaaacatcaaggaatcacaaaggctcagaagtagtgccccacacagcagacaattctagaaggttgggagacatgggtccccaaaacagaaaaaggtgctagaaagccaacacctatgtatcctgcaccagaaacattcagagaactttcacaactatgatgtcattgaatcctctctagatgatgaagggatcagcatttcccattttacagaggggaaaactgaggccatgagaaaacgacatcaacagaaagagagcagctaagacaatccttgaacccaagtctcctgacctagaaaatcaaggcattgtcagagctgggagggatctgaagaattaagtccagctccctcagtttgtacagatgagcaaactgaagctcaaaaagagaaagaggccaggcgcggtggctcacacctgtaatcccggcactttgggcggccaaggcgggcggatcacctgaggtcaggagtttgagaccagcctggccaacgcggtgaaaccccgtctctactaaaaatacaaaaattagctgggcatggtggcgtgtacctgtaatcccagctacttgggagtctgaggctggagaatcacttgaacccaggaagcagaggttgtagtgagctgagatcttgccactgtactccagcctgggcgacagagtaagactccatttaaaaagaaagaaagaaagagatcattcctttaaacttcctaattttacagaaagggtgagtgtaatcgggcagcccccaacgcagagtccacactcacccaagcgtggtcatggtgacaatggtataccagaaggccgcagggatgcttgtaaagttggtcttgtttgtgcccttctcagcataaaacatgacagtggcaaagatgatgatggccatggttagggaaaagaggagaaagcccagctcagaggcacagctcttgagtgtgtagcccagaatcctcaagccctgtgagtgcctggagaacttgaagatgcgaaacacccggaacacacgcagggtgacaaaggcgccagagacatcgtcgttcttgggcaccaaaagcccaatgtagtagggcaggatggccaccacgtcgatgaggctcatgacactccgcaggaagcggcaacggctgggggcggcaaacagccgcaggaggtattcacctgtgaatatgagtacacaggctgtgtccatgcagaaaaaggcctgtgggaagcgttcgccacagggctgctcccttgaggacctgcgtgcagagccgcggcatgggatggtctccaccacattggcgatgaccgacacggcgatgaagaagccggtcacatagtagaaaacgagggctgcggtgctcgtgtgtggattctcgaaggcccgccagagccgctgccgcagggagctgcctgctggcagggctgggccgtccccggcctgctctgcctcctcatcctctgccaggcgctcggcattctccttctttcggtcccgatactcttcaaggcagcagtcaccgactagctcgggaaccaggccgtagaaagccagctcttcgtcgaaggcctggatgcactcctgccgtgggcaatgcagccgccccgttcggtagaagttcagcacatggcggaacatgtcagggtcgcgatcgaagaagtactcgcctgagtcagcatcgtagaagaattccttctccgagctgcccagcaaggtgtctgggtagcggtccagcgtattcttccaagtctcaaagcgccgtccgctcacgttcaccaccagaacctcatctcctcgagatgccttcacccccggtgccgggggcaggggttgctgggccaggggcagccagcccactgctgctgcccgagcaaaaggcagccacgtggccaggcctgccgccatcgtgccactccccaagcccagggagacttagtgagggtggcgtttaggagaatgtggctgtctccaggatggtgggggcttggagacaccttgagccacccaaacaaggaaactgggggtgtctagagaggccaagaggaaccaggaggaagaactaaagagatgggaaggagtctgggggacatttacagaacctaggaggggcctgggcaatgttctgagggactgagaagggccttggggacatggagaagagcagaaaaggggtgtggggatggggccaagaaggagctgagggagggtttagagagactgagatgattctaaaggagtcagcctgtgcctgagaggtgtctgggggcgtctagaggggccaagaaacacgtggggaattctctgcactctcaagagtctcagggaaggcagaagagcctggaattcctttgcagtggtggagaggagactggggcatccagaggggtagaaatgggaccagaggtgcttgaaagagactgagagtgcctggaagtgggggttctagaggggctgagacaggtgaggagggttgtccacaccctcaagacttctaggggaagcataagagggttagacccccctcatggatctggaaagggagctggtgcatcttgaggggtggctgtggatccaggaggttgtaaagaggctgaaaggtgtcttgggactgcctagagttgccaagaatagcccgggggggtgtctatactctacaggagttctggggaagaaaggagaggccagagcctcctagtagggctggagaggggaaggggttatctaaaggggtagacagggggctgggttattttttgagaggctgagagttatctgggggaggtgggtatctagacgggccaacaaagcctggtcgacactctcaggagttctacagggaggaaaaaggggcctggggaattccaagggccgggactcaaatgttaggaagttgggcacaatcccagagcacccaggggatctatgaagactaaataagaggaagggggttaaccccaaaatgggattaagaggggggtggggtgttgaaagggagttgggtgtgtctccagggaggggggctcctgggctttgcaggaagctggcaggagacgccgggagaaggctgggtcccaccgttgggggcaggtctggggaaaccacaccccgaggggctggcggtgtgtactgggcagtggcagtagcagcagcggcagcaggaggaagagaagcaaccacagccaggcataggagagaaggtggcataggcagggggagggtgcggggtccctggaaggaggcctgggaagggcaaggtccagtgggacccctggggactatcccaggatgggttagggcgtgggggctggaccagggaaggatgaggacagcgctagtggtggtccccctccccctctctctcggggcgtcctcacctgtgtccccgctgcaggagcagcaacagcggtggggctgggggtaccaaacacccgagctcctggccccctctgcagagctgcctgagttctcctcctcctct

SEQ ID NO: 1870 - DNA, 35592 bp, Homo sapiens; identical to SEQ ID NO: 1866

SEQ ID NO: 1871 - DNA, 35592 bp, Homo sapiens; identical to SEQ ID NO: 1866
